United States Patent 7,868,149 (PLANT GENOME SEQUENCE AND USES THEREOF) - sequence listing, part 55

SEQ ID NO: 29854 - DNA, 1736 bp, Oryza sativa
  unsure (1)..(1736): unsure at all n locations
tgggctatgtactatctgctgccgcggtcgacttaagatcccttttaccccggtaggcctggttcagttaatccctacgagatagggattggaggggatttattccacacctattgtgatgtggaaggattgtctctcaatcccctctaatcctctttaatccccacaccaccgtagaataagggctcgttcgatgggaaattgaagtgatatgcatcatatagtgcatatttgggtctacattaactatttttctacgattataatgtaactatgaaagtgcatatgcacacattactgatcgatcagtcacctttctttatgcggttacaagaaaaacgtgcacgctcaaaaaaccaaccatgcacaccatttatccacatctgtgattataagtgcaccaatacattggttgtgtacattggctttggatctaatggtcgggttttaatccattttctgaaaaaatcattggtatgtgctgaacagtcagatagacctgataaattaaataatccgtaaattttttaagtgcttactcgcatgtggtataattatagacatcatgcatcctcaacttcaccattgcatcttaggaaaggaagtatataatgggaatcaatgcgcttagttcagaattgcacctccattactaatggacgtggactagtggagtattatatcggaagaagtatcaaatcaggtgtattgccctctgctgaactcaagggcaaacttataagttataattctcctttaactcaaagagacacagctttgtggtcagagtattggaaatggtttgaaaagtttttttttcgcgaacgcaaaaaaaattgtacgtcaatatattaaaggaatagagttttttttacacaacgcaaaaaaatgttttaaaagtggcacgtgtaatcatctgccacgggtgcagaacgactttaagcatgcagacaagagcaaaaaaaagcatgcagacaataccaaagacagcatgaacgaaaccagcttcaattgaacacccaaacatactatagtttccacaatatattctccatcaatccatcatcatttcaccggtattttttatccgtcatcgatcgatcggtcgattgcatcaacacgcacaaaaggcaacacagcagctcgagaatccgggcacgtaagctaattattaacacaacataaagggctccacacgtgttgccaaagttgccacgaaatgatgctcagtttttttttaaaaaaaataaccatgtccgttggtgcgatgcgtacggctgaaaaggtttgcagcagaataaatataccgatcgaccaaatacaatctaagcacatgatattcacccaacacgaacagattaaaaattgacagcacataatttctcagcaactgcccgtcagctcagataacctttagtttactgccggatcagatagccgtgaggacagtgtcagaatccattacgaggcaccatttgatttagattagaaaaacagacttaccaaatactacgttcgtcctaaaaaaaataagggaaaattgtaacatgccattataattttgtaaaatttgagatatgccatcttgacccacatgtcattgactcatgtgggtcctatatgtgattgagatacggatggcatatctcaaactttaanaattataatggcatagtcctaattacggggatctcttagagtcgaggtgcgggcaaggagattgtcaatcaaggaca

SEQ ID NO: 29855 - DNA, 1256 bp, Oryza sativa
  unsure (1)..(1256): unsure at all n locations
catgtggcttgaattagactaatctcgtatgcctgcaggtcgactctagaagatncccttctgaaaattccctgcttgggctatcctttcattttgcatcacctgcaatattgcttcaaccagtcaagttaaacatactaatttgttttgtgggatccttatgagttattgagaggtagtaatatctcctagggggatcatgaaaactgataggggtagctactgaaaggtatacaaaactacactaggagataccttacacctaagcctgcaagggctgtaaaattctctaaaagattcccatatgcacagcatgtttttagcagtcatcattatttatcctaatgttcagtacaatcatgtctttagtttttttttcaggggcttaccataataaggtctgcatcaactagaaattcaacttggtgcgtgacgtataacacagttttatcccttaggacccccatcaggcatttctgcaaaaaatgtatagagccaatgttaatggttatgtaacagggcttctccttgccagtaaaaatatagatatgagcaatttattttagcgagagaaataaatatcaataataatatggacaagattattgaataatcacaagatctcaaatatacgatgcccattgtttgtcctagagaacatgatgacttcttttaactatggaaaatttgaaaccatcaaagcattatatttttgtgaccctggggttaatttcttttgttggctcttaaggggaaaaggaccttgtatagatgccttccagtttgagggtctacagcactgaaaggatcatcaaacaggtagacatcagcatccttgtaaactgctcttgctatttgaatccgttgcttttgtcccccactcatagtcgttccccgttctcctatatctgtcatatcaccatccgagaaaacttcgatgtctttaaccaaggcacatgcttcaattgtccgctcatacctatcagtttcaaagggcgtccacaaaagaagtttctcttatagtcccgaaaggttcctttaccatgggaactatatgcttgtttcaaaaagactaaacggtcttggacctttgggattnttcacaacaacagagacagggtttaattttcattccaaaaaatcaaaaaagggcctttataaaccttgggggcttcacccgtataattgagagtggtattttgaaattttcaacagaagagcctggaaaatctgggaaaaaatatttccctttgtgt

SEQ ID NO: 29856 - DNA, 1568 bp, Oryza sativa
  unsure (1)..(1568): unsure at all n locations
gagccccccntttganatcatttganatctcgtagctcggtacccagcagagaaatgatgcaggcttacccaaagcatctagctgtttttttttcccggatcctgggggtcgccctctgcgcttcccgtcagggttcgagttcgatcctgcaccacctgaaggtccgccggcctccgtccctgctgcagccgcgggcttcagtcccaacccgatgttcccgtcaggaccatacttcctcggcctccccctcttcttcttcacgagctcccctccgccgaccgccgtgccgccaccgccggaaccgggctgctgctgcatgccctgcacgacgggatcggtgcggtacatggtccccgacatatccgcgggcttcataggcgacgaggcggtcggcgacgccatggggttgaacgagagcggcaccccgtgcataacattcgccgaccccggcggcatcgccggcgcggcgccgtaggggtgctgaggcatcatcacgccgccgccggccggcggcggcgagctcacgcgcggctgctgctgctgctcccggccatccatcccggcagcgaaaccctagggcacccacccccacctgaatcgaagccgccgccgccgccgcagcagccgctcctcgcgacctctcctcacctgcgcgtttcgccgaacagttcacatgcaccgttcggcgcggcggttgtacgtgagctctatgcaccggaaaacaaatctcgaaatcgaataaaatacatcggaaatggaggaggaggaggaggggacagaatttctgcggatgcggagaaaaaaattgggaggagaaatggagaaaacagggggggaggtggcgaggcgagaggggttacctcactgtgaggggtcagatcagatcagatctgagtgacgagaaaacgcgagatatcgagtaaaataactcgctgcctcctggctcgccgcggcgtcaggacgagaataggaaacttactactgtactgtatttgaacctttttcgtgatgaaaattgttgttttttctacaaatctatctattttcgtttagattattttttttaagtcaagagagaactttattaatgactaaatagagggttacattcttgatttaacaagtctaggattatgcgggggcggcgcacagcctctactccccacacgacctagtactcattgccatttgtgctaacacatgagcaaccctattagcttctctcttaatcttgtgcacttgcacccgttggatacattgtatcacacctttgatttctgcaaccgtcgtcgcccaggaggatcttgaagctacctgctgtgttagagccttaacaacatcagcattgtctagctccagaataatcggcatatgaatccacttcattgcttctttgagcccttctaaacatgctagcacttctgcttcagccgctgaggtacactgatgcaaagttttatatgcagccaggagtactagcccctgcaatctctgatgataatnnnnnnnnnnnnnnnnnnnnnnnnnnnnnnnnnnnnnnnnnnnnnnnnnnaaatcaaagccaccn

SEQ ID NO: 29857 - DNA, 2132 bp, Oryza sativa
  unsure (1)..(2132): unsure at all n locations
ccgtggttttgattannnnnnnnnnnnnnnnnnnnnnnnnnnnnnnnnnnnnnnnnnnnnnnncttctccggcgagctggggccgtcaccgctccaccgcctctcctccggctcctcgctcccccactgccggtcatggaagctcgccgacggcggccgcttccggtgatcctatcctttattaatttttttcccgcgctccgacattatttatcccttttgggaggcttttcttttttcctttttacctttacgtgtaaactggaaaagaagaattcatcctggccaaccacgagctggcaagctgtcccactgacatgtaggcaccgacgtttgtcaaaggttactgtttgtcagttgaacatgttgcaagccactgtaaaaaaaaaagcttcttgcattatctatgtacaggattactcctagcttttaaattattttcaagatattatttctttcttgtgtttgagattcccaagccaatagatttagttgtgtgtctggcatggagggaatgaagccatgtgagcggaattgaatgtgagcgttatgaattgaagatctgaactctgagaactaagtactcctacttactccctccgtcccaaaaaaaaaaaacaaaccttgggttttcatatccaattttgactgttcgtcttatatgaaatttttttataattcgtatttttattgttgttagatgataaaatatgattaatattttatgcgtgacttatctttttaatttttttcataatttttttaaataagacggacggtcaaatgttgggtacggaaaccagagtttgtctttttttggacgaagggagtacttcagtagtgctgaactgctaatgtcaacttggagtaactctgtactcatgcatccatgaagtcatgaacctccnacgatctgatgtctgatgagtgggcactgtggatggatcgtggctgatggttgtagaatcgtaatcaactttatgataaggtcataaggataatttatccattttaccatctagtcagagaccttgtccccttttttctctttttctgaaggcagaggttgacatgatcaagaaattcaagatctcttcctgttgtttcttcattgcttttgccggtacactgcgcaccaagcgattgtttccattttcgtccgggaaactataattgtggtatggctcttccagtcgagcactgtttcaaccacacgacgacagttgccggattcagtacacagtccgttggcaacatttactagttcgttgacgttatcgcgttgcatgtaatgtacaggatgaggtactcgaacaggtatgaagttttggtcaacaaatccagcaaatcttcagactggtcctccaacagacgtaggttggctctcccgttctcccagctgcaggttttcgtaacttctgaaactgcatatcctccactgccaccttgatctgaaattctgaatctacatcggtgacagttcttttgatctcgtttgatggctgttgccatcacctctcagtctcaggctctcaccggcgcgccactaaggtcaaccggcttcatcattctcatcgatgcatttaaaaagtcaaactcgatacattaacggctgcagatttggcgaataaacttgctgatgaaaagctcgcaatcatggggcatgcttagctagaaaccaccatcgacatgggcagttgagttgggaggtgattgcctcgacagagattggccggggtttgttgcgtgcgagctcgctttctcatcatctcggatggactcccatcatggcaggtgctctcgctctggtcgagaaaggtcgctacctttccggttaatcagaggttagctccgctagtgcggtggtggtggccgtggccgtcgtcgttgtcgtcctgccaaaagcttgcgatttcaccgaatcgcggtgagctgtgatgcgcgcgcgcgggcgtgttatgggtggatgcaccaacctctgcttgccttgtgaacgagcttactctctgcctgccggttgctgcatctgttgaaaaaaaagaaacatcatgatattagttttgaaaaagcgtttttttttgttcaattttcccaactattcccagagctttttttacacttccgggggggtg

SEQ ID NO: 29858 - DNA, 1832 bp, Oryza sativa
  unsure (1)..(1832): unsure at all n locations
acgggcttgtattgactatcnnnnnnnnnnnnnnnnnnnnnnnnnnnnnnnnnnnntgtgttttttatggattaaaaatgttgtcacgaatcttacctccacatgcatataaactctcaatatttttcaaaagaacttctttggcttgctgctctaagaattgcgttgaaccgtggccgtcgtcgttgtcgtcctgccaaaagcttgcgatttcaccgaatcgcggtgagctgtgatgcgcgcgcgcgggcgtgtgatgggtggatgcacgaacctctgctcgccttgtgatcgatcgtgcgctctgcctgccggttgctgcatctcttgagaaaaaagaagcagcatgatatcactatggaaaaggcgtattttttgttcgattttcgcagtaatcccagagcttttctacactccgctgggtattactatatgtttattaaggacaggagtatatgaaaagtggattttgattttttttagataatggaataaataaatatcccggcctttactcaaaagagctacagccaattattatatagaagccaattatatgaaaagtggattttgatgaggaacataaagctttaatgctgactgtctgacggccgttggtttgctagtacacattgcttcgctgtatgaactccgaagccacatgccattgtcaaccgggtcaagtacgcgtattattggctttgggggagtgaacactaggttagtccagtacccgagttcttgttacagtattgatgaggccaacagaaaactcctactcgttgacggtatcgaatgaactaatgcccatccgagggagacgattgccagtgcagtactgatttgtttcggttagctgcaataactcttttcagtgaaagcttgacaagaaactgcataagttctgaatccttatattagattatgacaacaatttgcaagcagggacaagtgacaacagtggcttggttgctgcttcaattcagcacagcaagcaacaggatcaaccttcccaatcttgttctttttccgcgtcagaactcaaaagtctcagaataagcaacgaccagccgaagattttctaaaccacgccattttcagcacagcaagtggtattgggccaattaattaggcattctgaatccatctgcagtccatataagattatgcatgtgaccaaggagttgcgtgtcagcttcagttgaggcctttgtggatcaaaatcatcttgctctatagtctagaccaaacatttttcccttttcttcttggtaatttggaaccatgacattataattttgtaacgtttgagatatgtcatcggtatctcaatgacacgtagaacccacatgagtcaatggcatgtgggtcaggatggtatagctcaaatttttcaaaattataatggcatggttcaaattttcccttttcttttatgcctgtcacacacgtacaacagaggcctggctgagtggtaggtcgaattataccgttgaggtccttaatttctgactatacatttctcagttgaggccattaatttctgaccatacattcctgtcggattactttagttttgttgcatgaatttgacaaaacttcaacttacacgggaaaacttggagcgatcaataattggaaaattcctcgcgaaaaaagagagagaagagaaggtgtagcaatgatacgcttctttgctaggtcaaactgagcaaacaaatacttcatccgtcccgaaatataagaatctaaaaccgatgggacatagtattagaaaatatcctatccgattttaaattattatattttggtttatatcctatnccagtttn

SEQ ID NO: 29859 - DNA, 1247 bp, Oryza sativa
  unsure (1)..(1247): unsure at all n locations
caaaattttgcgttaaaatagccgggttcccaagccggagcccccctggccaagggtgtggggcagtggaaacccaattttcaaattaaaggcaggggtcattttccctttcttttagccgtccaacgtccaaaagggcgggtgaatggaggccaattacccggtggggcctaattttcgactacctttccaggtgggcccttaatttgggacaatcatccgtggggtaaattgagttttgtgactgatatgcccaaatttcacttcccgcggaacatttggaccgttcaaaattggaanatccttcgcaaaaaagaaaaaaaaaagaggtgcaccattgaaacgttcttggttggtccaaattgacaacccaaaccttctcggtcccgaaaataaaaattttaaacccatgggcccatggtttaagaaaattccttatccattttaaaataataaatttgggttaaaacccaacccgttttaggtattaatatttaaggccgagggagtataacgcaaattgccaacggaggtggccatggccgtgcaagttgtttggccttcttgtgacccacccaagatcagccccattcaataattggccgttggtaagcccccaccaacagggccagtaaattgtttggcccctagctgcaccttaccatgggttgaataaaggaaaaagtacaccgaaggtcctcaaccttgccaccggaatcaaaacccgtcctcgacccgcaaaaccagatatataggatcccttacctatataaaactggtcacaataggtcccttggcggtttcgatccgggttttatcctacgtgtctaatgagtcagcgtgggacccacgtgcgccccacatgtcagcttgtccagtcagcctctatttctttcctctcttctctcccttccccttctgtctctcgctcttctctctggtgactctgggtagcccggcgccgccggccgacaggtggggaggagatcgacggtgcgaggtgggagaggaggtccggcggccggcgacgtggcggcggagacgacgcgggagcaggggagcaaggcggcagcggcggcgagatgtccacggtgaggcactggaggcggagctccgtcggggcggggagcgggtccacggcggcggacggcaggcacgggattgcgtcgcggccccacgctggcgnnnnnnnnnnnnnnnnnnnnnnnnnnnnnnnnnnnnnnnnnnnnntgttaatcaagccacgg

SEQ ID NO: 29860 - DNA, 1244 bp, Oryza sativa
  unsure (1)..(1244): unsure at all n locations
atgtggttttgatttgnnnnnnnnnnnnnnnnnnnnnnnnnnnnnnnnnnnnnnnnnnnnnnnntaattttcatttaggcatttattgttctttttcaaacttatattgttttctggtgaactcatcctgatgataaaatttattttatttctgctaaataaaattatatttgcattataaactttcttgtctagattcacagctcatagcaccattgcacttacctccaagcatcttatattgatatttccatcaagtggccagttgtttggggggcggcgataatcaactactagaggagcctcactagggatccttgagtactgcaaaattctttcaactgatatcattttgttctctgtgttgcagatgttccaaataatagatgccaactgtgagttgaggttcaatgcataggtcaccgcaagtccagcaatgcctgcatgtacaatatataagtttgaaaacagccaacatagagtgacttaatgcttccataatcaccaagagcctaagttcttcttagagcttacttggatttataaaaccttcaggaaggctcactagcagggtcaaagagaaagcaaagaccaagttggataacatgtttagccttgaagaaagccattccattgaagaaatgttatggaaccatggcccggagtgattgtcgacaagtcccaagtttgatttcttgaacgaccttttggccatatgctcctatacctgatgcctcctgaaaccaatcttgccaaatggtggaagatgggagccccttggnattgtgattaaacgagcccaattctctgctggtgggatgtaaaatcgctgcacattacaccnaatatattgcttcaagattttgggaatgacgctattatttattgagaaaaagtgtccctatagctcttgggactcatctggggcccanaaggacttttggcatgtggctttggagtcacaaagcttttaataaagtttttttcttgtgtggagttatacccgcacatgaaacaaacaacgtactgtgaacaaaatggaaaattggccggcaaccggggcataacaccatggtccccaaattttgtgaccttaaaccccccacccaactgttgggttttccaaatataaacaccttggctttgggccctgaaaacaaaaccacaccctttttttggggtggaagaaccggtgcctttaaagttcaaactcagacggtttaactcttaaaaattttcaaggg

SEQ ID NO: 29861 - DNA, 1078 bp, Oryza sativa
  unsure (1)..(1078): unsure at all n locations
ggtggtttgaattgtagnnnnnnnnnnnnnnnnnnnnnnnnnnnnnnnnnnnnnnnnnnnncaggtgatgcaaaatggaaggatagcacaagcagggaaatttcaagaactccaacagaacatggcttttggagttatctttggggctcacttttgtgccgtcgaacaagtttgtaacgcaaaaggcacaagcatatatttgtcaaagcatcatgcagaatcagaaaaggtaccaagcatcaatgagtccgatgcagaaaaggaaatcagcagcaaatggcaaaacacaaatatgataaattgcagacaagaagtatttagagataacactgaagaagggaaattgctgcagggtgaagaaagagagaatggatacattagcaagcaagtgtattggtcatacctcacagctgctcgaggtggtcttttcattcctatgataattgcagcacaatgcttctttcagatatttgaagtgggaagcaactattggatggcatcagcttgccatccacgaactggaagcaaatcaaaaatggaatccacccagttcatggtatatgtatttatatcagttggcagcgccttgtgtatcttgattcgagcagttcttgtagctgtaaccggcctcctcacatcagaaaaattgttcaagagcatgatgcattgcatctttcatgctcctatgtctttctttgactcgacacctacagggcgaatcttaaacagggtcagtccattctcctgtctcagaagtgtaaactatgtaaaataaatcctaaagaaattctatgtaaaataagtaaacatatactgcattacacaggaaagtgtaatgtgtatgtcgctttacctgagttgctaatacatgatttttgcattgttcatgtaggcttcgattgatcaaagtgtgctagatttggagacagcgtcaacattaagtgagagcacattttcagtgatgcagtttctaggaacaatactaatcatatcatatgtttcctggccagttnnnnnnnnnnnnnnnnnnnnnnnnnnnnnnnnnnnnnnnnnnnngtatgtcatcaatngggcacac

SEQ ID NO: 29862 - DNA, 606 bp, Oryza sativa
  unsure (1)..(606): unsure at all n locations
tggggggntgnntttgttatcggtattcgttctcggtacccnnnnnnnnnnnnnnnnnnnnnnnnnnnnnnnnnnnnnnnnnnnnnnnnnnnnnnnnnnnnaacttctactcgttgacggtatcgaatgaactgatgcccatccgagggagacgattgccagtgcagtactgatttgtttcggttagctgcaataactcttttcagtgaaagcttgacaagaaactgcataagttctgaatccttatattagattatgacaacaatttgtctttgggttctcgttggttttgcttgtgcgtcttccacaaggttttgttaatccaagtaagttttgacttgttcggacccatgaatttaattgaacgtaaactcatgctgttctaccgtcattcaaacttgaaggataaatatcttttttctggtataagggttgatgttctcttgctgcaaaacaggcattggtgggctggtagtgatgtatgcatggaatttgaatacacaattatcagaagccacccggaatataagtcgtgcagaagcaaacatgatatcagttgaaagaatattacagtacacaaagcttccaagtgaagccccaaccata

SEQ ID NO: 29863 - DNA, 1275 bp, Oryza sativa
  unsure (1)..(1275): unsure at all n locations
ctttgtctttttccttttggggaagaaggaaactctccccctctctctaagaaaaaaaagcggttggttgttatcaccaaaaaaaacctaatttttttccccgcccagttgnggcaaccccaccttaaaacaatttttttggtgtttttccaccaaaaggacgcccccaaattcggccccctcccctccccccnnngtttcttcttctgtgagcaaaatatattttcttcccccagaaccggcgttttttttttggtgcaaccaaaaggaatatttgatcccttcaaaaaagtacccccaataatagtattatgcgggtgatgagcccaaaacttccttggtttcacctacatagaaaaaaatgacaaactttttcttttttgataaacaatggttgccctaatagcccacatcttatatagcacaaaaattgggtaagcgtgaatatacggcaccactatgaagtgaaaatgggccaaattgcggaccctatcccccaggtaaataataaaggcctcaaaagcgggcataccactaaaagtatttttagggtagatcaacagtagttttcattctgaagtaattaactacccatgtcaggtagtagacaagtgtcagcttgcaaatgtggtgcgctcgactgagaaaaacttggatgaaataggtaccgctcagcataaccttttgaggaagacaaaaaaactgccatgagtcctttaggaaaagaacatgttaatatgtagtttttctgaaatacttatgctactatgaatttatatttcattcgcagtaattgaaaatggggacaactggagcatgggacagcgacaactattttgtttaggcagaattctcctgaggaagagcaagatactagtccttgatgaggcaactgcttcagttgactctgctacagaccggattattcaagagataattcgtcaagaattcaaagattgcacagtgcttgcaattgcccataggatgaacactgttattgatagtgaccttattcttgttcttggtgaaggtaggtataccactacaatactaaaacaacctcagaatatcatgttgcacagctacgtcactctttaaatctgatatctctatgcaggtagtattttagaatacgacacccccaccaaactgctccagagagaggactctacattctctaagctaaccaaagagtactcacaacaatcgcannnnnnnnnnnnnnnnnnnnnnnnnnnnnnnnnnnnnnnnngttgtataacaaatcaaacacag

SEQ ID NO: 29864 - DNA, 1506 bp, Oryza sativa
  unsure (1)..(1506): unsure at all n locations
cggggggcgtcattccctataggtgacctgtagaaaggacacggtgggctttttttataccacatggaaagaggaatttccacaccttatatgtgggaccccggttttccactcccggtttaaaaccccggccattattgtataccctccttaagggatatttaggccggaaactccggtggttcgggattccttttaaggtatcgagggggaatgggtatagcctaaaccggccctcagccagttctttaacaagggggcccattgtctcctagggatttagcattttttgttttgcaattaagggccaataatgtgcccaagttaataaactctttttacccgtcaaaaattcttttggataatgccaatcaaataaaagtggccgacagaaggtgtaatctggtttgtaagcttttaaggccccaaaactgtctgggtaacttggaatactggttttaccatatcatttcctggtatgtataggctgtttcatatgggtaatagtaaagcttagctattagactatttcataccataattttataatatttggtgggtaatctttagagttttctattcggatgcctgtcaagtgtgttcattcgtgaaccttttagagtgttaaccactcggattccttttattatggctaaaaagcagtcggctaagaatgcctctttaggcgccgtgtatgcttttgtcatatgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacaagtagaattaaaacaaccatatttaacagttcgatcaatatatatcttttctttnnnnnnnnnnnnnnnnnnnnnnnnnnnnnnnnnnnnnnnnnnnnntattaatcaagccacag

SEQ ID NO: 29865 - DNA, 2458 bp, Oryza sativa
  unsure (1)..(2458): unsure at all n locations
agtggtttggnnntttatatnnnnnnnnnnnnnnnnnnnnnnnnnnnnnnnnnnnnnnnnnnnnttgaactgtatatcatgaagtaattatgatttctctacacagatctgtcggactgtcaaccatacaacactgtctaggtgaagtggatttcctgtggatggtagcgaagtgaaagcccatgggttctcgaaattcaccggttccatggcaacggtggcagtaatctaacccgctaccaccacatatacggcacctggaaaatggaagtcatgccggagaagcatgtttctcagtaccagcagcataagtatggcagacagcttttgagtatgaggctatgagctcctcaccattgtggccattcgcccttcgggagcatgacaagatcggcatgattggttctccctgtaaatcccaggttccatggtcatgagagaactggtttgtaggatcatgatactagcaagagaagagaacatggagtacaagagatacctcgaccaaaacagttgcggcaatctattttgcctgtgcctctgcagatggtgcatggaggatcaggcctttttggtctctccctcctaatatttgactgcatcatacttgcagtgaagatatcaggattggtgtataaacatgtcaaaagttaacaaatgacaattcttaatgtacaatatggtctgagatggtcttgttccatctgtctggcaagttgaaggactcctaactcagtgacaaacagagagggtatcagttggcacagaaaggaaaatagcatgccctttcttaaccccattccccttttcccctgccatgtttccctcgcaatgaatctatgataaatctcatgtactatcacaatttttttcagataatggataacccgaccgctacatcaaaaaacacataaatctgcaaggccaaccttggtatgtttggagttaagaaatcactacaggctagagcaaacacacagtaagcattgctggctgtaaaaacgttggaacaagatctaagtcatgaagtgaatggcaagtaaattttgcttataaagtgttcagtggattgcatatttgcatggtgctaagcttcaggtattcaataaaaaagaagtggaatcaattgctacaaagttctgatacacatgacgaccttaacattctgtaagatggtttgaaatatattcaggtggggaacgcccccctccggcgacttggtcagaaaaaaacaattccgtaaatgtaatgccgaaacaatttctaccaaccatggcctaatttcctcatttttggtactcaattgccgattcctcatgattcttcccatcgcgctagcttctgctgcaggcagcacaatcttacccgctaccctaacccatccccacacctcctctccatgtcccgctgccgaggaaaaacctaccggtcgattcaactacgcttcctgtctacgaagtgttcgacgaatcgcaggcacgagaacaaaaggggagaggtgcagggaaggattgagctcacctcgctgcggacgatccatgaaggtctcgatatgagcacgctaggaggggcctcgtgaaatccggggagcgagctcgaaggagcctgccccgccggcgacgccacgccgttggggccggccgccggcgtcgaagccatcagcggctacaggttgcggtaggggcggtcgggcggatactggaaaggcacggtcgcacagagagaccgacctgttttcatcagttcaggctgcgttatccgcccacgattgggcctctttgggttctccttaactgggctaggctgggctgggctctattctaacgaaacaatgaataagttcactttaggtccctcagtttgctatcgagttcagagtccctagatcacaaaactggataaaacgcatccccaacttacaaaaccgtacaaacgaggtccctcggcagtatagcatctgattttaactgacgtggcatctacgtggcttatttgactaggtcttcgtcccacgtggcatttgatgtgccgtttacgtggcaattcgatccaaaaaaaataaagcctatagggcccacatgtcagttacacaccaattatttaaacatggtgagggccatgtaggccacatgtcagcctcattactccatttatctcactatcctctctctcctctgcatggggtcggagaggagcggccggcgcaaccctagccacagccgccgccgccaccgcgacggaggaagatggggcaaccacggggtcttccatggcgaaactggggaggtcacagcctcacggcatcagatcgaggggagctagggttttgggaggctaagaggaggagaaatgagctagagaggaaagaagccgctctaggttttctagttgggnnnnnnnnnnnnnnnnnnnnnnnnnnnnnnnnnnnnnnnnngttatacaacaattcaaaccacag

SEQ ID NO: 29866 - DNA, 2141 bp, Oryza sativa
  unsure (1)..(2141): unsure at all n locations
agtggctttgaaataacttattctcgtattcctgcaggncgactctagaggtattcccgatgctctaggacagttaggacagcagtttgttgagatgctctaggacagnttgntgggttgctctgctctaagacagtttgttgggatgcgttgctctaagacagtttgttgggatgctctacgacagcaccctcttagacttgcatggctgcatggctgctacaagcagctataaatatgtatccaatcctctttgggaggacatggcttttgtgtttagtaaatgaagaaaaccagaaaattgctccatctcgagtgccatcctcttctcaatgagagtaaccattgaaattctaacagcatcagcgacaggttccacatgagaaaggctctccactctctgttagcccaagctttgctcctcaaacaacggccctctctaatgatcaaacctgtaacatatggtgatcgttaatactgcagaaaagaaaagcaattgtggctacagaatgaatcaactatatgaagagcttctcaccatgtgatgtctggtctgcctttcttcatttctcttccatgttcacagtcacacttggttgagaggtgtaccattatcccatggtcaggtagcgcagtgcctagacgcgccaaaccaattgcggtctgatttgcctcctcttcgacccgccaagctatgtactccctttgagcccatccaggagggatcacaaactcagaagatgaagaacatccgtcctcatcctgaccattttcattgttacagacttcagatagctcagaagacgaagcatcttgtaaagaaccatttccattgttactgacttcagatagctcagcaggcgaagcatcctgtaaagaaccatttccattgtaacagacttcagatagctcagcgggtgaagcatcttgtagagagtcactgttctcatatttaccactctcgcagttactgtcattcggtggttcactaggtgatgcatcctgcaaagaaccgtcatactcatctttatcattctcactgctacagtcattgagtggcttaacaggtgatgcgtcttgtgaagaactatcactctcattgttagtctctttggatgacccagcaagcacaccagccccctcacacggcatcaaatccatgtaccagtagctatgtaagaatgaatcatgagctcttgcaggtgggcaagagattttgttgcaccaacgtatcaccgtgagatcgtccccctcaacgatcagctttttaactggttcatgatgctcaagcatgatttctagcccatgttcaagtgcttgaatactagccacagtctgatccacgttacctaaggaaccgatgaagtaggagagtgcaccttcatcattgtggaatacaccacccatgccagcagaacgatttttggagcagccagtgccatggaagttgagcttgatccaacccttgggtggaggggaccaagtattccgatggattgctgggattcggtgctggaactcctgtccccagaattgaggttcatcatccttgcagtcgccttgatcttgtttaaatggacgcaacattctttctttcaggtgcatatggaaataagacacgactgaaaacacaaacacaagaacattacataattagtcttattgacctaaattttgattcagcatgtacaaacactaatcaaatgaagaatgttaagtagcaagatattgcccttaagtctcaagaggtcttactcaaaagcaaagaaggaattatattccagttccaattcaaagttaaggaaaaacttttccttaagagacaaccctgcaaagttagctccaccatcaaacaagagtaccgaaaaaaaaaatgagttcagaagaaaaacacacatacttggcacatttgagttcatgtccacatcagcggcaacatcaagaaactcaaccctcagttcagagactccccagaattcctcatcaaagttttccaaaacaattacttcatcaatataattaatacttgcccaaagaaacctgtctctttccaaagctaaggaacccttgataccagtaaatccacagctcctgttttcaagtgcagcagaaatacttttcccactattcttgaacccata

SEQ ID NO: 29867 - DNA, 1133 bp, Oryza sativa
  unsure (1)..(1133): unsure at all n locations
atggctttgaattgttgtacaacnnnnnnnnnnnnnnnnnnnnnnnnnnnnnnnnnnnnnnnnnaagtcgaagcatgctttgacatcagcaggagagagtgctggatcatatatttcaatgtcaccaattgggaatatattatctgcctttagaagaagagcgaaggcaagctgatattgagacttcacatcaaattcaaagctcccaaggccataaataaccaattggatgcattcatgagctcccaacatgcttgaaatgtgagaagaaacgctctcatctttcttcacatgatcaataaactttgtgtacagtgcagaactcctaacatcagaaatagtttcatgcatttctttaactatgcttttagcttcctgtaagtgcttgtcctcaatgtatgcatcactaggatttaaatgccacctggtcgattaattcatttagaaaaggaattaatttgtgaagtcaacaatagcgaacgacaaaatacatcccacaaaattattagcgcacgtgaaaaatcataaaacagatggcctagaaacatagtcgatgattgataaaacaacaaacaggtgctgcaggctgcagcaatctgccaatactataatcactgaagtaaaagaagaacatgcattgtagcaatactataattaatgcaaatctcacttaaacggtaaaatagcccattttacataagaaaccctttttttagggtacacgcaagaaagctgcctaaaatggtgtaatcatctttgcttgagttatccttcattaaatatttctttaaaccaaagcatcattttgtttacttaaaattcacagaattcagcaagcaaataatcatgggaaactggtccaaattaattgttttgtcagtatgcagtcttacccttctaactgagcatcacaattcatttggacattgacataactccagacctttgtagcacaattatctgcatcaaacaaagcagcaacaagtcatcagacaacatagtccatgtaggcaccacgttaagcttttacaaaaagggaaatgggctgcaaaagaacctggtatcaagtgttcaatatnnnnnnnnnnnnnnnnnnnnnnnnnnnnnnnnnnnnnnnnnnnnntatcaacttn

SEQ ID NO: 29868 - DNA, 1299 bp, Oryza sativa
  unsure (1)..(1299): unsure at all n locations
aggtgctttgatgattcttaatcttgcatgtcctgcggccgactctagaggtattcactatagttggaggttgtgttgctggaatgctgatggcaacaacgcccgtgcaggctccccattcatctatttgctgctatcactttgatttcagctggtttgtgccctaaactagcattttctttggccttctgttacattctgttttccaggttgtagtggggagtttcattgctgaaggtcaaaaaggcaaggaagaacatctgaaacgtgagccaacatctgccccgactccgaaccacgcatctggctttggcgcagccacagctgccagtcctccgtctgatggatcatcaagcgaccactccgatgacccacggagtcccatgggacctaatggcagcacattcaataattcaggtcatcccatgcattcttcgtatgctcctgatagctggtcgctatctgggaatcaaggccgttacgatcccgacctgaagatgatgaccgactagataatcctgtgtttttaagctctgttagctgttgacccagtagagtgtagggatcagggattcagagtttactgcaccgacaccaccggcagaggtggccaataatcacgcgcgctagtagtaatcagtatcacaatgcctgaacaaaagagatcaggaacaaataagtagccccagcgcatggctttgcctgtcagggagctaatttttatttttcttaatcgggggcttaaattagcatgctttgtcagctggtaacctactggtacggtttttttatgaatgttcggcacctttttcttttatcgctagcattccgcgtgtacccattcttaattaagattgaatgacatgttattggatattgccaggttatttttggtggggttcacccgggaaaaaccacttcacttcctgaagccttttgggggtaaggatcccaaaggacaagaattttgaacgcctttataccagggtcccaccaactgggtagaattaattttttggaaaatggcnnnnnnnnnnnnnnnnnnnnnnnncgtgaattaacctttaggggcaagtcggaaaataaatttttgtgggtttgggacccctttgaataaattgtatttgggttaaaaacaaagggtttggcgttaaaatgggctacagagttacaaaggtggggaaccagggttattttttttttgggcaagagcactataacccctttgttttttgtggagggtcgcncccggaagcctttgaaaaagaacaccgggtgtttgtttttgctccgctgtct

SEQ ID NO: 29869 - DNA, 1775 bp, Oryza sativa
  unsure (1)..(1775): unsure at all n locations
atttttaaaagaatggggggctcctttntttacccaagggaaaagggtattttccaaacatttattgggaacccggtttttcccatcccagtttaaaacgcggcctgtttttttaaccctccattaggggaatttgggcggggcacattttttttttaaaaaaaacaatgtatttttttgggccttttcccaaaatcatacccaaaattttgtgggtgttttttgaaaaaaaaaaggtttttcaattaaaacagtttgtaaaggggggaaaaaccaaccaatttttggtggaataccaaattaaccggtttgttccatggaacccaaaggcccctttgatttaaaaacctactttttgggaaaactaaccagggaagcactttcaggtttaacaaaaggttgaagaaaggactggccctttatgtataacatttttcatatgaaactgacatgcagttactgcagaatattttaggagctttcatgtggaccattacgttgtgttttcaacattactatttttattgctttatattaggagtgttggtagtagtacaattataagctgcctaatttagctcaatgactagcatctacttaattagttattcattccatttatatgccaagccttctaataagctgtatcgtatacttacaccttcctgttatgcttgaattgcagcctttgtttgtttgatggcctcacctgcatcaccgagagagttcactcaggaagctgcccgtcagtctctgattgcgatctcccggtctgttccagcggcaggagaagccgtcaacatcaagtcaccgagcggcgccatggtgaatggccaccaccacgacgatgacggggcagagaagtacagatcaaagctcatctccatctccaacctgtcgcctgatgcccagcctacgccgtgctctcccaaggacaccgctgctgcttaggcttaattaaccgtgtgaccatgttactgcttacacttccaagtgtggatatcgtgtcccagcgtgtgtcgctaaatgctgagactgtgatcaggacccttggccttaataactgccatgactgtatatggtcttgtgatgaactgcccagtgggatactgcccttcttatgtgtgaaagatgcatcatggcttgaaatcttctcgcgtgtaaaatcagtacagcagttacctgaaaactgttttgcaaatgcagtggatcactatcttgttcttcttttgaggccctggtgtagcagtaggacgactgcattatgactctatgagtcgatgagcagtttagatcgaagcagatatgtacagtagctgctgtgaggcaaatttttcatgatatgtgacggttcctcttactttgaagtcttactttgaagtcaagatgaatctgtgaagtgagttgaccgtgaacccacttaaacaaaattacttaaacaaaattagtgtacccacttaaacaaaattagtgggcaacctatgaattaatccacgggttacttactaaccaacttgacgacgggaaccggccgtgggttgcctatttatttaatttaatctataaagcttcgcgggtgatccacttgtatacttacatcttttatcaggatcctggtgcaagaaatcatacggatttgctgttgtgtgcgtacgcgccaacgggtcaactcagcgcgcgtttcggacgttcgcaggctcattagtaaagcacgnnnnnnnnnnnnnnnnnnnnnnnnnnnnnnnnnnnnnnnnnnnnnnnnnnnncaaacccat

SEQ ID NO: 29870 - DNA, 1217 bp, Oryza sativa
  unsure (1)..(1217): unsure at all n locations
ctgtggttttgattgacannnnnnnnnnnnnnnnnnnnnnnnnnnnnnnnnnnnnnnnnnnnnaagaccatttctagaataagtctttttaggggtctatttgcgaaataagttttttaaatggaccaaattatgaaaaatacagggccgtgtgccgttcccctggccaccgcgtgcttggccaccaacgagtgcgcgcagcgctcccctgccgctgacgccgttgaagttgatgcgggcgccgtctttgttgccgcgcccgccgccgcgattagcgacgatagcatgccctccctgaccggtgttgctgtagagatcaaggagagtttcaaagttgaggagttgagactacagctccccaaccgtgatgtgatcggacttggtgcacagagccnagacgatcgggctgaagtcttcatgtaaccctgagatgatgcactgcgccatatcctcttcatcaagaggacgaccggcggcagccatctgatcaccaagagctcgcatcttggcaacgtattcatcgaccttcattggtcccttcttcgtgtctgtgaaggcgagcctggtattcaccgatcttgcacgggtgcggctggagtaaaagacctcgatggctcaccaagcttcagccgccgccttgcacatggcgacttgaatacaacatcccttctaagagatgacaggagatggcccagaacatgtgatcattggctacataacattcaatgcgcggctcgaatttgtacaggctcccatctaccgtgactgtaatttggngttagagctctcacagnaccatgaggtaaccttgatatgggtcaggcactggagggctactttgggttttccaagggaggaaggctttacggttccttgtaacgaatggccttaaccaggttcacattccctccctaggaaacaacaacgttaaaggggaaaaagaatcattttcccgggggaaaggtttttttctctgttaaaaatgggagccttaacctttgtttggccccattttttaaaaaaggggaaaacacctttcccgggtaaattttaatttagagtaagggaaatccaaattggaaaaaaacatttcctaaacctttacacggaactttttatggttaacaatttgcatttaaatttttcccttccttgggaacctcaaaaccagggtcctttttgtgcgttgtgcaacattgttcccaccccaaagggct

SEQ ID NO: 29871 - DNA, 1379 bp, Oryza sativa
  unsure (1)..(1379): unsure at all n locations
tccttactcgtctcataggttttttctatgtggacgagatttatatttaccgctcgtgtcgcgtgttntnttgttgttatttttataattctttnnnantaaccnnnccnnnccnccccaggggttttgattgcagatccnatgctcgccgcctgcaggncgactctagaggatccccgccgtcaagccgaagggtgccgccgcttcttcctcatcgctgtcgccgtccgttgatcttccgccgccgctttggtcaccggtgagtttgccgtgccgtccgctacccgtaggtgctctccgttcgcgctgtcgtgccgtcgttcgccggcgagcatgcacgcccgagccgccgccggtggtgacgtcaccgctgacgtcatcgtcatcgtctcccgtgggccggccgtggaccggtcgatctcggccattcgttttggatggaaagatctcggtcgttcgttttcgtgagccgccgccgtgcacccggttcaccgcgaaccctaaccgctgacgcaataattaccttttccttttcaaaaataattcattattgcgtcataattcaattaaaatctaaataaatgatttaatcccatttaatctttgaaaattcataactaattcatcttagctcggatttagttggttcaagtctctaaatttttctaaaattgagatctacatgttaaaaatatccacatgtactgttcatgcttttttatgtgctgttttggtgattttgcacctttctgtttagattccgacgtttccggagagtccgtttttacaggagaagaatttgaagagttccaaggccagcaaggcaagtcacacagatcccaaacaaccctttgagcatgttgatcctgtttaaagctattgtttctattcaactattgcatttattttcgaatgtcattgggtggaattaacctattgtttgttatagcccttttgttcttgattactttattccttgataccttgggttattataacttgactagttggactatatatattggttcagctagatattagatatgattgcttagccatgcttagaaacattagcacattattgggataacttatgactcactattatttaatgttggcttaatgatagttcacgatggtcaatcgtgattggttaattaattacttgccaactaaaacttgataatggtgggttgtgagcacatggttttgagagtcgtgctcatgaaaattaaggaccggttcacgagtttcggttgtgaaacattaaccgtgccaaccacaatccagcgtgggcaacggctttaccttttgtatagcannnnnnnnnnnnnnnnnnnnnnnnnnnnnnnnnnnnnnnnnnttgtacacaaacacac

SEQ ID NO: 29872 - DNA, 736 bp, Oryza sativa
  unsure (1)..(736): unsure at all n locations
cgcggnctttgaatgcagatcnnnnnnnnnnnnnnnnnnnnnnnnnnnnnnnnnnnnnnnnnnnttatatcacccttagttgtttttatattgtaatcggttgtgttttgccgatatacaatggccgatatggttatatcgcccttagttcaatttataattttattaatgccttcgtcattgtaaaattaggggggcacatatatgtaaaagttgcaaagcaaaagttgcaaatttttttagcaaaaacgagaggttatattaatcggcacatcagttcagcaacaaaagcaacaaatgaagtaccataatttcttagccgaatacaaatttttttctaaatcctattacatagtcactgagataagtatcgctggatagccgatacagcctgttgtctgatttgttctatttcttcaattgcttgggcatcttgtgcatcggttccaggggcgacttttaaggacttagtcatatcggcaacattcctaatggccgatttcagcctagacttttgttcttcaatagcacttggaagatcgggtagcttctgcttttcaagatccaattcggcattgcattctttgagttgagctatgagatcaattttgcgggcttcaagccgatctatgttcgactgaatcggcccaatagagagttgatcgagcttggctttctcttcatgcacgagttgccgattggcttggatggtagctttcatgactttncgntcccg

SEQ ID NO: 29873 - DNA, 8689 bp, Oryza sativa
  unsure (1)..(8689): unsure at all n locations
cgcgcccttttgattgcacatcgnnnnnnnnnnnnnnnnnnnnnnnnnnnnnnnnnnnnnnnnctatttattcatgataaataacctagtatttgaataaattatttcccctatacacttttatgcagtttaatgcacattatggtgagggtatgttttagccgattaaggattataattagtctatcatttaattgatttgactgatttatttgaggtatcatcctaagtgttaaaatttgaataaaattacagtgaattgtatgtgttgagtagagactacatgaattttcccatgattttaccttgcacgaattattttcaataattcgcaagcatttatttatataagtgttctcactatataaatgcatctaaatgtttgtaaaaacttatattaggaattgacttgaactgagttgttattatttgacttcactttcatgtccttgtaattatgtcacaagaatgaccatgggtttgtctagtagtgttgtccttttattcatgttcatgaacccaacatgatatgcaaccaaaatccaaatgcacataaaagacacaaatcaaactaatgctaaatgcatatgcatgtacacatttttgtttgcatttttgtcctatgctgaaaatggaaaggatttaatttgttctcaaatttttacttaagtacaagttaagttgacctcacctaggttaaagtagcaatttttggctcccaaaattggaaatgttagtttctaattattttgataagaaaattttaagacctagaattctggtatgtcacagttggtgtcatcggctcgtcccctaaacacgagagcgcgaaggttgcaggcataatgtttgcaccaacagtaagattataaagatttttcaccatggacctctctcacgagtcaaggaatggttaaggacggggagctaatccgaattgcttcactcatgatggtagtcagatgaggctggatccattggaaagaggactccgagagctttacatcaagtactcacggaccgaaaatggagttcatatgcatatttggctgccgttcgaagtcaacaatgtagtaggaagccgaataagattgcagcatgtcacaccctaaaaatcctaaatatataaattgttgtttaactggaattattaaaatttattttaaaagtctagaaaagaagatctaattttaaataataaattccaatataaaatagggctagataaaatttcattaaatactttacttaattctataattcctagatttttctgggatttatttgagctaaggaagtatttttaataaatagaattgcatttcatgaataatttaaattgaaaaaggtttttaaaatcctcttttggctttgggccgaaagtcggcccaaaaccttctctctctctctccctcggcccagtcggcccagtcagcccacagccgcccgcgcgagcgccctcggccgctgacaggtgggtcccacctatcggactcgtcgtcctcctcgcgccatcgcccggccggaaccctagccgagccacgccgccatctccttccaaattcgctcgcgcctttccttctccggtgaaatcaattgaggggaaatgtttcctgagatctcctctaccttttctctcttggaatcgtcggctaaatcgtttggaaatccgtggattcgagttcgattcggatcgatctctctcctccgaaccctaaaatttccttcgcgtcgccggtcaccgtgggccttcgccgccgcctccttgcccctataaaaggacccccaagcccgccgttacctgccgccaccctcgccttcgcctctcgccacccgtagcgccctagccccgtgtagcctagcgccgccgtcgtcgccgttcgtccagccgtgcgccgccgccgatcccgtcgtcgtcgtcgctcgagaaagtcaccgtcgtggtcgccgtcgcgtcgccgtcctcgtcctcgggaaagctattaatattttgagtgcaaaaaataataagtgtgagaagatctatagaaaacaggagtttatcattgaatctcttaattctgaaattgctagattaaaatctcttattcctaatgatgatgattgctcaaactgtgaggttttaatgaatgagatttcaaaaattagaaatctcattcattaatttttttttcaaaaattagagatgtaaaggcactatgtttagccacgtcatcaaaatagtttgaaccctctagaaagatggcgactctcttctctggcgacatccatggcgactctctctagaagatggtcatgccggcgccgcctacttgatgggatttctccccggaggattccatccgcgatgaagtttggagccgttttggttcaccagtgcacttttcctctcattttagccgttctccgtttcgataagtggttgatgttcctcgttcttcgtttcgattgaccttgtcctcggtggtgaaaaacgtccggttttcatgtttaggggggtaattcatactcacccaatagttcaggggggtaattcgtactttttccttttccccctgaagaagaccttccccctgctggtccaaataatgatgaaaatcctgatggtaatgatgatgatgattgtaagcaagataatatttggcaatttggcccacatcctgtggttcttgcagaagaagaccaggcttggaatcaggctgctgtgggccatcaggccatggaccttgaacaagctgctcctgagaacatgggccagattgataacaaccatggctggaatctggttactaacagaagtttaattttcacccttgctgatgcttacaaagatgccttcaattcctggtctgccaactctctcgcaaattcagcccttaatcctacaaagcttaattttaatttgggaaatgaaattgtgccatatgattctatttcttttgaatcttctgctataatcctgagcccagaacctctagctgtcatccctccgcagtctgtgatgcctgttttgcctgaggatccttttggctcaatggaggaacattcttgtccttctactccaacaggcatggaaatagagattagtcttccaccttcccctaggaaaagagggaagaagagaacaccttttgttgactctcaagttagaaggagtggtagacttctggctcttagggatagtttcaagaatactctgcaagaggatccaaacatgggtgttggaaagccaagagggaaggcagttaaaaagctgaaacagttggctgaggcaagtggaattgttttcccatctgattctttatcttctactgatttaaatcctgatatatcttgtgagtctgaaagtgatcttacatctgttatacctgctgattgtgatatatcttttctccagaagattggatctaagatgtgtgggacttcccttgaggaggtttcaagcttggtggacttgggagaagctcaggtcatcaagccgaaagcaattggaccatccaatgatgaagcctagttctatcagacttttagggctgctagtggcactcttttggggcatgtgtttattcctttatcagcccttttattttgtgtttaagttatgtaaactctatgatggtactatgtgttggtgtgcttgggaactgcatggattattccggcttgttatctttctctctttaagactagttgtcaaatgaattcggctatgagaaattggaatgtcctctgttggaatgttaggggtctgaattctgatgacaaatggttagccattagaaataaaattgaggaaagtggttgtgctgttttttgccttcaggaaacaaaaagatcttcttttgatcattcttacataaagaagtttgctcccaaacgttttgataagtttgctttctttccatctgttggagcttctggtggcattttagttggctagaacagttcagtttttgggggatcagatattataattgaaaggtttgctgttaagattactttcacctcaaatcattctggtttagtttggactttagtttcagtttacggtccctgcactgctcctgaaagagataacttcctgtcctggctccaccagttgaacattcttgatgatgacctctggctcatcttggagactttatcttctatagatcagttacaaatagaaataggccgggtgcagacatgaatgatattttcctgtttaatgcaatgatcagtgatctgggtctagttgagctgcccctcaagggaagggctttcacttggagtaacatgcagcatagtcctctactagagcaattggattggtttttaactctactgtttggaccttaaacttcccccatacctaagtaaagccacttgctcggtctacttcagatcacacaccttgtgttgtgcaaattggaactgacatccccaaggctgacatcttcagatttgaaaatttttgggtagagcataatggtttctttgatttagttcaatccatttggcaaaatcatgggtatgaaggtaatgtagccaagaatatttttgttaaattgaaggctttgaggaaaggtttgaagaagtggagtaaatctctctctaaacttcaattgttgattaaaaattgtaatgctatcatagcttttttggactccattgaaaacttgagagatctcactgttcttgaatggaactttaaaattcttatcagaaacaagctactgttatacctgaagtataaacaaacttattggcaaaagaggtgtactatcagatgggccaagtttgggggtgagaatacaaaatttttccatgctatggctactgagtcttttagaagaaatgcaataccctctttggtagattcttctggtttagtttgtacaagacatgaggaaaaggctcacatagtgtggagtcctttctcttcaagaatgggttgttctcagtttgagttcatgccttttcagctgcaagaacttttccatgcaaatcaatctctagcttctttggatcaaccctttggtatttctgagttagacaaaattatacataatctgcctatagacagagccccttggcctgatgggtttaatgggatgtttgtgaagaaatgttggccaatcatttgtcaggattattatagacttgcagctgagttctactctagtacactggaccttgatcctttaaaccattcttttatcatcttggttccaaagaaatctgtgccagaaggtataaatgactataggccaatatcactcatgggaatctctcttaagattttaacaaaagtcctggttgatagactgcaaaaggtgatattggagataatcagtcagaatcaatatggattcataaaagggagaactatacaagactgtctagcatggaactttgaattccttcatcagtgccatcactccagaagggaaatagtccttctaaaattggactttgagaaggcttttgacactattgaacatgaagctattttgcttataatggaagccatgggttttagtgctacatggcttggatggataaggaagatcttttcttttgcttcttcttcagttctggtcaatgggatacctggaaaaaatttccactgcaagagaggagtaaggcaaggtgatcctttgtcacctttactctttgttttaggagctgaacttctccaggtcattctatcaaagccttttccatcagactttgacccaaattttcctattgtccaatatgctgatgacaccctgttttatttgaaagctagtagtaaagagctctttactctaaaggctttatggcaaaccttccagctgggaactggtttgaaggtaaattttaataaaacttgtctcatcccaataaatgttgatgaagggaaagctcagaatttagctgcagtttttggctgtcaattgggatctttgccatttacatatttgggtttaccacttggtactattaagccaaaggtaatagattttgcacctttagttgacagaatcgaaagaaggcttacaacaaatgcttcattcttgtcttatggagatagacttacactggttaattcagttttctcttcactacctacttattacatgtgtactttaatgttgccaaagacagtgattgataacattgacagagcaagaagacattgtctttggagaggctctgaggtcaattccaataaaagatcttttgcagcctgggataaagtttgtaagcctaagagaaaaggtggtttaggagtgctaaacgttactatccaaaatcatgctctgctcatcaaatttttggacaagttttacaataagaaagatttgccctgggtcaattttgtttagtctgcctattatggttactctgtccctcatctgacaaacttgaaggactcattctggtggaaagatatttgcaaactgatggatgtctttagaggtattgaaaagtgtaatctgaaaagtggaaatacctgctccttttggtatgatgtatgggatgatcaaccccctctttttcacactatgccaaggctttgttctttttctcaaaaccagaatgcatctgtctctgattttctgtccattgaggctgaagaaaattttacactatctttatctgctcaagcttttcaaaagtttcaagagctcacttcttcccttctagatatcgagctaattaatgaaaatgatgtttggtcttacatttggggaaatatgaaatattcttcacagaaattctatgcactgaatttcagagttattaagccaccagttcattttctatggttatggaagtgcaaagcagtttcaaaagtaaaggttttcgggtggctactcatgatgaatagattaaatactaagttcatgctagatcataagaattgtgctcctccggattgtgatctttcttgtgttctttgtcaatcggcagctgttgaagacctcatgcatctgttctttttatgcccatttgcccaaaattgttggagtcttctaggcattacatgggatactaatctatctttggaagcaatgtttataagggccaaattggattatcaggggagctgtttcatggagaaattcctttatgctacttggcatatatggaagcaaagaaatgggttcatttttgagcaaaagatcctctctttcatcacttggaggcaactcttaaagggtgacctctttcttctgttgtttagaatttctgcgagatatcacaatgtaatcataagttagattaatgggttgtaactttgttcttgttttcttaataaagtttttttaacagcgggggcctcccctgctgtgttctcttcaaaaaaaaatcagagatggtaatgctgcccatgatttcaaaaatagatcttctctagctcttaattttgctttgcacccaggcactttggatgagttgtttttaactaaaaagttgttgcaaaaatatcaaattgcttttcatgctagtttgatgtttaacatgatttgtgctaaaaagttaaaacaaccacatgatgttttggattgctcaacatgtactttgagtaagatgaaactaaaagatgctttaggtcgtgttgagtacatggaagatgttgtgaaaaacaatgaagtgctttcttgccccaagtgtcgtaaaagcaaaggtgtcatggtagattgtgaaaattgtgctaatttggaaaaagaggtttcttatttaaaaaattccttgcaaagattttctgatgctaaaaagaacctcaacatgattttggatcaatctaaggttagcacacataaccgtggtttaggttttaatccttatgctcatcatactagacatcctcctgttgtgttaggtgttggtgctagaagtggtgagattttggttaaacctaatactaataaaactgtgtttaaatctgctggtatcatgtctaccttgagtgcaccttctttaaaatccaatgttgtgcatgcaaaacctcctattgttacttgtgttgctaaatcatctgattctactaatgtgtctaaacatcgtgaaaaatatacttgttcttgttgtggcaaagatggacatattgttggtttttgtttcagattagctcataaacaaaaaaggagagagagagattgcttttgcaaaatcaaagtggcaaaaatctggtttttcctcgaggaaactggtcagaccggctactgagcagcggtcagaccgggcaccggtcagaccggcccccggtcagaccgtcagtaccacctcggtcaaatcggcctcggagaaatttttcagaaaattctcaaatcgtttttgcacgtagatatatgcctattggatcttctggtcgtgtgtctcagtactggattcctaaatttttattatcatctaacccccagtactaaggctttggtggcaaggaaggagaacgtgtggatcgtggatcccggttgttcgcggcacatgaccggtgataaaaattggttctcctccctcaaaaagacatccaaaactgaatcgattatctttggtgatgcgtctacaagtgccgttctggctacaggtttggttaaggtaaatgaaaaatttgaattgaagaatgtagctttggttgaggacttaaagtacaannnnnnnnnnnnnnnnnnnnnnnnnnnnnnnnnnnnnnnnnnnnnnnnnnnnnnnnnnn

SEQ ID NO: 29874 - DNA, 732 bp, Oryza sativa
  unsure (1)..(732): unsure at all n locations
gtgggctttgatttgagaatcctgatcctatagggcgaattcgagctcggtacccagacacatataccatcaggtgttgtggcacttaagaagagagagttcagcgcactcaatcagggatcccgttctgtcatagagtacctccatgactttaatcgcctagctcgttatgccccagaggatgttcgcactgatagagaacgtcaggagaagtttttagagggactgaatgatgagttgtcttatgcattactggctatggaataacgggatttccagcagttggtggacaaggcgattcgccaagaaaacatgtacgataggatggaacagaagaagcgtagggctgctcatttcaaggctcaacagggtagtagccagaggccgcgcattctatgggacctcaagctgcaccatacccacagggaagatcctcttcagttgctcgccctcaatgccagttctacaacaacaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttgataatga

SEQ ID NO: 29875 - DNA, 1369 bp, Oryza sativa
acgggtacgtccctgtcgtcaagactgtttctatgaattcggcacccattattttgctcacatcgaatacgtccttgtcgtcaagactgtttccaagcattcggtattcatttttttcatatttttattctcttttcacaatgagcaattaaagtgatttcaggaataacaattcaataaagcatatatatagagcatttagaaatcaaaccacatgctagcatcaacattgcatatttacttaattcaagtatggaatttaagtgtcatgcatcatctcccttaaaagcaaaatctaaatctcatgcaaagactagaatacatacaagctatgctagagacaaataaaccttcaaagtattgctagtatgcacaagaaaataccacatgtataaacaaagctctcttttctcaatttttctcattgacatatttttgctagataaaaccatgaggtacaaactccccctcaaaacatgccaaaaggatgaattattcccaatccaccacgaagaaaagcaaaacgattagaatccaaaggtttagtgaaaatatcagtaagttgcaactttgtgtccaaaaactgcaattcaacatctcccttctcaacatgatccctcaaaaagtgaaagcgaatatcaatatgctttgtgcgtgagtgttgaacaggattcttagcaatgttaatagcactagtattatcacaaaagagaggtactttcttaaaattaagaccataatctttcaaagtagataaaagccatagaatatgtgaacaacaactagcaacagcaacatattcagattcagcagttgattgaggaacactagattgtttcctagaagaccatgcaatcaataatataccaagaaaatgacatgttccactagtacttttcctatcaattctacaaccaccaaaatcagcatcggaatatccacttaagcatatagaagatgaagtagaataacaaattccaaactcaagtatatgattcaaatacctcattattcgcttgacggcttgacgatgtgaagcacgaggagaagcttgaaagcgtgcacacaaacacacagcaaattgtatgtctggcctagaagcagttagatacaacaaagatccaatcatacttctatactccttttgatcaacagcttcaccatcttcatcaggatccaacatagctgtagaaccaattggtgttgaaattggcttacaattctccatcttgaaccgtctcaaaagatcctttgtgtacttcgtttgatgcacaaatataacttgaggtgtttcttaatttgcaatcccaaaaagtacggggtaccgagctcgaattcgccgtatagtaagtcgagatcatcaacgcgt

SEQ ID NO: 29876 - DNA, 3913 bp, Oryza sativa
  unsure (1)..(3913): unsure at all n locations
gagganaantttgattgatanttcnnnnnnnnnnnnnnnnnnnnnnnnnnnnnnnnnnnnnnnnntaggtcatagctaccataaccaagtttcaaataccgttatagtctaaattcacatgcaactttgcaaacaaatattttcaatcctcaaaacatgggattcaatgtgatcaaatattgggaggataaaacttgccttgttcctgggaaatgttagcacctaattcacttcttcaccatttacgcaattatctatataaagtacacgttatgcaattaaacaccaaaataggtaaaaacccaaaaggctctaaaatgcatgatttgtgcaccgtgggtaggtactggtctaagatgaatttaggtgaaagaatttctattttatctctttttatttgtcagttatgagttttagaagtttgctcggtatagggtggtatttacttaggtagtgttatgaaatatttttgcaaagtgatttttattaggtttgatttctcaggggtgtagagatgtgttttcaaagataatacatttggtttcataacttttagagttattatgaatttcttatgtattttacaagttttaacgtgttgtaggtaggtagcttctatgtgtacatggttttggagttttatgtccagtacatgtttcatattgtttgtgatgtataaaatgactaattttatcaaccaatataatcttagttcacaattttagagattatattactctactacacattttataagctaggggagtgttctatgttagttactgaacataccaacctagaaattgatatatgagctaagtgtgctaagtttttggtggttagggatggaactatgacctctctggtccatcaagttttattttggttacttagagctagagtacatttatatatacatttatacatatgtattggctaaccaataccatgtgattagcacttatgttatctatttaaagtttagtgacatatttagtatagaaggtgccacattttaatttaactaattaaagttcattacttgctggttctgaagaaacttggttcattccatttggactaaagatgaattctctacaaattttagaagttgaagggtgctctaagttgtttattccttatataaatatttaggggcttttattgcactgtaagtatatatttttattatatatctttgaagtgctaaacttggttattctgcggaacttgagtttactcaaaaaggaagtaagatgaattttatataaatttttaaagttcagcttatctaaaactagttattttgtagaatatacatttagaggtatttggtgtaaagcaagtgcatctttttattttattttaccttagagagtaagttggtgaatctgtggaagttgagtttgcttcaatttaagttgaaatgaattctctatgcattttgtaaatttgtgcatgctttatgtgtagtttttcttagataaattttagaggtgaaatttatactgcaagtgccaagttttatgtttccatattaaagctcatccttctatgagttcacagaaacttgaatcatctcaaaatgagctatatttcactttgtatgaattttacaagtttgcatgtttttctgttgaaaatataaagctctagaggattttctttagattttcagatttttaagctcatggggtccacctgtcagtgagataccaatatgcaaaaagatctctgggttttcaggcaatcaatccgcagtcctatgactgttgcattgtgtggcagtttttacaaagtagtacctacagttttgtttcttctccacagaggtccctggttcgagctgaaacagagctagccatggctgagctcgttctcgagctttctggcggtgaacggtggcagatctcggcatgaaaccaaaagagaaaaggaagaggggttctttgcgaagctaatggtagtcttatcgtgatctgtggttaccggaatcaatggcgacggcggcacgagtggcggtgggtctcggggtagtgatgcatgtcacgttagaggccggatctaggtggataaaatgcatgcatgcaactctagaagctccagggtgctcacagtagtattggacgaggttggccaagcttggtcgtcgacgacggcgttcggaacggctcggcgacggcgctccttctccatgaacggcgtcggcttgactcactacaagaactgccatgcatgcgtgtctctcatgttatagtggtcgtaggaaatctatgtgtgcatggaatcgacttggagctcaccggagaaggaggaatcaaagatggagctcggcggccggagttggagaagaatagctcgatatctctcctcggtgctcggatcttggggattcttgagggcatttggagaggacctcgaggggaagattttggcgcgacggctcggccggattcgctccacagcagccgggacagcgacgaggtcgtggcggcggcgctccgggcgcgctctgaagctcccgtgggcacgatggcgttcccgtcgctgcagtggatgaaatgagatggtgtcaaaaggaaacttgttcggcatgaagattagaatacggaacgggaaagagttagagttggcaaagtcttgacgatgtgttgcggcgtccttcttcctggcggccggcaacgaagaggagagggaagacgatagctggagctctccctctcggtttctttggctcacgggtggtgagtgatgtgtggagatgcaactgggaggaggagaaagctagagatgcagaactgggcgtcctcacgtctcggccacgcgtcgaccggcgcccagagcgtgtcccctcttctctctcgtgttcttggtcggttggagaggagagacagaggaagggagcctgccaagtgggtccagggcgaagggaacaagtctggagtgagagaggtgggtaggagattgggtgttaatcgattttggacgattttcaggatttgaatctctctcctctctttgttaatctatagtttaatttttgggcatgataaattcatgtggatttttctagaggtagatgaggatacctagtttccattttcttttgtttctcttaaaaagtttatgtggtttgctctcagaaaattcgagaagatgggctcggtagatcattgtttgaatttttaggagatttaaacagagtagataaattctggaaaaattctatttattcatgataaataacctagtatttgaataaattatttcccctatacacttttatgcagtttaatgcacattatggtgagggtatgttttagccgattaaggattataattagtctatcatttaattgatttgactgatttatttgaggtatcatcctaagtgttaaaatttgaataaaattacagtgaattgtatgtgttgagtagagactacatgaattttcccatgattttaccttgcacgaattattttcaataattcgcaagcatttatttatataagtgttctcactatataaatgcatctaaatgtttgtaaaaacttatattaggaattgacttgaactgagttgttattatttgacttcactttcatgtccttgtaattatgtcacaagaatgaccatgggtttgtctagtagtgttgtccttttattcatgttcatgaacccaacatgatatgcaaccaaaatccaaatgcacataaaagacacaaatcaaactaatgctaaatgcatatgcatgtacacatttttgtttgcatttttgtcctttgttgacgatttttctcgatattcttgggtttttttcattgcaactaaggacgaagcttttcaacactttnnnnnnnnnnnnnnnnnnnnnnnnnnnnnnnnnnnnnnnncgcaaacaaacatactcc

SEQ ID NO: 29877 - DNA, 1797 bp, Oryza sativa
  unsure (1)..(1797): unsure at all n locations
tgtgggaanatttgaatttgacatttcctcatacccgcatgcctgcaggtcgactgtagaggatccccttcccttttcccgattataaaaataatatcctttcgcttccttaggataccccacaaagaagcatttatctgatttaggtgtgaggttgtccgattgcaaacgttttacatagacctcgcagctccaaatctttagaaaagacaaactgggatgcttcccaggccatatcttatatggtgtcttctccactgattttgatggaaccctgtttagtgtcaacgcagctgtctctagagcgtaaccccaaaagcttagcggcagatcagtttggctcatcattgatcacaccatgtccaacaatgtacgattcctccgttcagacaccccattccactgaggcgtttttgaaggagtgagttgtggaacaattcaacattcctttagatgattgccaaattctaggctcaagtactctccaccacgatcagatcgtagatacttgattgtcttgcccaaataattttgtacctcattctaaaattccttgagcttttcaaaggactcagacttatgcctcattaagtagacataccatatctacttaagtcatcggtaaaggtaataaagtacccaaaaccacctttggcagttgagctcattgatccacatacatgagtatgtactagtcccaatagttcacttgccctttcattttgacccgtgaaaggtgcctttgtcattttgccaagtaaacaagattcacatgtctcaaatgattcaaaatcaaaagagtgtagaagtccatctctatgaagcttctccatgcgtttctcatttatatgacccaagcgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaaccattgtccacagatctaaaaccataaccctctacttgcaaacaagaagtagagataacgttcttacacaaagctggaatgcaataacaattatttaactccaaaactaatcctgacggtaaagataatggcatagtgccgaccgcaacagcagcaactcttgctccattgcccacgtgaatgtccacttcgcctcttgctaagctcctacttcttttcagcccctgcaacgatttgcatgtgtgagcaagtgacccggtatcaaatacccaagaatcagtataggaagtagcaagattaatttctataacattaatacctgaggtggaactctttccatcctgctgcttctgcttgagctgctctaggtatttcttacagtttctcttccaatgacctatctccttgcaaatgaagcactctgcatccttagctggccctgtcttttgaaccttggtcttagagttgctagtagtcgtgatctcatcagagtttagctttctcttttgaccactcttcttattgtttggcttgcgcttatgcatacccatcacatggttggagtttttcttaatgctttcctcggcagtctttagcgtcacatgcaattctgccaaggtcctgttcaggttgttcatgttgaaattcattatgaatggctcaaagctgggagggagcgactggagaatcaaatcagtagccaactctcggctaaggggaaagccaagcttatccagactctcggtgtaaccaatcattttgatcacatgtgggctcactggatta

SEQ ID NO: 29878 - DNA, 27947 bp, Oryza sativa
  unsure (1)..(27947): unsure at all n locations
gtgttctagatctcatctannnnnnnnnnnnnnnnnnnnnnnnnnnnnnnnaccattttacatttaacctttcattaaacaatttaacaaaagatactcccaccatgtattgtgaaacaaaattccctcattttattagtgtctagttagctttggcatcacagctacacaactatcaaaataggtaagcaacaccttgctaatcacatcatatgtgactcttgtgctgttggggtgacatctccatgtccagcccaacctatgccccaaggtccaaaactgttttgataaccttgtcaagtaaaccaataatctccgcatatagatgtccgacatctatcctattttatcatgataaaaagtgacactttgctatggcaaacccatcacttatgatcacaaccataataggtgcaattattggaagagcataaatacagttaatttttctgagggaatctatcctaccatgttatatcaaatatacaccaccaataaagtaagatagatataaaaaccccaagcgaaatctaaggggcaacgcacacggcggtcacgggatacatagatcacatctacgattcgccatgtaaaaaccttaacggcataaacaaattatgccgaaaccgagtcaatctcattggctcatttttctcattggcgtgcggttccagtggacatcggactatctgatgaacacaatcgcgctcggccttgttgagtactagacattccagtgaagtcaccaacacatataccgattgatctcatcaacccatgcgtctgtcggttcatctcatgttccgatcacctaagaactcatatacaacataatagatctcatccactacatccgcatatcaattatatgcaatgatctagatcataagctatacaaggcggctctgataccactgttgggatacgcgtaggctacgatagcataaatcaaaattttctatcgcgtaaaccaggaaccatgcaagtattagatcatagatcgttaccactcgatgcgttgtgcaacggaagaagacgctgagaagtcgaaggaactctcgcgaagtaacgcgcgtcgatgtagaggaagtaatcgatcgcacctactcgaccttctcctcctcgtgcattctcctcgctgtactcccacgctgattagcaccgcaaaccagcggcgcctttaccggtatccacacgtacagagacagaacgccacaacagatattctagcacccgcgcgcggctagggttttgctcgggagggaagtgacggctagggtttctcacgtgatgcaatgcctccgccggtcacacccctcacgaatatataggatccatcactcgggcctccaaggcccgtaggactcctattcggatccctatccgaattaagctcatattggatctctatcaaatccccttattctggcccattaagcgtgtgaccctgtagattcatatatactcgaccgtaacccgaaaactccttttcggtccacgcgtaaacagcggcccctagcagaacgtattgacccaccgggcatacataaagatcatatcggctgaacctctagtgtatacttgtatgaacccttttgcctcacgatatcgattaagctcaatgctagatatatgccatcctctaatagctcaatcattcactcgaacctgttgatagattatataacttgtgattgactcctcaatcacctttggcatggtcatgcccttccataatctacaacatcgaggggcccaaagatatctctccatcttgattattcatatcccactacatgtttcataacatacccgaaaactacttttatagctacccatttacggagtagcgtttagcggtccctaagtaagctactacatatgttgagaaccatgataatctcaagtctaaggattcaacaccaacactaaatgagattactgatgacacaacacatatagctcttgcagtgtctcgtgttgcgtctatccaacaacatgtgcaccaacatgtgtccacattattaatttgatatctctataccatgatccatgagacatgatcatcaattaatacatatgctgatcagataaacatatttgttccacatatgatatttgatcagggatcctttagaaatagtaacaaacaacataaagagtctcatgaaaggatcacatattcattaaccaataaggagttatctatttcaaggaacaatgtcggataaatatgtaaaaatagtatgtgatacaatcatctctatgattgcctctagggcatatcactaacatatattgtgattagaaacaatggaggggacatggagacacttggagaaggacgtagagccatggaggatcatcgaggacgtccaactcaaggtggaggctcaaactaattcgacctcgggttcaattcggagtccaggaccagtctgcacgaaaacgggcgcccaggtcgcatacgtgctcggattggggtgttctttatatggatggaaagctaagaagataacctttccaatggttctagtcccacatccaaattctttccgagtcaatgggaatcgatcgaacaaattgacatccagaatctgtcctggtgctgcatcaccgtatttgggcttttgggccatgtatcgtgttggaacccattagggttgcgtcgagagggggttgcacgaccctaaactctatatataagtaccaccgccatctttaggtctttgggttttgcttagattaatctgtcaagaacagtttcgccgctagatcggtttgtaagaccacaactcgtgagcttaattattcatctgcaattttgggtggtttctatctcgttcttgtttgtcttcttcgattggcaaacagggattagccttctcagcgagatcatccctgtttcgacacgggtgataactagaggagacgtggtgttgcgattgcggggctcaagagcgtgcgcgttcaagaaaccggatcgatttgtgtcgcgactccgcccaaatcgttgtttatcagaacctttcagaagatcgggaaccctagtgcacaacccaatcagactcgcgagcatctgatgcaggcgggttcaaaggggaggcggcagcatcccgggctcagtcgactgtcctgaggttgaagaagaacagtgccgagggaagcattgtagacttttagagaaaaggaaaaagaaaagaaaagaaaagaaaggaatggagtagcaggctggcatggctagcagcccgagagaggctttatgggccaaaaatgaccaacggcctagagaaaggttttaaaacttttccttctttgaataatccgtgaaatgctatttcattgattaaaaatacttcccttgctcaaataattcctagaaaaatctagaaaatagataatcaaacaaagtatttaatgaaattttatctaactcagttttatgttgcgatttttcctagattattagagtttaacttgtaagcttttaaaataatttctaaaaatgcattaaagaatgaattattaaattaggtgatttttcgggcgtgacaatcaccatctccgatactcagattaccaaatttggttgttaacagtggttttactagcgtcttccaataacgattcctaggcattgttgttttcttctctaggaaattctgcatgaatttcaccaggctgtccgtcttgggtggctccacttcgacctcttgaatattctgtgggttcggcccgtactttattctgaccatggagcattgttccgtcctcggttgaaactcaaacttctcttccttgccgatgatgtggaaacggatacttcctgttcccacgttaatgttggctcccgcggtgctaaggaacgggcatcccaggatgagcggtgtcttttttcccgtgtccatatccagcaccacgaagtcatccgggatgaaaaaatcccgtatcttgactggcacatcttccgctatccctgccgggtaacggactgacgaatgagccagttgaaggtgcattggtgttggtgccaacactgttaagttgagcttgtcgaagatgtcttttggcatgaccctgacactaactccaaggttgcacaatgcctggtcgaactattgtgccccgatcaagcaggtgatcataggacaccccggatctttcttcttgtctgggagcttgtggagtatcaggttgctgcattgttccgtcagcttgaccacctccgttgttgggagcggtctcttgttgttgaatacgtccttgagataactggcgtatgttggcacttgcatggcgtccaacaacggcacgttgatgtggatcttctggattacttcaacaaaacgagtgaattgctcgtccactgacggtttcctactccgttgagggaacagcagcaatcatgtgtcgcagtactcttgcggcactgtcttttttggctgaacttccttgtcagtcgagccattagatggcgcttcttttgatatcccattagttcctacagggttaggatacggcgaatcacgagtggacttacctcccctcgtcatgatcgccttgacattctcaatggaggagtcgggttgccccgaaatcctcccagtttcatttgcagggactaaggatgccaactgagctagctgggtttctatcattttgttaaagctcagctgattttgaaaagcggaagcaaagccatctaacttgacatttatgttttctaggaccttgtcattggctgcaagctttttgcttaacgcatcagtggttttagcttgcgcaaaaacaagatccttcaaggagagctggttagaaaagttaccgttgttgttacctccttgataatatgggcatggttggttccacccctcacctccttgtggacgatacctgttgttgttgttgccaatgtacatcgcctcctcacgggtttccgggcagtcattcccagaatgacccgtgttgccgtagacctcacatgtgatgtgagagtccaaggccttgacggtgccttgtggtcgtttcttgtggtcgtccaatcgcttcatgagaaggtccagcttggcagcaagtaactccgtctccttattggtgtgcatgcctcgctgacgggtctggagtcgttcctcactccaacccatattggagaccatcttctctattaaatcagcggctccttgaaccgttttagagaagaaagcccctccagctgccgcgtccaggtgatcgtgggacatcgagtgagtccattataaaagttctgcaggatcagccagttgtccatcccatgatgaggacaggcgggcacgtactcctgcagacgctcccatgcttctagaatagactcatctcttgtctgttggaaactagaaatccttcgactaagggcattggttttgcctatcgggaagaatttcgagaggaatgccgtagagcatttatcctaggtgttgacagcagcacgattggcatagaaccactgcttcgctctcccaagaagggagaacggaaacaatcgcagcctaacggctttgggactgacgcccttgatggtgtacgtgctacatatctccaggaactgtttttttttactgaaagtactgccagggctttgcccagcagtttaaattttataaaatataaatatgtacaaagttacaaagggaaggcaaaacaaatatgctacaaagtttgtatccaatcagaaagagattgcttgagtggatctttcattctacacatatgtagaagaacttctttaacaaacatagatttccatgattgaagtgatggctgaacagtttgaaagattaatccattcctttgcttccaaatatgtcatgctgccatgaaaaaaacatcaaggaaaccctttcgagcaaatctgattctcgccaagacaagcatttggaaaaactccaagttataattctaggaaatgcccatctgctgctaacaagccacactgaagggacatgtaaaaaacagatggagcctagtctctctttgatgtgtgttgcataaggcacatgtgaggtcatcgtcctcttttgcacaatgtcttctgtcaaagcatgtcccttgtgttgagtctatcacaaaacaagagccatgcaaagacctttatcttcatgacacatttggtcttccacagccaaatcatgggcctgggaggatgtagtgtggagaaattgagcttataaaatcttttcgctgtgtacacatctgaaccccaaatgaaactccaaacatcacctctttctggctgaagctgcagatgatttaactcctctcgtaactgcaagaactctccataagcaacatctgagaggggcaagataaaagaatcttccagtggccgtgagcacatgtcctaaactgaatcatttctgaataaagtcatgttgaagagattagggtagcttgtgcacctaaaatcatcattccataagtcattccaaaatagaacagatttccctgactgaactgtgcacttagctacacctctgaagatatcagatagggaaacattgtctctccaccagaaagaacctttgttcaggaccagatgtggcactctggattcataataggtttgagagatgagcctgaccgatggcaggtcagctccattataaaacttgaccaaatgctttaaaagcaaagcagtgttctgaactctcaagctgatcacacccattcctcccttgtctttgggcatacatactctatcccatgaagctagagattttctagttgaggatggattgttacctctccagagtcaattctttcttgctgtatcaattgccttgatgacagtgactggaagttgcagacagcgcatataatatgttgggatggaggaaagaactgagttgatcaaagttaatcttcccccttgaggcaaaaacatagaacttgctgtcagcctcctttccactctatccaccaatggagcaaaatcaaccactctgggtctagtagtaccaaggggcaatcccaaataagtaaaaggcagggaaccaatggggcatcccaaaataccagccaataatgatgctttgtcctgagatagattcaaaggatataaacttgacttgctaaaatttacctttaggcatgtggactgagcaaacatatttatgatggctttcaaacataagacttccttttgagaggctttaagcagaatgagtgtgtcatcagcatattgaattattgggaacccactaccatcattctcatttattggcttagagatcaaacccaactaaaaagctttattcacaactctttgtaacagctcagctccaagaacaaaaagaagtggtgagagaggatctccttgtcttaccccccctcttgcatttaaaagattttcctggaacactatttagcaagacagcagaagaagcagaagagaacaccattttcacccattctatccatttttcaggaaagcccatgtgttgaagaactgcaagaatagctgagtgctcaatagtatcaaaagctttctgaaaatccagtttcaaaaagaacaatttccctcttagattgctgacattgatggatgtactcaaaagaccaagcaaggcaatctagtattgtctttcctttgataaaaccatactgattctcacttactagcttaaggattatgccttgaagtctgtctgccaatagcttagttaagaacttcagagaaagccccattagagatataggtctataatcattgacagtctctggtgaattcttctttggaaccaaggttatataagagctattcaagattttcaagttagtgcactctgcatgaaaatatgctgctagtctgtaatagtcctgagctattatatgccaacattttttcataaaaaaaccattaaaaccatctgtaccaggggctttatctgtcgggataacagaaacaagactgtcaatttcctgtgtggaaaatatgtccaccaaacattctaggtctgtatgtcttgggaagagtgtactcaagtcaaaaaccattttagggtcccttgcaactcccattctattcttaaaacactgaagaaaaagagaggccttttgctcatgtaaatgcacaaactgcccattttgatcaagaacctgagacgttgtgttgattctatatctctctgttgcaatagactagaaaaatttgtattttcctcaccaagtaacatccatctattagtacacccctttttccaatatatctttctgaattccaataacttgaggatttgcattttcacaatttccctgaaattccattcaaagattgaaagacatcttgtttcttctaccagatccaaaaaatctatcactttgttatagttagtcaaaagtaacaacagctttgacagatttttcctccatgcaagaagccttttccttaacactttcagcttaaaacaaatgcatttagcagggtcttcaaaacctggatctgtgtgcgaaacctgctgaacaatgtcaaaaaatccctccatctccacccaatagttttcaaatctaaaaataggggactttggaatttttgtgtcaatcttcactacacagggcacttgatcagaaatatttctagtaagggggacaactgttgtgtttggaaaatccaaagtccaaggagctgatgtaaagacccaatccaaccttccaaggaggggattatgctgcatgttgctccatgtgaactttctacctttaagtgggatatcaagcaagccaagagagctaataatgtcattaaaaatgaagatatcattcatgtcagcaccagctttgtttctatcatgcacatacctataaaaattgaaatcacccaggaaaagccaattttgttgatcaccaatcactaaattctgaaccaattgacaaaatcagatcgctctgggccacttgagggccataaacacaagtaagggaccaagtttgagcagtatgtctggaagtgaaatcaacagtcacagagagcaaatttacttgaaccacagttccaacaaacattcttaaggaccagaccaccagaattcctcctgatgcaccactagagggtgcaaaagcaaacgaatcaaaccgttttgggacaaacttcttgatatcagagatatcaaaatgttccttttttgtctcctgaatacagaaaacctaacatgcacagttatcaattttttgtcttaaggagagcaatttttgctctgcattcattcccctaatattccagtgcacattccaagacttgtaattactcatgaataaaataggattgaaacaacaaccaaacagagctagtataactagcctataatgtcatagccaacatagtgctaacaactgaatcaatatatgacaaagtctcaaaaccacttgaccaaacacagacccttatagaattaactaaaaagaaacacaggtctgacaaaaactgtcagaacattaaaatcattttccctccatgtcaggcctgggcaccttctttcttcttgcaccccccaggctggattcagctacctcctcaggagctaggctgcacatatccactcccatcttttgcaacaaagagatagaacagtcagatggtgaggaatcagagtgattatcatcaggggcatattcagcaaaatcagactctttaatgttaccatcatcaaggatttttgctatacctgcaagctctttcaatttatttgcaaattttccccttggcttaccaatgcccattataggattcacttgtagttgtacttcctccttgctctgctgcaaccttgcactctgcctcctgtaaggattatagagtaaggtcttgccatctctttttttcactggagccttaggtagcacaggaagagctagtgcttgaccaacaaggctagaggaaggctgaacagacaaaggcatgacttccagcacttccatagcatcttgggcctgggaattcatggtatcatcatcagtcttagtgggaaccagggcccaatcctttatctcttgtcacgtccagaaattcactaataatttccgaacttatttgtgcataaaatcttcgtccaggaaacagccgaggtacacaaactgacaatttaaaatacaaatccatcctaataatagcgttacatacttacaaaagaaaagaaaaaacaacagaggaattaacggcctagcgatggcttcagctccactcccacaggcagctcaactggggtataagctaaacgtcttctccttctggatcctttttcttcaactgaggttgattgattattgcaaggtgagtacatggaatactctgcaagccacacaacaaatatgcaagtgcataaggataccaaaggatggcataatataggttcatttgcaaaaacatcatttagcaagcatttaagagtagtaaaacagtagagtaaataatcatcaattttaatcaacactgcacaacacacccatcctgcacaggcccaaccatcctgaacaaccatacccggctgtacagatctaactccaaaccaggagctaaacaaattattaccagttatagcatcaataattactgtgagaggtgtgagactaatcacgaaaaacattgctcaacccgcccatgaccgcgggcacggctattcgaatagttttactctggccagaggtgtaccactgtacccacaagacacaacctcaacatcatgtctaccatgcatcgcgatactggaaagtacccgaatagaggctgtgacaataccctctacacaacacaactcaccacagtgcaccgttcctggatcataatcaccccctctacaaccagaggcatggactccccagcgacacccatggacttctcgccgcttctcagtctgggaccccataatgaaccgtgctatacaaaaggtaaagccgttgcccacgctggcttgtggttggtacggttaatgtctgacaacagtagctcgcgaaccggtccttaattgtcatgagcacgaccttcaaaaccatgtgctcacaacccaccattgacaagttttaattatcaattaattatcataacatgattaaccatcgtgagctaccattaaatataatcataaataataatgtagtaagattcatcccattaatgagctaatgtttctaagcatggctaagcaattatatatatagcatttaactgaaccaaaccaatatataaggttcaagctaatcaatttattacccaaggtatcaaggaatagggtattcaatgcaaattggccataacaaaggaataggttcacaccacccggtgacattcgaaaataaatgcacagttgaaataaatagagaatttaaatatatgatcaatatgcacaaaggattgtgtttaggatctgtgtgacttgccttgcaagaatcggacttcaattagtcttcttgaacacttccgatgcactcatgaaccttcgcaacgacggaaatgacaagctaacacgcaaaacaaaaaaaaagactaataaaaaccaaataaacagtacataaaagtaaacaaacatgtagatcatgattttagatgaatttagagacttgaaccacttaattccgacttcatatgaattagttatgtactttacaagataaatctgattttagacttatacagaaagggattaacgatgtcatgacgacatcactgccggcgttggagggtttgggcggccaaaccgagggcaccagaagaaagaacatgacgaggggaactcactgaggggcggcacgacgaagaacgacgacgggagacggccagcgacgagctccgaagggcggcgaggtactggtcgacggcgacagcggctttctggcgatctttagcggaggaaaattagcggacgggcttcaccttggcgctgcgatgccgaagaaggcgacgacgacgtccagcaaccactgagtcgacggcgaggctcggccggaggtgaagtagatcggattcacgccgacgaggagcttccagcgggttacggcaaaaaggaaccggtggccgggcttcttctcctccttgcgaacccggtggtgacggcggcgtccagaggcgacgatggacggtgacgagcggcacggctggagcggctgccggcgacggagagagaagatggctagggcacgggagctcgagcaaggggtttaaaacgaaagaggagagcctggggtttctatttataggcaaaggtggaggagattagctcggacccgagaggagagaatggcgccggatcgggaagaacagtggctctggtggtagaagatgacactgttgtgacagggaggaagtagagtttttgcttggcggaaaagaaaagaagagagggactagaattagacttttctgggaaagaaggagacaggaaacagagacaggcaaagaggaaggatgggctgaggatgagtagacttttccagtttcagcccgaaaaggaaaaggggaatttcaattacttttccaattaaattaatcactgaaatgatctttgaattgttaaaaatatttccaatgctcaaataatttcaagaaaaatcctgaaagtacttgaacactataagtatttaacaaaattataatcagaccatttaatgattaatttaatatgtggataattactgaaatgttgtttgtattattaaaattaggagttgagcttcgaaaaatccaagaaaatttcagagagtatgattaaccatggagaatttaataaaaattaaatccagccatgctttatatttaggaaattttatttcccacatttaacttcacttgtaaattaatgaacatttaatataaattctaataataatttattaaataatttataaatcctgaaacgaaaatcaggttgtgacatctcttgacccaccaaaggagcaaaatcaaacattgtcgttttgggaaggacaagtgtggtaaaaggattggttgcatgtatggcagcaggaacagaactggaggctaaaaactgatgcatagttcccttttctttgcgcagaagatcaatcttatcattcaggccagacattggataaaaaaatggatgcgcaggattttcacttctagcaattttgcccaacttagctaggaattcctgaacctttgggtcctggactgaaacttggaccttgtccttcctaacaagagaaacagctgtaggaacaggagcactgacatcaggaatagcaggtaccaaagctagcataccatcaggattaacctccattacttggcccattggatggtcttggctccatgcattgtccagctcagcatctgcagcttgttgacccgcaggaggctgacccatctgccaaatgttacctgcatcaagatcatcatcatcattatatgggtcatttggatcatgttgagggcccgcagggggcagatcttcattagggggcaagttgagaaaatccccttctaacaagaaaactgaaactgtccaagactctcctcccccacccatacctactgggtcgtgcagaacaattttgcgcggtacataatcgttgtctttaaacttaggccttatcagaactctccatttcatctcatccctttcaagctaaaaggaaagctgaccaaaagtgattgtagctaggtttagatgatcccaatcaacaaagtcaaggggaaaatccaagaaaagaaaccagccctccctattgtactgcgaggctctccaatttgttccctgatcatgctttacgaaagaaaccgagtgcacaccatcatagataaatggctcactatggaccagagcatctctatgcatagcagagcgaagttgatacatacccaccgcagaagcatgacgaaagctatttctgacctcaaaaagatgctcatcaagaatgtgatgcaggataagcatatggtggtgatcccaatcttactccggcactggcggctccaccaaagcaaggcagaactcctcatggcgatgaacaggcctttcagggaatgtgagatcaactcttgggacacgcaaatttcctcccaaatgcacaatgtgaccttgatggaggaaacgaagggggttagggttaagattcgccattggcaagggaatcggggtccggggaggcttgaacagtagtatcaacagtagattggaggagatgagggggttgcgtgataaccggcactatctctttaggtctccaaataaaattgccattaccccgggagtttaggactgcagtagaattaatgcggggggaaaaaaagactttgacaatttaaccatggagacaggcctagagctgcatgacccatattcatgcaggtgcggcaccggaaaggcccaacacaggcagacaaagaatgccccttctctaagcaacgtccacaaattaaatttgaatttaaaacttgcttaggaaacggatcccgattacctcgctcattttgaaatttgagactagccgccggctggatcaccggagctttggtcaccagaatggtggtcgctggagaaaccacgccatgcaccttcaagggctcctttaatctatcaaaaacactcttcaaaggaatatcactgtgaacagcttgagcgtaagaacgacccggttgtcccagagaaccagagatacgtttcttaggagccaccgaaatccattctttttcttgatcacgggtccaagcatcaaattcccattgccaattaggtccaccatttctccaaaggaagaagcgtagaacaaaatcatcacaagagaaagacctcaaacgataaatccataaacccactggcttggagcagaccaagaaagaataagaacgatctttaagaagggtaacagagagatccacaggagaaccaccaatcacagccctgagggctagagcaacagaagacgttgtcaaacgaaaatttgaacggggaatatccaccgctaaccggaaaggaggcgagctgaacttagcagagaaataaaccggcgatcgaaaacgatgccaagcttcatccctaattgcatcaccgggagagaaattccaccctcccagcggtgccggagtcaccatggaggatcactggaaatcgcccatcagagcacctccgtgaaaaccggatcgactagcttactcgtagcctcaactgctggtttatatgatactcctatctgatagatcatctgaggcgtttcaattgggggagtgcagatgagtattggcatcctcgttaggcttgccacagaacgggctagcatgcgccatcgtgatgagcctagacttcaagtcgaaatccacgtcccctatgttgacctacggcccaatggccacattgtcagcagagggagcagcgaactcacggagagtcttgttagccatagtcttgaaggttggtggcgctggtacggctggtttctctgtcggtagagttttctgcggagcagcgacttgcggcctgacgctccggaagaaagcttctggattttctttgaagttttccggcaagttgataccagtcatgcactaccctattttcacaacaaaagtgaaaacaaccaaggttagcctgcaaaggaaaatgattatacagaggcaaatataaaatattagttcaagtagtctctattatgaatcttccccggcaacggcgccataaatgcttattggtattcccagcaatggcgcagaaatacttctggtatattttggttacagagttcatccgcaagcgcacggatataccattgtagcatttcacccaagagtatttcaagggtatcgtatttattttatcctgtgggaagataatgtagagagaacttgactaataatttatatattacttgtgataatcatattctaagcaggggttaagataatccaagggtagagtgacacacaagcattaactactcattctcataatatattatctaagctaagtggatagaaaagagaaagataatctattcctatacttataaaatacatagtatacatacattctaggtaaccgatatactagctaataccctctatccgatgccctcctggtacatcgagaagccacccctgactgccgagttccttacgacagcccgtcatgaccatacaaccggggctaaatacggaggaataccctccccaaggaattaacttaggattatataccggcacggaggaatacccgtactgagctatcaccatcagcggcccacctcttatccgcaatatataaccccaaaaaatgatatctcgtaatctagacaccacgtctaaactactagatactactctaatatcatcgtcatgacatagagtaattgcataagcaaacactatacccgcaccaaagcatctcctagataagctagccgtatattcagtataacatgaacataatgtaaagtaagtactcatatactcggaaagtatttcaataccataaatgtatttagaagagtattctaataaaaatacaaggcttacaaaagagaagagaaaagctactatagccatacccgaactcttccaaaggcttccgtactcctgatttctactctattcctattccaccagctagatactactaaactaaacttgagagaaatgagagagctattgcttgaggtgtgtgagtgaagtgagaagaggaactccttttatagctgaactatgacggttgtgatggctggaatggtcggtaataccctccaaccgtcattggggcttcatctcaaccgtccagccaagacctggatccaacggaggcgagggagtttcggccgaaccccctagttcggctgaacctggggccggcccaactagcccatgctttggctggcggcctcctctgttgttcttctccgcagacagtgaattttggcccagtttgtcatgtcaattctgagttcttggcccattcatacataagtctggttctcgatatcgtccgattgatttatcgtctgagttgatgtcgattctcctccactttattgttattctctacaaaaggttagtagacctaatattagtgaaatattattattctaacatatttatgcattgcaagcatcactagttctcctctattttggtaatattaacggtcgaaactgatcgataatgaccgtcaacacctgccgttcttgtgagtagcgtcgtgattgttcgcgcacgtgagagagaacaacaaattagatcggtttgtttttttttggccactgtacgtttcacatcaaggcacatagaagagtccatctccaccttgaccagccactacacaagcccacctctctcaaacttgaccgaggctgttaccaccctccacctcatcacgaccatactgacctctccacttccgggtagcgggtatcgagtccgtagttttctctatatcatataattgttaagtagcggatttgagatatttttataaaaacgaaacctacgcgatgtgagcatttcatttttgagatgatctaattttagttttgcactttgcatttaagtccctgtaatattcatatttacatttgagtccctgctcgaggtcggtggttagttcttgttggaaaaaatagtaaaataatataaaaaagaaaaggcagaaaggtgcaaagaaaaagaaagaaaaagccacaccaaaaaaaagaagaaaaggcagaaaggtgcttaaaaaaggccgcaccaagaaagaaaaagataaaatattcatcctttgagtatgttttcagagtgtagagttgtgcaatgattcatatctagctcttagtgttgtcgggtgcctacttgagctagagttgagcctaggctaggccagcacattgactagtactttgaactattattcaactttgcattttctgattagcacaattgcgttcctttgctactatatattatgcctcccaagctccacatatatacttctggtcagcaccactttgatccttgcaatcgccacatcacgtccttgaaggtgtcacgaactagccaccggttgtaccgtccttagcattgctgataagacacttgtaagagcttgataaagtgctccattttcctgagttgttgagagacaccactacaccgtgtagctgattattagtgataaccttcactgtttgttgctgtttttgtgtttgcaatgacaggtatgggtggcgctcaaaatcagcgataccaacaaggtaacaataatcgcgtgcccgatgatccttgtgctaaggttatgtttaaaataccatctttttcgggttattatgatgctgagaaatattttgattgggagatgatagtagagcaaaaatttagtacccaccttgtgcctgagcaacatcgagttcgacaagctacttgtgagtttaaagattatgcttatatttggttggctgggttagttgcagagggagctttacctactagttgggaagaactgaatgtatctatgcgcaatagatttgttccaccatcttatcttagagaattaagcaagaaactgatgcatttagaacaagggataaaactgtacaggttactatggtgaactacaaaatggattgatgcgatgtagcatagtggagggaactgaggattctatttgtcgtttttactcgggattgaggcgcgaaatttaggacatagttgataataaggaatttaacactatcaaccagttatttcagtttgctatgcatgcagagaaggaattgtaggggcgtgatcaacaggttaagaacaaggcgagcacgtacacgccgcaggcgaagccatcatcaaggttgcccaagcctatctatttctgggcgtctccaccaaagagcaagcgaccggttacatctggagtttgtacagtgccgaaaccaccttccccacgacccgcagattcaggtaaaggttcttcgcacgtatccaccaagagtgccttgtctgtcgcttcgacgggatgcacgcataggattcagtgccaccgctaccatggatttggccatgtccagaaggtttgccctagtcaactggtatacgttgctacggatgatgactacatcagcacttccgatgttgaagatgatgaggaggaagagaagaaagacaaagagcaaaaagacctatctatagctccatgcatgcttgaggaatgtttaattgaccaagcgcctgtaatttctgaagatgagaaaaaaggtaatgataatggtgctacaactactcaaggtatgcatatttatgatgtgccaactatgtccactacttatgctacattatagcaacccgtagtggaaacaattgctgaaatacctttgtcacaaaacaatttgcttgatgtttcttgtgataaagaagagttgtgcgatgcttcacttatatccttgccacaactagtgaatgaacatgttagttccatagtagagctaccatgtgttgagtttaaacatgttattcacattgctagcgagaattatgagcttaaattgctatcttctttaaatacttggggttacattcaatttgatgatgtttgtccactcaactatttagagaagaaattatttgctagatttttattgccatgaccttcagatgtgattttttatgttattggcaattatggtagtaaaggagaatataatgtgcattgagtatatatttgtttgaatttgaccatacctccttttcatgatgaaatgaattgtctaggggactgcatgtgtagaagtaattctctatctagttgctttagttgtttaaatgagttacaggttggtttgcaagaaggggagtgttgtgattttgaccatcaaaaattttcctcaccagatgttgagatagataaagataagttcaatacactccatgacaagatgaaaccgaggacggtttccaatcaagaaggggaggataatgaggacacaactagctcggatataaccatgactatcttatatattaatcaaccaaaggtgcatatgttctatatgagatttacttgttatatatttgaacaaacgttgctacacaatgatcaaagtggtgctgaccagaagtatatttgtggagcttgggaggcacaatatatagtagcaaagagacacaattgtgctaatcagaaaatgcaaagttgaataatagttcaaagtactagtcaatgtgttggcctagcctagactcaattctagctcaagcaagcacccgacaacactaaggactagatattaataattgcacaactctgcactctcaaaacatattcaaaggatgaatgattttttttctttctcggtgtggcttttatttaaacacctttctgccttgtttttttcttttttaggtgcggctttttctttcttttttctttgcacctttcttccttttctttctttctttagtttttttttacttttttttcaacaagagctgaccactaacctcgaacagggactcatatgtaaatataaatattgcagggactcaaacacaaagtgcaaaactaaaattggataacctcaaaaatgtattgctcatatcatgtaggtttcgtttttacaaaaatatctcaaatccgcataaatatttgatatatggatgactacgaactcatacccaggttcggaggtggaaggtgggagtcgctcggttttctttctcacagcacacgcgcacatacgccacacatgaaaacctaacaaccaggcaactccaaaaccgctcgattaaaacttctccaaaccacaaaaacggaaacctgacaatgattagattcgatttttcaaggtcccggcaacaaccgacaatttacaaaattggacacaaaattgacgtacaactcacaccttgataaaccctagacccaaagtgttgaacagatgcattactcaaaactaaaaattaaatctaaaactaaaccatcactcgatacgacgatgcaatctagaattcaacaatgcaaaatctaatagaacaatgcaacaactaaaattgtctaggtaaagaataaatatttttgtgttgcaattttctggttatgggaagacaaattacctaataggcaaccgcgctctgataccaactgatgagaaagttaggtcccgatcttctgataagtattgataaacaatcaatttgggtggattcgctggacaactcgatccggcttctaaacgaacacgctactgagccccgcaatcgcagcaccacgtctcctctggttatcaaccatgccgaaacccggttgacctcaccgagaaggctaatccctgcatgcgaatcgaagaacacaagcaagaacaagatagattgcaacacaattgcatatgaatgattaagcactcgaatttggggttctacaaaccgatttagcagcaaaactgttcttaacagaataatctaagcaaaacccgactctaaacgatgacggctactgattaagtatgattagggatgtcctagggttaccctaagcctataagctttccaaatccatcttaaagtagactccataagctttccaacaagtactcatgggccccgaaattctttctagatcagcggctaggttcgtttgaagttgatgctatcaggaggcccaaatccgaattcaaaacgtgtagaactttatgtcttgtcttctatggaccaaaagtgacgtggtgagatggaagtgaacttggagaaggttttggtttggtccccaatcaacttctttaattatccatgaattccttacgctcgcctcttttctttcacccaagcaagtacctctgcaaacgaaaacacacaaaactcattgtgtagcaacgtttgttcaaatatataactagtaaatctaatatggaacatatgcacctttggttgattaatatataaggtagtaatggttatatccgagctagttgtgtcctcgtcaggaagattccaaaagcatattgtgatgccgaaagaatattcggaaccggtggggttctgattgaaggctagacaaacaacatgactgaaatatgtaaatcaaactagtgaaatagctttataatattatatagatatagaataccaaaagcctgatggctttgtcatcaatcaccaaaaagggggagatagaaagttcaagtgctaataatttggttttgatgatgactgataaattcaattatgtgagactaatttggatatgaaagtgctaggcaaagccctggcagttttcaaggtcaaaaaaatgtggatatgaaagtggagtgtgtgagagctgattcctagacttcatatgagttgagttgagatagaaacgttcattggtgatgcacctaaattacaaggatgaaatacatggagataaagctatatctatcactctctctccatgtacatattgatatgttcatatataatatttcgatgtgaataacattatacacatgagactaatgttttgtttgagcattttttgcttgtttagtctctttacattgagaacatgaagatgatgaaggtatacatttcttttaatgcgtatgtttgataaatgcattctattcttgtataggataagctcctaatgtttcattctttttaggaaaaagtacgaattacccccctcaacaattacggttgttcgatttttaaccctgaactccaataccagttatttttaaccctgaacattacaaaccggacgaattactcccctagatcgatccagggtggtttcggtcctacgtggacacacacgtggcagtccggtcagccaaaacaaaagaaacatatatgggacccacttgtcagccacaacaaataaagatggtggggcccactgtcagcccgagcctccacttttccccttcctctttgccccttcccttcgatctctacatctctagcgcatcaaggcaggtagcggagctcgccgttgatctcgccgcctccatggcgagctcgcagcggcggccaaccagcgcacatgctcgccacggaggaggaacacgagcatgcccagaatggaggcagagacgagagaggcgtcactgcgcacgcgctcatcgacggaggacatcgccgtgctggagacaggggtgggggagaagcgcggggccgaggacagagacggagcgagctcgggtgaccgacagtggcttccctatccccaacctcctcgccgttgaccgtggcgccacttgacctccaggtggtcggcggtagctcgggtggccggcggtggaggtggaggcagagcaagcctgggggcaggaggctgcggcggggcacgcaacgattagttgtggatggcgacgtgctagggcggatgcggcgagcgcagcgggcgggcgagaggctgcagcggggcgcgcagcgacgagcggtggacgacggcgcgcgggggtgggtgaggcgcgcgcctcatcctcggcctccgccacgaggaggctcacgagctcgccgaaggtcgtgatgttgacttgggcgtagggcctcatggcagcgacgcctgcacctgactgtcgtaggcgcggcgtgcgccactgccgttcatagcgccgacagggagagtcacggagggacctcaagacggcggcaggcagaactgcctcgcctcctctgccgtggcgctcaccttcgccgccgccttgccttctccactaccagttaggatccgccgcctcatccttcctcagctctcccgacggcaccagacgagagagagagaacgaggaggagagagaacctcgccgccgcttcgcctcctccacgccgcgcgctgcccgccgtgccacatctcccgccggcccccgcacgccgaccgcccgtccacgcgccgccgatgccgcccactgctcgttcacgcacacccgagagagagaggagaggagagagggaagagtggtaatggcaggtgggcccaatattttattttatttcattttgttgattagatttccacgtcggcgccacgtgtatgccacataggagaaaaaccgctcaggattgagtcaggtggtaattcatccggtatcaatagttcgaggtgtaatatgtttggttttgtggttcaagggggtaattcatactgtcgcaataattcaggggggtaattcgtactttttccttctttttatgcatactattgcttcacacaaatattttgtatgcatacatttaggggaagcaaatcctataccttagttatgcatgtatttgatccaagttattcacttttatttaattcggatctttacagttgagcatatatttgagtatatgacacttatggtgttgattaatactcatgatttattcctatccttttatatgcgcgatcggtaaatcaacatgtagaggttgacaaccggatcattgagactaataatttcattgagttcaatgagaaaaataggtcccaaggattgaaaagatgttgatgctcaagtgatatgattacacctaaaataccaagaataacacagtagagatattgaagatgttggatatgaggtggctactatggcaagacggtgaaggggtcgcgatacaccatgcggcggtgaagggcaagcaaggggcatagcaccgaagaaccaaatccggtggtaaaggggaagtgacggtgttatcatgatggaccgtgcgagaccatttgaagctacaagtaaccgcataaatcatttgaagaatatatggtgaaacggttttggcgttgcggtcccttaagacaaaggaaggaagatggaaagaaggtattcctattagtataattctcttcctatttaaatttgagtacaggaatgtcgtactatcaagagtgatgcaacgtcgatgtgtttgtgtatgtgtcggtgctcaaagtgatctgtcatagtgctaccttgagagaaacccaagatttaacaaatcctttgagtgtttttagacgttttttggttgagttgggtagtcctctgagtcggctttccatagagtccaagattatcaaaaacagactcccaagcgaaatgttatggtcgtattactatgtgcttttcggaaattctgaaaaaactccgaaagtccgaaaaatatttcggaaagcccaaaattttttggaaattccaaaaatgactgcgaaattcatatagacttctgttaattttcgggcttgtccgaacaggcctttcggaaattccgaaagtcatagtcttgtccttcaatggctagttctgagaggctcgtgtatataaactcctccacccctgttgacggtcgttatcgaccaattttgaccatcaatattactcaattaatgaagactagctatgcctgcaatgcataatttccaaataaaatatctacctccactatatactatgctactaacatgtatataggagaagcacatataaatgcaggagaatcaatagaaaataaaagatcaatcaatcaaacattgtcgagatctagacttatggatgaatgggccaagaacacaagattgacacattcctctaggccatttggataagggaggagttaaggggggcacctgccgaaaatggaccagaatggcccaactcatggttcggccaaaccccccatctgcgccgttgattcttggttttggcgtggacgctccagatgatgtcctgatggcggttacggggcacaaaggacatgtcgcacacttataaccgtcataactgccctatataaggacttcactccctccacttcaacacacactcaagaagaagagctctctccctctctcaagtttagtagtatcttagtgctagtggagtaggaattagaatagtattctgaatcctcgggtcttcaggagaagtcgggtatggctctagtagctttccactcttcttttgtaagacttattgaattaacagaatattcttttttatacatttatggtattttattccatttatattatctaagtaccaactttcatttatacttatatcaatatagttctgtagctagcctaccagataggtgcaatggtgtgggtttagtgtccgattactcggttgctctatgtcatctcgggggatatagagtagtatttaataatatagacgtggtgtctagattattaagtatcattatctgggcatatatgctgcgggacagtagaggtgagccactgatagtgacaactcagtacgggtattcctccacgttagtataaattcataagacaaattcctggggagggtactactccatatttaaccccgttggaaggccatgacaggttgtcgtaaggaacttgacaacccagggtggtctctcaaaacaccaggagggcactgttaggggttattggttgcatggttgtgtactagcaagtgtagactaaatatgtatgtatactagaagtataggaatgaattcttttcttattattcctccacttagcttagattatattttagtgagagtatcctagttctttcttccgtgtgtcacataccctttgaattacttaacccttgcatagaccttgatgtatacaagtatataaactattagcatagtattctcttatcatatcttcccttgggattaaataaatacgataccttggaatactcctagatgaaatgctacaatggtatatccgcgcgcttgcggacatatctataaccataagtataccatgaaaatttctacgccattactgggatttatatttctagaaatatcgttaagaaatatcaacaatccctcctttgagtggctgttgttcttgggcattattagacacatccaaagctaaatagccttccccattatcctacctttgtggtgcctatttgtgagtgggatttgagaaggggagagacttggattgaatgattgtgaaattgagaactagtgagcttcacacaatactttgagctctcgagttcatagcaagaaaatcttcgattgagtttgttactcttggggactaaggtctcgtagatggctaggcatcgctggtgagcacccaaggttgaggtgtgtcgcggaaagtttatgaaggcatcgatttcgcctccgcaagggaagagtgaaatcgaggagagcatttgcgcaacctcgtaaggaaaaggttgaaatagacccacctttgtggcccccccaacggagacgtaggatccgcagatccgaacttcggaaaataaatcaacgtgtctgttctcttgggttgctcattcttgccattctcatattgtgcttgagcttgtttttacccaatctacttgtatgcttaattaatatagttggtgaccttatatcttgcttagataccttgtttgtcaccttttgattcatatacattttgtttgttcgagctacaaattcatagatagtgttttattctattaccactgaacttttcggttgagaccggaacttccaatcccataccggaaattccgatttgaaccgaaagttatcatcattataatatgctaatgaagttgtgataacttttaggaatacctattcactccccttctaagcaacatcaaggtcctttcaaacctgaatgacattcgatagtaagcatacattccattggatacgtgaacgttgtcttgctttgatcgtaggaatatatgggaattatatgataaccagaatacccatcaagaaaccaaaagaaggaatgatttgtctgccgctctaacatctcatcaatgtagggcagcagaaaatggtccttttttatagccttgttgagttttctataatcaatgcacatcctccatctaatgacagctcattccgggattaactcgttcttcaagttttcaactactgtcatgcctcccttcttaggcacaacctgaactgggttaacccattcgctatacgacataggatagacctctttttcacaacttctctcatcgnnnnnnnnnnnnnnnnnnnnnnnnnnnnnnnnnnnnnnnnnnnnnncagtcacgcg

SEQ ID NO: 29879 - DNA, 738 bp, Oryza sativa
  unsure (1)..(738): unsure at all n locations
cgatcaactctctattgggcggatcaagtcgacaatagatcggcttaagcccgcaaaattgatctcatagctcaactcaaagaatgcaatgccgaatggatcttgaaaacaaaaagctaccgatccttccaagtgctattgaagaacaaaagtctaggctgaaatcggccattaggaatgttgccgatatgactaagtccttaaaagtcgcccctggacccgatgcacaagatgcccaagcaattgaagaaatagaccaaatcagacacaaggctgtatcggctatcaagcgatacttatctcagtgactatgtaataggattaagaaaaaaatttgtattcggctaagaaattatggtacttcatttgttgcttttgttgctgaactgatgtgccgattaatataacctctcgtttttgctaaaaaaatttgcaacttttgctttgcaacttttacatatatgtgcccccctaattttacaatgacgaaggcattaataaaattataaattgaactaagggcgatataaccatatcggccattgtatatcggcaaaacacaaccgattacaatataaaaacaactaagggtgatataaccatattggccattgtatatcggcaaaacgcaaccgattataataaaaaaacaactaagggcgatatanccatatcggnnnnnnnnnnnnnnnnnnnnnnnnnnnnnnnnnnnnngttcaacaaatcaaanngcccact

SEQ ID NO: 29880 - DNA, 6002 bp, Oryza sativa
  unsure (1)..(6002): unsure at all n locations
aataaggtagtattggtaatttccagcctaatggtgtcctcgtaaggaaatatccaaaaagcatattgtgacgccgaaagataattcgaacccgggtggggttgtgattgaaggttagacaaacaacatgcctgaaatatgtaaatctaactagtgaaatagcttttatactattatatagatatagacttccgaaggcctgatggctttgtcttcaatcaccaaaaaggggtatatagaaagtacaggtcataatactttggttttgatgatgcctgataaattcaattatgtgagcctattttggatatgaaagtcctaggcaaagccctgtcagttttcaaggtcaaaaaaatgtgnatatgaaagtggagtgtgtagatctacttcagaaacttcaagaagttaagttaagatagaaacgttcattggtaacgcacataacttccaaggatgaaatccttggagataaatcttacaacaatctctctctctccaggtacatattgatatgtccaaagagaagattacgatgtgcacatcattattcacatgaccctaatgtgttgtaggagcattttcggcacgtttagtctcttcaccctgaaaacatggagattgtgaaggtaaacattcctttagcgcggtaggtttgatagatgcgtcctattcctgtatgtcttacgccgnnnnnnnnnnnnnnnnnnnnnnnnnnnnnnnnnnnnnnnncttcttgctatggctcaaggtggggatcaaatccctggtagcagtgaaacgcttgccagtcagcttgctgttgttgcatcatggtgttaaagtttgcgagctgtgcaccaacagactgctgccgttcccgtgactgtaccacatgatcctccaaggtgtgttgctcattccctgcctgcagttctaagtgtatccatcctccggatgagttctcccagatcccctcgagaggagactgagcaatgcatcaagaggatggaggtagaccacttgaactgaaggagcccgagtatccctagtgcagctcctgtggctcatgcctcctgctgtcgctggcactctgccaggacgaacctccggtgtcatgttgcaggaattgggtccaaccacgggcatgcacggtcgggccccaactgtttccatacatctgcactggtggttatgaggaagacgcctccagaggtacttctctcgccattcgtcatgttaccctgcgtgggacttctcgaggcaactccgcttggaaagaaatggttagttctcggcagttatacaaatgaaactccgggttaggtaacgtaatctcatttgcatagccgggaaacaaaaatataagataatcatttggaccatgtttgagtatgtggcattgaaccaaataggcctcatcaacataagagcgggtaataggaatatttgcatataaagcagagtcccaactcttcatgctaaatgagtcaccaaagaaatacactcaacaggactagacaacttcacattttctaaccattgcttgatcctgggttgaacgggtgaaactttgattttttttttaaccatggcatacaagaggactagttcgcactatccggatattagctctaggaaacaacgtgaaacaagaaacttatgcaacagccttaaggtaggattatggatgtcattagttctaggctttctacaggatgagagacccgaaatactttgtcaaaacatacgcttgttaaaatcaggaaatgcgttcctgaaattaactttgcatgttttgtcaaagactagaagcaagctaagttctttccaagaaaggtgatattccttgcggaataaccggaaagtaacgccatcgcctacctctagcaaggcacataaaaactgcatggtaagcaaacgggaacccggctcttctacacatgcaaatttatcccatcctacagcacgccaaatagtatgaaactcagcatccatacctatccttttcagaaggtcgagtcgtatggtcaggtctgagcacacgtttggtctttcaacatatgataggcttgcatttcccggtggcccacaaggtcgagatcagagttgtcgtacagccttggtggaacgtacgcctcctccatggatgcatccgcggaagaaggtgcactcggcttatcgtgtcggcttgtccgtgagcttgatcgtctcttgaatatgcccgaaagtcgtttcttcatagctacagcaaagagcaagaatacaagactactcggacgggggttaagcaagtacccgccgattatccttgcaccgaactaaagcaaacttgtatatgcaaggtgtctaaactaaatgcagtgaattgtgtgaatttgaggtaagcctgcaaaactttgaatgaattttgcagcaaggttttgagagggagtgaaaatgagttaaagtggtgtgacctccctctcccagttgagctgcatatatagtgcatggataacggctagtaatggcatgtgggccccactagccactaccctgcagaaatttgcaaccagccggtaccaggccaattcgaccgaaccaaggggttcggccgaaccactggtggacccaatcggccccacatttagccattgggctccaacgactagtgtgaaggtggctgtgcaaaattttgccaaaaattgcattttattttgctcacaaaaaatcatttgaagaaattgcctcaaattcaaatctaaatgtgcatttgaaaattcaaacatgctttgatgcaatggaaaataaatatgagattactaccaatttacctgttggcaagggcgacgtcgtttcaggtccgatgagcacgaccatacctccaacgaattttgctcgatgaggcacccagttccggaggtacaggaacgggtgtcttctccttaacccgccacaccttcctgatcataggtgcgggcagcggcctcttcgaaactgggaatgcaggttgaccggcctgtatttccagtttcttggatgccggcttaaggtactgacggttcctcgtttcttcccgctccaggaagttcatcatgaaagtgttgaagttatccgtccttcggggttttactttgacctccttgtgtgtcgatatgttcttgatctaccccatggagcaatgctccatccttggtccccttgtggacgattcccgttgttgttcatgagcttgacgttctcacaggttttccgacaatccgtgccagagtgaccagtattgccatcgacctcacatgtcttgtgagagtccatggccttaacggtaccctgctcggcgtccttctcattgttgtccagtctcctcataaggagatccaactgagcggctagcatttccgtccacttgacggtgtacatgtcgcattgacgggtttggagtcgttccttgctccaccccttatttgagagcatcttctcaatcggttggcatataactgttcttgagaagaatgtccctccagcagcagcatccaggtgatcccaggacgagggggttaatccgttgaagaaactctgcaggatgagccactcggccatctcatgatgaggacgggtggtgacgtattcctgcagcctttcccaagctttaagaatggtttcatccctcatcagctgcaaactgggtattcttcgacgaggagcgttggtcttgcccatcgggaagaatcttgagaggaatgccgttgagcgcttattccgggtattcaccgttgcacggttgatgtagaaccactgttctgctctcccgaggagagagaacggcaacaggtggagtctgactcttctgacggtatacgtgctacagctttccaggaattcctgcaattgagcacttgaatcctccttaggcttaccacagaatgggcaagcctgcaccatcgttaatttagctggtcttcaaatcaaagtcaccgtttcccctgctgacttgggttccaactggcatgttaccagcagagggagcagcgaacttgcaaagggtcttctcatccatatcgtgcaattctggtggcacggaattggctggtctagttgccaatagagtgaccttgaggatgaatgacacggggtcggcttcatttcacccgtgactccagataaaaaattggtcggcagatcagaaccagtcctgtactactctgttttcacataaaagagaaaacaaacaaggtttgcctacaaaggacagtgacttatatagaggtaaatataaaattattagcaagtagtaaactcttaatcgtttatcttacccggcaacgtcactagaaatgcttgttggtatttcttagcaacacaactggaaatatagttcccagcaatggcactataaataatcctgctatattctggttacagacgtgatccgcaagcgcacggatatataccattgtagcatttcaccagggagtattccaaggtatcatatttattttatcccaagggaagatatgataagaaagtaccatgctaatagtttatatattacttatatacatcaaagtctacgcaggggttaattcagttcaaagggtagggtgacacacagaagaaagaactaagaactactctcactaaaatatagtctaagctaagtggagaaagaataagaaaagtatcattcctgtacttctagtatatatacatctttagtctatacttgctattatacagtcatgcaaccaataccccgtacccagtgtcctcctggtgttttgagaagccacccctgactgccgagttccttacgacagccagtcatgaccatacaactggggctaaatacggaggaataccctccccagggaattaacttaggattacattccagcgcggaggaatacccatactgagctgtcaccaccagcggcccacctctcatccgcaatatataaccccaattaatggtatctaataatctaagcaccgcgcttacattactaaatactactctacatccttgcaacggacatagagtaaccgaataatcggacactaaacccacaccaatacacctatctggaaagctagttacacgactatattgattcaattgtaaagtaaagtcggcactcaagtaatatgaattgaataaaataccgaacttgtataaagaagaatattctgctagttacacaactatattgattcaattataaagtaaagttggcactcaagtaatatgaatggaataaaataccgaacttgtatgaagtagaatattctattaattcagtaagtcttacaaaagaagagagaaaagctattaaaaccatacccggaatctcttgaagactcgaggactatgaagactattctcttgatcttcttcttgatcctaggagcatctttgctctccttaggacaagtagcaagatgaagtatccaaagagcatctttcaccgccttgtgccatgtgtccatgcttatgacggtttctaccggtagaattgctcctaaccgtcataggatacctgtagataactgcaggtggaaaatgggctggattaggccagctggtggttcggccnnnncncccnctcttcaccttcctttccttctcttcccatctcttcccctttttaataccctttttactttcctgttttaaccaatcacttctaacgtaacgaatgttcctggaacgaatccctcctatgctaccgtgctatggatcattttatcacctggactttttttcggtcttgcttgacatacgtcggtatctctagcgttctactggcttacctgaatattttaaacatcaggatagctcctctctggtacttaaacgattcttaccatagggagtatctataattcaagtctctcgtttggaagttacatctttgatgcgtatgcttacgcaatctttggttctcctagtgctacttcctctatatttggcaccctcgcttttctatcctaccctctctttctctaacgtttagtaatggtatctcttttcctttgctttgacg

SEQ ID NO: 29881 - DNA, 39999 bp, Oryza sativa
  unsure (1)..(39999): unsure at all n locations
gttggttaaatgctagtgtcaccgacaatagttgttccaattttaaaagaaaaatggccccctcaagttaatctgtaatgaaattaaaagtctacgccttgatgaatagagaaattttttgcctgtgtacaaacgttatttttattccaatcttaaagtaaagttggcactcgagtaatattaatggcatatatacccggcgtttgtttaaattaggttatactattaacccagaaggcttacaaaaaaaaaaaagatgctattaaaacattgccggaatctcgtaaacagtgatggactataaaacaaattgactggatgttattntgaatcaaaggagcaatttagttctctttaggaaaggtagaaatttgagtatcaaaatagtttctttgaaggtatgtagcgatgtgagaatgattagaaaggtttgtaagagaaaaattgttataaagagtgataggatttgggttgatggtgaagggtggnttttgggttgggtttagggtttgggtgggtgggnnnnnnnnngnnnnttngnccgaaccctggccatacccaatcagcccacaattcggtaggtgaattcctcgtttgccccttaagtcagaacagggaattttgggcttatttgatcatgtcatatttgagttctcagcccatctatccacaagtctgatacttgacaatgtctgtttgattgatcgattgttttactatcgattctcctccattttgatagcttctcctacatggttagttttccaagcatatagtggaatagaatattttatttatggaataatgcattgcaagcatagttagtctttattaattgggtaatattgacggtcaaaactggtcgataacgatcatcaatagaagttaggtcccgatcctctgataggtattgataaacagtcgatttgggcggattcgcgacacaactcaatccggcttctgaacgaacacactacttagccccgcaatcgcagcaccacatcctctctgtttatcaaccgtgccgaaacccagttgacctcacctagaaggctaatccatgcatacgaatcgaagaacacaagcaagaataagatagattaaaacacaattgcatatgaatgattaagcactcgaatatggggttctacaaaccgatctagcggcgaaattgttcttaacaaaataatctaagcaaaactcgactctaaatgatgacggctactgattaagtatgattagggacgtcctatggttgccctaggacgcacacccccttgggctaagcccacgattcaattacaaggcgcaaaacccaaatcagattcggacatgatgagatacgggacttgttttgaaaattccggcagctcggtaggaattttaatgtcggaccaaaaccatctgaaagtagactcaataatctttccaacaagtactcatgggccctgaaattgcttctagatcagcggcaaggtccgtttgaagtcaggaggcctgaatccgaatccaaaacgtgtagaactttatctcttgtcttctatggaccaaaagtgacgtggtgatatggaagtggacttggagaaggtcttggtttggtccccaatcaacttctttaatcatccatgcattcctttcgctcagtctcttttatttcacccaagcaggtacctctgcaaacgaaaacacacaaaaccccaaatttaagtgcttaatcattcatatgcaattgtgttgcaatctatcttgttcttgcttgtgttctttgattcgcatgcagggattagccttctcggcgaggtcaaccgggtttcggcacggttggtaaccagaggagacatggtgctgcgattgcggggctcagtagcgtgtttgttcagaagccggatcgagttgtgttgtgactccgcccaaatcgactgtttatcaatacctatcggaaggtcgggaccctaacatccctcatcagtttgtatcccctaacatccctcatcggtttgtatcagagcgcagttgctcgttaggtaatttatcttcccataacaagaaaattgccatacaaaaatatttattctttacctagacaatttgagcagttgcattgttctattagattttgcattgttgaattctagattgcatcgtcatgtcgagtgctggtttagttttagatttagttttttagttttgagtattgcatctgttcgtcacttagggcctgttcactttggtgtcattttcaaccttaccaaattttggtacagttgccaaaaaagtggctacatttagtttgctgccaaattttttaactatataagaaatcctgccaaaattttggtaagttgccaactatgccaaaattttggcaatgccaaattttggtaaggttttttttggcatcaaagtgaacaggcccttaggtctagggttcatcactcaagtctgtgagttgtacgtcagttttggatccagttttgcatctcgtcggttgttgtcgggaccatgaaaaatcgaatctaatcatcgacattacttgaacattgcatcccgtccagttttgcagaagtttttgtcaagtggttttggaggtactcaaaatctagggttcctgctattggtcttaattaacgacgttactagaaatataattcccaacaatggcgcataaatacttctggtatattatggttacagagttaatccacaagcccacggatataccattgtagcatttcacccgagagtattccaagggtatcgtatttattttgtcccgtgggaagatcatgtagagagaacttgactaataatttatatattgcttgtgataatcatattctgagcaggggttaagataatctaagggtagagtgacacacatgcattaactacttattctcataatatattatctaagctaagtggatagaaatgagaaagataatctattcctatacttctaatatacatagtatacatacattctagttaaccgatatactagataataccctctatccgatgccctcctggtacttcaagaagccacccctgactgtcgagttccttatgacaacccatcatgaccgtacaaccggggctatatatggaggaataccctccctaggggattaacttaggattatataccggcgcggaggaatacccttactgagctgtcactataagcggcccacctctcatccacaatatataaccccaaataatgatttcccgtaatctagacaccacgtctaaactaccagatactactctaatatcatcatcatgacatagagtaattgcataagcaaacactatacccacaccaaagcatcttccagataagctagccgtatattcagtataacatgaatataatgtaaagtatgtactcctataatcggaaagtatttcaatacataaatgtatttagaagagtattctaataaaagtacaaggcttacaaaagagaagagaaaagctaccagagacatacccgatctcttccgaaggcttccggattcctgatttctactttattcctattccatcagctagatactactaaactaaacttgagagaaatgagagagctattgcttgaggtgtgtgagtgaagtgagaagaggaactccttttatagctgaactatgatggttgtgaccgttggaatggtcggtaataccctccaaccgtcattggggcttcatctcaaccatccagccaagacatggatccaacggaggcgagggaggctcggtgtcacatcctgattttcgctttaggatttaataaattatttttagaatttatattaaatatttattaatttacaagtgaagttaaatgtgggaaatcaaatttcctaaatataaagtatggctggatttaatttttattaaattcgccatagttaattataccctctggaattttctttgatttttcggagctcaatttgtaattttaataatacaaacaacatttcagtaattattcacatattaaattaatcaataaatggtctacttataattttgttaaatatttatagtgttcaagtactttcaggatttttcttgatattatttgagcaatagaagtattgttaacaattcaaggatcatttcagtgattaatttaattggaaaagtaattaaatcctctttttcatttcgggccgaaacaggaaaagtcctctctctttctctgcccaatctctctctgggcctgcagcccctctccctctctttgtcgaagtctgctatttgtccctctttcaatcaggccttggaagaagaagcccagccggaagtttgttattctccctctcgctacagtggcatcttcaacctccagccagccgtccagagcccctgttcttcccgatccggcgccgttttctctctccaactccggccgccatcttcagccgccttttcccgtcacgccggccgttctcgatcagtgacgccacctccctccgctccgcaaggttgatctctaccatggccgccagttcttttgcgccaaatcccgccggaaggttgccgtcaccgtgaacccgttggttgttgccttggtttgatctctagccgtgccgttcgtcgtcgtccgtcatcgccttcggtcgccgtagccttcattggattcgcagctgtaaggagaacaccgtccaccacctcttcttcaccaaagatcgccggaaagccgtcgccgtcgttgatcagtaccccgtcgccactcccgatctcgtcgccggccatctcctttgttgttcatcactgcgtaagtgttggtaaggatcatcgcgtcctcctcttccttcccgtgctatcggtttctgctgtcgtcctgccattcaccggtgtaggtttttccctagggtcttaatccaatctaacctaatccgttgtttgtctagcatcgtcgtcgtctccgtgtgttgctgccgtatcggtgtcgtcgtctctccctcttcaatcgctttggttcggtgaggcttctatctatgttccctcggtttaggttttaatctctcgtttgtgtcattgagtagccgccgccgtgccatgcttagctgctgccctagcatcactgctgcgctagccgcctagccgtcgttgtgccgctccatgctacagccgtgctgctgctgctcgtgagtgccaagtcattgtcgtcccactaccgcagccaccatttgccgtcgttgctgtgccgtgtcggattcgtgtaatcctaggttcctaccggcctattgtttgccgtaccggggctttactatgaatcgtgtcgagctcaccggtttagccgcacccgttgttgagtcgttcgctcgttcgttcgaacgaggtgtcccccgtgcttcattcgttcgtccgtgttgagttgtcctttagtttagagccattcagagccgccggcgttgatcccgcgtggttgccatgtcattgccttgtcagctgtcgtccctgccatctaagtgtcacgccgtctctcagatcccacatggcagccatctaaaaccttagatcagatcaatccgagccatccaattttggtcaactaggtcaaagttgatctcagccgtccaaaatcaatataaatcctgttattccttttcaatggtatattagttctttttactatatgtcgtatactaaattcattccaataatttcggcggatgctttagtcttatatctcagatataaattatttgtaaattgtttaattaatttggaatagtcttttctttaataggtttaattggaattaatcttgtaaaattcataactaattcatatgaaatcagaatgaggccgttcaagtctcataattcatctaaaatcatgatctacatgtttgtttacttttatgtactatttatttggtttttattagtctttttttttcgttttgcgtgttagcttgtagtttccattgttgcgaaggttcgtgactgcgttggaagtgattcagaagaataattgaagactgattattgcagggcaagtcacacagatcccaaacacaatcctttgagcatgttgatcctatatttaaattctctatttatttcaactgtgcatttatattcgaatgtcaccgggtggtgtgaacctattcctttgttatggccaatttgcattgattaccttattccttgataccttgggtaatcaattgattagcttgaactttatatattggtttggtttagctaaatgctttatatatataacttcttagccatgcttagaaacaatagcacatgattgcgataactaatgttacactatcacttatgattatatttaatggtagctgacgatggccaatcgtgattggttaattaattatttgccaattaaaacttgtcaatggtgggttgtgagcacatggttttgaaggtcgtgctcatgacaattaaggactggttcgcgagctactgttgtgagacattaaccgtgccaaccacaagccaacgtgggcaacggctttaccttttgtatagcatggttcattacggggtgccatactgagaagcggcgagaagtctgtgggggtcgctggggagtccatgcctctggttatatttatagagggggtgattatgatccaggaatggtgcactgtggtgagttgtgttgtgcagagggtattgtcacagcctctattcgggtactttccagtatcgtgacgcatggtagacatgatgttgaggctgtgtcttgtgggtacaacggtacacctctggctagagtaaaactattcgaatagccgtgcccgcggtcatgggcgggttgagcaatgtttttcgtgattagtctcacacctctcacaataattattaatgctataactggtaataatttgcctagatcctggttggagttagatctgtacagccgggtatggttgttcaggatggttgggcctgtgcaacatgggtgtgctgtgcagtgttgatgattaattactttactgttttactactatttaatgtttgctaaatgctgcttttgcaaataagcctatattatgccatcctttggtatccttgtgcacttgcatatttgctgtgtggcttgcggagtattccatgtactcactttgcaataatcaatcaacctcagttgaagaaaaaggatctagaaggataagacgtttggcttataccccagttgagctgcctgtgggagtggagctgaagccatcgctagaccgttaattccgctgctgttttcttttcttttgcaagtatgtaacgttattattataacggatttgtatattaaattgtcagtttgtgtacctcggctgattcctggacgagggttttatgcacaaataagtccggaaattactagtgaatttccgggcatgacattctgccgaacctgggaccggtgttgacagtcgttattgaccagtttcgaccgtcaatattacccaattaatgaagactaactatgcttgcaatgcattatttcataaataaaatattctattccactatatgcttggaaaactaaccatgcaggataagctataaaaatggaggagaatcgacagtacaacaattgatcaatcaaaccgacactgtcgagaatcagacttgtcgatagatgggctgagaactcagatatgacatgatcaaataagcccaaaatttcctgtcctaagttaaggggcaaacgaggaatccacctgccgaattgtgggctcattgggcctggccagggttcggccgaaccaccagttggcccaatccaacctattttccaccggcagttatctataggtatgcaatgacggttgggagcaattctaccggtagaaaccgtcataagcatggacacatggcacaaggaggtgaaatatgctctttcgatgcttcatcatgccacatgtcaagaggagagcaaagatgctcctaggatgcttggagcatctccacactcccaaggcacctcatggctataaatacccctcctctcattcattcccacacacaagttttgtttagtagttctagtgctagtggagtaggaaatagaatagtcttcatagtcctcgagtcttcaggagattccgggtatggctttaatagctttgctttcttcttttgtaagacttaatgaattaatagaatattcttctttatacaagttcggtattttattccattcatattacttgagtaccgactttactttatacttgaatcaatatagtcgcataactagctttccagataggtgtattggtgtgggtttagtgtccgattattcggttgctctatgttggttgcaaggatgtagagtagtatttagtaatgtaagcgtggtgcttagattattagataccaataattggggttatatattgcggatgagaggtgggccgctgatggtgacagctcagtacaggtattcctccgcgccggtatataatcctaagttaattccctagggagggtattcctccatatttagcaacaattgtatggtcatgacaggctgtcgtaaggaactcggcagttaggggtggcttctcgaaacactaggacattgggtacggggtattggttgcatgactgtatactagcaagtatagactaaagatgtatgtatactagaagtacaggaatgatacttttcttattctttctccacttagcttagactatattttagaaagagtagttcttagttctttcttctgtgtgtcaccctaccctttgaactgaattaacccctgcatagactttgatgtatataactaatatataaactattagcatagtactctcttatcatatcttcccttgggataaaataaatccgataccttggaatactcccgagtgaaatgctacaatggtatatccgtgcgcttgaggatcacatatgtaaccataatataccaggaatatttctagtgctactgtcgggaattatatttccagtagtgttgctaagaaataccaacagccggcccaaccagcccatggtatggctggcggcctcctctgttgttcttctccgcagacttgtaaattttggcctagtttgtcgtgccaattctgagttcttggctcattcatacataagtctggttctcgacatcgtccgattgatttatcgtctgagttgatgtcgattctcctccactttattgttattctctgcaaaaggttagtagacctaatactagtggaatattattattctaacatatttatgcattgcaagcatcactagttctcttttattttggtaatattgacggtcgaaactgatcgataatgaccgtcaacaaaaccccccaagcttgaacctttgctcgccccgactgaaggacgaaaggaaacaaggacttggttgttgattaggagttgctactatgctgcatatctcaaagatacaggtgcaaggtatatgtactctctcttagcttaaataatctttggcacggtggcttacccttacccctgattcccacgagacactgcttttccttgccttgagcagttgaaagacagaacaataattagagcaccaatcacccaatctttattcaactcttattccagaagttttcaaatgattttgtaaaagaaagccaagtttctcaaatgattcactcagtctctctaagtgcatcaaaatgaattcctcaccaatttgcctttttgattcctactccaaggtttgatatgtggagctcgatagggatcaaacatggcatacttgcatttacatttattactaagtcaaaaacttagactaaagcagataactaaacatactccagatcaagatcgtgcgaaaaaatgtgtgtggtatatggtgcaaaaaatatgagtttgacagagttcaatggaatggcaagtaaccaaagtttatatggtttaatcatgatagcacatttttagctctagtaggaatttatttcaaatgaggaactctcaatttatcattttgaaaaacaaaacatccggaattcaagtcaaactagtattaggatcatagcaactcatatttactatcacatatctcgcaacaacttagacttagatcagcaggtgcagctcatttacctcaggttcacagataattgttggctacttatatttgacctttgagagagcacttaccaaaaacccatatatcagagatataaaacagagattcatcatttcaacaaagagaactagcttgtcttacctagcatgactcaaacctatcctatctttttggtattttctattttgcaaatttttatgttgtcttcatttttataagatgcaattagaaagcaaatatgcaattgaaaagggaaatatgcaatgtgatacaagttatctcaatggggggggggagagatatctcatctctcccccaagctaggctttcgctcagggtccttgataaggattgaacccctgaaaacggaagtacgcttgaaggtcatcgtgctattgctgcatcatgttgttgaggttggtgaactgcgcatcagcagattgttgccattcttgcgtttaaatatgtgttccgtgaggttgtactggatctctcccgtctgaatatcaggggtgtccattctcctagtgatttcacccaagtcccaatgagaggaacttgagcgccattcacttggagatggaggcacaccacttgatctggaaggttggttgtccccccattggatgtcatgaggcgcacgccaccgatcctcactggcactcgcccgggttgagactacgatgttgtggtgtggagcttgggtccatccgggtgcgtccccagttggctcccaacctgcctcatacagctgcacgggtgttgaggatgatgaactttctcgttcatttcttgtcatgttgcgcgtttccctgtatgctccacctgtacgagattcttctatggtctgcaggggaatggttagttcacgacagttgtacaaatgataccccgcatttggcaataggatttcatttgtacaaccggggaaaaagtaaatcaaagatctgtctactccatgtttcagaatatgcccttgcactagataagcctcatcaatacacggacgagcggctgagataaaagcaatttggtcgctaacgacccctagcccttttgctatccgagtaatcagagaagtgcactcaataggagcagagaacttatactttctaaccatggcaaaattcataatcaattcatctcccctaatgggcctcagatcacctctaggaaacatagtcatagcaattcatttgtgcatgagcctaagtgtaggattatggatatcattcgttataggtttcttgcaaattggagcaccaaaaatgtcttcccaaaacctatttttctcgaacccagaaattcctttctagagatcgattttacaggaatcgtgaaaaccaagaagtgtacttgtcacgtgtgagcattctccggagagtattctcgcgtgtgagcatactcccggtcgctcagcatgtagtaggcttgtctctcccgatcactgacaaggttgagttcggtgtcgttcagaagtcgtcgcggagcttcggcgtcttccatcaagacatctgctgatgaatgagtactagactcgtcatgatgacttgatgaagagccggaccccttgaacagacgagacagtcgcctcctcattctgcacaatggagcaagatcggactaactcggcaggagttagcaatgacaagaatttaacccgccggttagtttcaccaaagcaacttgtatatatgcaactaagtgttttgaatttcagggaaactatcaaagcttgaatgaacttgagagcaaactttggagagggaatgaaaatgtgttgaaatggggtggaattccctctctcggccggctgtcttttatagggtacccacaatggtcagaaatgacatgtgggacgcactagccgttaccctgccaaaagtggcagggaaccattgcctggccggttcggccaaacccatggtgggcccagtcggccccactttcggccgttgggttccaacagtcaatgtggtcgtggcatagcgaattttcgttgaaatttttattttggtttgctctaaaaaaattcaattgaagaatttcctcaaaattcaaaaatcctaaatgcaactttgaaattcaaacatgtgatgatgcaaaaattcaaattgttgaaagcaaatatgcggatacataccaatttttctgttgccgaaggtcgcgtcatttaaagtccgacgtgcaagattgtacctccatccagttcaatttgcggattttctacccgtctccggaggtgatggagcgggcctctttggtttctccctccacggcttcttctgagctggctgctctagtttcttggtcggtatgggtggttgttgatgtaaaaacccgaggcctgagagatttgcttaactccagtgcaggtccaaatgctttcctttaggttcgtgagcatgccagttgatttgatcctgcaatcaccaagaaataaagacaaagaaaccgtggttaaatccataaaggatagccgatcggctagttaccgatgacatcatttatctctgagccgatgtcatgtttgaatcgatcggtagatataaacaagtaagaagagactaaatctactcgatcggctatagatattgacaatatattatctctatgtcggtatatacttaagtcaagtgattgggatagatcggacgccatgccgagacaatataaatcacttagatcgaagtatatattcacaacaagattatagatgtttatagcattgcctatcagatagatctagcacgtatcgactaatactccgataccactctatattaagatattaaagcaagtaaaatatatcaaacagaagcctaatatactttgttgtaataagatcttaatataaagggtagatctagcatgtcaattaagcgcatgagataatagggctaaattaggtaagatcggctgaaaccccgatactaccctaatcgacaaccaaaagcaggctagagattgaaattctaatcacgacttataaggtcaaactcaactgatgcagctataagtatgaaaagaagaacaaaatctagacaatcaagccgttggatgtttcatagagtggtggatatcctatacaatctaagccaacatagatatttaacctaatcggctgccttccaatgatagatgttagccgattgaaggttagataacgacattgtcgaagattatacagaatatatgataactctacgaattacataaacaagattagagtatcataaagatggaagcactaatcccaagaacgcaagccgccataacaagttttacctctagttgaagatcgaaaccgatgcagctcaacccgaatgcaagaactcatcgaaacaaaacgaaagtaaaaggatggcgatgctccaagattgtattgaacgtgtgttagattgattacatgaggctcggggtctatttatacccgaaattaacaaaatatgtccgtgttggacatgactcttatctctaacaaactctaagataccacaagtctttgcggcagactcttgcccaaacatatctctaaggaaattacatgaaatatcctaattaatagatacaattgccttctcaggactctattcgtgcatggcaatcctcatgaagcacattaactcaacccgacaacatatgctatgtcatattgtcggattcggctcaatcggctaaccttgtcaaactcagactccgccgatcctggtcgtagactagtcggactttagccgattcttgctctgtttgcggaacgatctccatctcggattccgcttcgactttatcaccatctccgatactcagattaccaaatttggttgttaacacatgccccccaagtccagaatatttgataatgtttcgaatttgctttatctatgtctccgagagaatatcacacttgccatttttccgaccattaccgccacgctttaaatactaactgtcatccccgagaaatttcacactgttagttccgttttcaccgcttaagccaactctgtcctctctctctctctctccggcgatcccctcggtgcaaggcgatttcagggcgacttcccctccggccaaatcttctgcccgcagagatgtcgccctccgctaggccattcgtcgtgccatcggccgaatacgcagaggtaagtacccatcggctagatcctcttctttcgcagcatattggttttctcttgcctcatcttgttttcttcttctctgttcttgtttatatctgtaacacttgtccaatctggtagcaattccaagtttgtcgcctgagaatcactattttcttggtccaatcggcaatcttgatcctactgaattcatcatcgtcgaaaccaatagaatccactttagattagccaaccctaatctaagccactggaaaaacaccttcacgtcttggccatctcttgagaaaaccacccctgagaaaagctgggccgtgtggtataagcgtgtatcggctagcaagcaagttcactgcgatgaactcggaattagccaggcgctcgacctcaccatagcaaattcggctaaagatgaacccttgatggcagctgccacctatttctggtccaacaccatcaatgccttcctattcaaccaaaggccgatgacccccaccttgcttgacattaccatgatcaccggtttggatgtgacctcttcagctaaccccatgagtttgaacaccaaaaaccagtttgacttcagaactaagagcataggtggctggtctggttatgtggcagcatatatgggcaaaggacctgtcacttcccgagaacatgtggccttcctgctaatgtggcttgagaaattccttttttgtggatcaagttgtggccctaccaccaactggcagttcttagccaaagcccttgagacaaagaggcaattccctttgggcaaaatccttctcgactatttgtaccaaatgttaaacaacgcatcgactaagattgctgtcggcttagtcgttagcgcaggcaggccatggtggttgctgcaaacttggctaaacttggtagccatgaaagctgtcaatcggccagccgtaacagaagctgaatttccgagattagagccgatcacagatgatgatggagaagagcgcacccatcgcagatgtatgtcctatggggagtatgcctctacactagccgatgctggagcaaagttatcggccgaactactcaaagactggttctgccgtttctatgagggtttccaaagagatgctcgagtctgttcccatacgaggactcaataaacttcgatctcccaggagactttagatttgaagacctcaactctgaaaagtatcaaaaatcaagagaagtcttctcagcggccattagcccatgcatccttcctagtggcatccaccaaggaagaaatatacaagtgtcctatgaattctacgatccgatgagctcagccaggcaatttggaatgggacaactaccaatcggcttgttctttgccgataaaatccaatgccgaggagaggtttcattaaccctgatgatggatcggctactcagcatcccatgacctcctttgcgcagtatcgaaaacatagagttggcaaaattcaggagcagaaacattgaccgatggtggggagaatggaagcaacatatattccatcaatcggcttctatgtatatgacagacttattcccagatgtcattcctcaggtacatcttcactcttatcaattcagttagccgatttgaatcgtgactaacttttctctttaccttgcagacaacataatcctctcctccatacaagagcaacagtggcaaagacatagaatatgctccgggccttttgccaaacggtggcggattaactcctcctatcatcggctaccatgccctcaagacctcaagtctgcttcaagggcagatgagagaaccggccgatgttggcaggaagagaaagaccaaggaactagcactcgatccatcagctctggctcccaagaagaagaccaagaagaataagcctaagccagccgatgacttgcctgccttagatccatccatcgagcaagctttggatgaagaagagactgaagaggatgttgaccaggccgcagccgaagcaagtgatacaagaaaaactccatcggcttcacccaaacgaactcctccaactccttctgcaccacttctcaagcgtaaacatctctccttgattctcttttgcaattattttactcatagccgatcatttataaatcttgtactttgcagaaaaagaaaactgtcgtgaagaagaaattggcagcagcagcatctaaaccagctccaccggtaatatttcttttataacaggatttttaatcataacccatgcggactaacatttgaattttcagcatcctcctcctccttcatctcctgtgcagcaaatgtcaagtgaccgaactccatcggctgcaggaagccataatatcgaggaagaggaacaaccagccgctcctgccatcccagtaagtcttgtctataaaaatctcaaatcggctgaataactcatcttgataatcaattgtcttcaaatttcttcttacaagccttagctgatttgttctcttttgacatcaaggattactttgataaggaagcagaagaagaaaccacaagcacggccctagcccccctggatgaaactgttaagaaaacacttgaagacatataccttcggctagggtcatcattagacagcttagtggcggattgtggttcaatctgggcacgatttgctgaaatccaagccttaatcccggaagatctagcgaacatcattactccagctatatacctcgagcaacatcaattcaagctagagaaggctcagcaacggatagccgatcggcgggagcggaaagtcattgaagctaccatccaagccaatcggcaactcgtgcatgaagagaaagccaagctcgatcaactctctattgggccgattcagtcgaacatagatcggcttgaagcccgcaaaattgatctcatagctcaactcaaagaatgcaatgccgaattggatcttgaaaagcagaagctacccgatcttccaagtgctattgaagaacaaaagtctaggctgaaatcggccattaggaatgttgccgatatgactaagtccttaaaagtcgcccctggaaccgatgcacaagatgcccaagcaattgaagaaatagaacaaatcagacaacaggctgtatcggctatccagcgatacttatctcagtgactatgtaataggatttagaaaaaaatttgtattcggctaagaaattatggtacttcatttgttgcttttgttgctgaactgatgtgccgattaatataacctctcgtttttgctaaaaaaatttgcaacttttgctttgcaacttttacatatatgtgcccccctaattttacaatgacgaaggcattaataaaattataaattgaactaagggcgatataaccatatcggccattgtatatcggcaaaacacaaccgattacaatataaaaacaactaagggtgatataaccatattggccattgtatatcggcaaaacgcaaccgattataataaaaaaacaactaagggcgatataaccatatcggccatctcaaggcgatgtaaacatatcggctatcatgtatcggcaacaccagctgatcatctattaatccaaacacttgggtaatatttcttcaagtatttgccattgagtgctcgtccataaacttcaccatcaagtccttgcaacatataagcccctttggatacaaacttatagatttgaaacggtccttcccaattcggcgaccacttgcaaaatttgttatcttgagtccctgtcggcaaaatcaatttccacacaaggtcaccttccgaaaaggactttggtaccaccttttcgttgtaatgccgagtaattctctccttatctttggtgacttttgcaagggctctcaatctcgattgaaccaagtcttccctctcatcgaccatgagattgtaatattcatcggctgttaactcattttgtaactctatcctccttgagccaatttgaacttcccatggtaaaactgcctcatgtccataaacaagtttataaggaggaacttgaatcgaaccatgacaagccatctgataggaccacaatgcttcgaccaatctagtatgccattgccgaggataatcagaaatctttctcttaataaatttgatcaaactcttgttagacgcctcggcttgcccattagcttgtgcataatatggtgaagaattcaacaatttgatacccatgctatcggcaaactgaacaaactcatcgaacacaaagatcgagccttgatcggttgtaatggtttgaggaataccaaagcgataaataatatgctcttgaacaaatcgaatagcatgcacagaatcaactttcttcaaaggaatcgcttctacccacttggtaaaataatcggttgtcaccaatataaacttatgtccttttgtcgatggtggattaatcataccgatcatatcaattccccaacctctaaatgacctcgacttgatgataggattcatagccgatgcgggtgctctttgaattgctccaaacttttgacaatattgacatcctttgtaatatttgaaacaatcttccaacattgtcggccaaaaatatcctgcccgccgaagcaaccacttcatcttatgagccgattggtgagttccacaaattccttcatgtacctcgcctattgcaaccttagcttgatcaacacttaaacatttaagcaacaccccatcaattttccgataatatagctcatcatccaacaaggtatacttcaaagccttatagcgcaacttccgagaagccaattgagttggattctgcaaataatgatgcacatcgcacctccaatcatcgactgttatcgtggcaatttctattgtgacatccttcatcagcggcttgtaacccgatgccccttgagccaagtcattagcatcaatattttgctctcgagatacatgcttaaaagttaccaaccaaaatcttttcatcaactcccggcacttctaattataaaccatcaatgtatcattcttgcactcatattcccctgccaattgactaatcaccggcaatgaatcacccataatcccaacaacatcggcttcaacttccttaagtaattgcaaccctttgagaaccgcttcatactcagcctgattattagttgcatagggcttgatagtatatgcaaactcaaaacttgtcccccgaggagaaattataaccaggccgataccacaaccatgagtgcatactgacccatcaaaaaacaaagtccagggcacaatctcaaacgagccgattgagtcatcacgatgatcaacaataaaatcggctatagcttgccccttaatcgccttcggtgactcataccgaagatcaaattctgtcaaagtaaatatccactttccattctttcctttcaaaatcggagctgataacatgtacttgaccacatcggctttgcatattacagtgcattcattggataatagataatgccttaaccttgtacaagaaaaataaaagcacaaacacaacttttcctcaggagaataccttgtctctgcatccaaaagccgacgactcaaatagaacacaactctttcttttccctcgagcttctgaatcaagaccaagccgattgacttctcaccggccaatagatataacctaaaaggtatccctttttgtggaggaatcaaaactggaggagagctaagatattctttaatattatccaaggccttctgctattctgccccccaagtaaatttctgatcggctttcaatctcaacagcggtgaaaaaggttctaatcctccagacaaattagagataaaccctctaacaaaatttatcttgccgatcatctcctgcaattctgtcttgtcctccggaggttgaatctttctgatcgcattaacactcctctgagttatctcaatccccctttcatgaacaagaaatcctaaaaattggctagccgatacgccaaaagcacactttgtcggattcatcttcaggccatacttcctagttctctcaaaaaccttcctcaaattggctatgtggtcctctatttcctttgacttaacaactacatcatcaatatagacttcaaccagccagccgattagatcatgatatatgtagttcatagcccgttgatatgtagctccagcgcttttcaagctgaaagtcatcacaacccactcaaacaagctgattgcaccaagacatctaaaagcggtcttatgaatgtcttcttctgtcataaagatctgattagaaccagcattaccatccacaaaactcaatatcttatgccctgaagcagcatcaaccaattgatcggcaactggcattgggtactcatcctttggtgtagccttgtttaagtctcgaaaatcaatgcacaccctaactttgccatttttcttgataattggaactatgttggaaacccactcagcatatcggcaaggacgaataaaaccagcatcatacaaatgtttaacctcagccttaacgggttcgatcatatcggctttgcatcttctcggcggctgctggtatggtctaacccccggtttgataggtagccgatgttcaacaatcgatcggctgagtcctggcatctcataatactcccaaggaaagcaatctctatattcttttaaaagctctatcaacttggttctaaattctggagataaattcttactgataaatgtcggccttggtctatcactcggacctatatcaacttcctccaaatcatcggccgacatgaacccctgtccctgcttgtcatcgagatcatctactgtgttgttggtgtaaatgtttgaaccctccacgacgccctcaaaataataatttggctctccatcttcaatcggctgtatatcataatcgaacacttttagaaaatctccatcccaaacttttccagacaagcaatcaatactgtccatctcccaaagagctaaatcggcactggcaacgttatctgacctgtcggctggcacaatttcaatcttgtcgccttgccattgaatcaagcattgatgcatggtcagcggaatacaacagttggcatgaaatcaatctcttccaagcaacaagctataggaaccctttccaccgatgagaaagaatgttgtagggacggttttactaccgactgtcagctccacatttaaaactccttttgtttccgatgaattgccaccaaaatctttgagaaccatgtttgtcttgatgagatcttcagtatttctacccagctttctgaatatagcatatggcatcaaattcacggcagccccaccatcaaccatcatcttggacatcggcttcccattgacatagccgttaatgtacaatggcttaagatgccgattctctgtcccttctagcttctcaaaaaccgcttgctctggtgacaaaaccaacctagccgaagcttcctcaacttcatcaacatcagcttgtttagctctgaattccgcaggcaacatgaaaaccatgttaaccaatgcggtcacaacactcttccccttagccaacattttttgcttcatcggctttggcatcatcggctatagcagcttggtaattgacacgccactcttgcctcggctttgtcttcttcagccgatgattaatctcttgctccacttcacgaaaacgttctctgttcctcaatctttgaaccattctcttctgattctttgtaaaaataccagaaggacaccattgagtttttctgccctcctcaacatcttgatcatgatcttgatttactgggtccaatctttgatgaataggaactcttgtctgcctcaaccgattgcttctattgtgagatcggcttgaacattctgcaatgtcactgcattcaggacaatcttcgatagatggcagcctcataccttctttccagcaaaatctgaaaaactcacagtcctaatgaggatcaaaacctccatcatcttcttcataatacctcccttgttgctgcttgtcatatttcctctaatacttgttaataattctagccgaattcatctaaaaacttttagtcctgcttccatcggctgttctacctgctgtatgtaccatattgaccaggaaagggttaccatcgaccttcatcggcttctttgagtcatcaaatttaatctttccaccttcaatggccacctggatttgctgtctaaaaactttgcagtcattagtagaatgagaaccagagttatgccatttgcaatacctccttttgcctagttcctcagccgatggtataatatgaccagcaggaagttgaatttgcttctcccgaagtaacaaatcgaagatcttgtcagctttggtgatatcaaaatcaaacctttctttttttccagaactcttcacccatgggcatggcacaacctttttgctcctaacccattcggctgctgctacttcggagtcatcatcatcatcatagcaacctgttcctgagtcatcattgacattttgtccagcatgttgtggttgctctctagtcaacaagcgaggattggtcagttgccttgatgccgatgatggtgcagcaggtgcaggagctgatactggtgctgtcggctaagctggtggtacactggaaacattcggctgattatttgtgatcaggggccgataatttgggaaaacaccccttggtaaatatactggtcctgtaacctgatactcagccattgaaccatcaaccaatgtgtcacgaccccaaataaataaataaatatatatatatatatatatatatatatatatatatatatattccgtgacagtctgtcatatccttatacgcatatatactaatatttatatatgtccataaggatgcaaggcaagatgcaatgtctaaccatcacaactgaagcttggacatctacaacagtggttccgtttattattattactttttttccaccagctttactgcatattacatcggttggttcactgaccaacttattgtcaccaggacgaaaccctatacctagcatgcaagtatgtcctctggatatctctaaagactaagtagaccacactccccactagttctgcatgtcatcattcccctctgacatctcatcttgactagtttctgcgcacatcaaatagtaataataatatatgagtatgttatacatactcagcaagattagtacatatagcaatatatatatgtttttaaagacagaagaaaaatactactacccatagatattaacagccaataaataataaaggacattaaacatagtaaatgagttaagaatacactggagaggtattaaaataatcgtcataatctcgttccttcaatccattttttccccaattagtgataccctcatctgagaatcacgccgccggattccctacttgtgtgaggcattcatcatctcacactgatatcagctgacccgatatcgttatttcaggtatcggatttcaggtatcggccgtctcaggctaagtatcataatcacgttattattctcactgataaaatcatcaatccattattcgagtgttaataatgtttattgttagattattagtacaccatctcaatataatgtaggtaaacaaattcagttagaggtgattaagtaaaatagttgacgggcgtagtcttgccttgtcttctgttgttcttcctctgcgtcccacctaatcaaatatacaggtcttcggtattaatttatatctatatttgtcatgcaggacattagctactgacatcagctactagcaccatagatagctggttgatgtgactatactagagaaagaaaaccaacatggagtagtgtgtaggtgcttgcatgcatctattcgagtgggcagtactgcatgcatgcacgcatatagcatatagtacagctgcttgctagtaacttctagtctctgtactagccacaacaagtattaacctttcacactaatatatctacctcctgctccatttagtagtactggcggaaccaggactaaaatacagatggggcgaaaaatactaacacgataaagacatatgaacgcaacacatactatattatgatgcaattgtaaaaaaaataatataattctacaattaacaagtaaggcataaatgacatgagtagtgaccacgcatcaattaagcgagtttgtcatgtggttgttttagcatcgtcgttaaactagtgtcacattagtggtgcccataaccctctagacctaagagtaagataaccctcaaaatctaattacaaacaaccgtgtggctagatatgggtaccaatgctagttgctcaatatttattccagaattccaaatcttgatattttgtaagctagataaaaactgtcctcacagttgcaactataatatttaaaacattgaataaaaatagaaataaaagaatatattatatatctacagaaaattatctacaacttttgtgtttttgagaacaatttaattagggactacttttgaattacccttgcaacaaggaacatcaattcgagacgaatttccaccttttcttccctactcttctttggaaccgataaaaaatgtcctgacagttgtcttctattctcctcttgtcttccttgctacagatcagaaacagacgtgcattagcggccaagacgccaagcaacgtagcagcaacagcaagcggggaacagttcttcctcctcctttgttggtggttgcagcgtgcagcgtggtggctagcagaggctccatgctgcccgccagccggttccctccggctccaggctggctggaggcacgccgccacaatgggctggcctggccggatgggaagcgcggctggtgggctaaggcaaacagggcggcggcggcacgcacgggacgatgacgactttgtggcgatgcggcatgaactagcaaagaaagaatgaagatgaacaggtcgccgattggaatacgatgcatcgctatttccgtgattggttgatttcttcggtgcacctgcgcctgatcggtttttgggtatctggaggcccaagggggggtggggcgacgtgggccattactgggccggtcgcccaaccccgcctaatgggtggttctgcccctgtttagtacacaggatcatgaaaagcaccctaaaaatatggtaagtgtagcagcctactagtaccacaagaaaattttgctaatatagctagcttacttcttgctaggtctgaaaactattaaaatgtaaccatacacttacctgcttgctctgtgcagccctgtgctcacgctggcttctatggtgcaagtagtattcctaggctttgggaggcttttatagcagcagcttccttcaagtctaaggagacacctacccagataggagagtgatggatagctttcatctcctagacatttatctgctcattttttttaactggtccctacgatcctatccactggtacatgtttatcctatcccctttgatcattaaaatatacaaccctccccactctctttctatctctatctttctcacacttttaagttcacaaaataataataataataataataataataataataattattattattattattattagtactactactacacaatgaattcaccatgtttgacaaggtattgactagcactccagattgattaatcaaagtatgttgcacggcgtagtcaatccgatcttggaagttgttaaactgtggttgtactacattgccatctggtccaagatcttcaacttgtaccccctgaaaactgtcacctttatctcccgagccctctagaatgcctttactacctgattcagctgtagcagccggaacttgttgtaattctccatcgatccttagaagaacctgttccaggaacatcagcaactaattttaccttatacttctgaacaactgttcccttacgggtctccatgaaagaattcaagaactggtgttgtgtttgctgcatcatcagatcgagctccttcttttgttccggtgttaatttgtctgtagtgacgggaacaatgtttccctcatgaacttcaaacccactaggctttgggctattagtcttgggagggacctccgtgagagaacgttgttgcaactcggtcccactgggcatgccaaaagagtgttgatgtaaaaacacgagggctgggagatctgcttagctccagtgcaggtccaaaagcttgcctttaggttcgtaagagtgccagttgatttgatcctgcaatcaacaagaaataaagacaacgaaaccattgttaaatccataaatgatagccgatcggctagttgccgatgacatatcatttatcttttagccgatgtcatgtttgaatcgattggcatatataaataagtaagaagggactaaatctactcaatcggctgtagatattgataatatataatctctatgtcgatatatgtcacaccctaaaaatcctaaatatataaattgttgtttaattggaattattagaatttattttaaaagtctagaaaagaagatctaattttaaataataaattccaatataaaatggggccagataaaatttcattaaatactttgcttaattctataattcctagatttttctgggatttatttgagctaaggaagtatttttaataaatggaattgcatttcctgaataatttaaattgaaaaaggtttttaaaatcctcttttggctttgggccgaaagtcggcccaaaaccttctctctctctctccgtcggcccagtcggcccagtcagcccgcagctgcccgtgcgagcgccctcggccgctgacaggtgggtcccacctgtcggactcgtcgtcctcctcgcgccgtcgcccggccggaaccctagccgagccgcgccgccgtctccttccaaattcgctcgcgcctttccttctccggtgtaatcaattgaggggaaatgtttcccgagatctcctctaccttttctcttttggaatcgtcggctaaatcgtttggaaatccgtggattcgagttcgattcggatcgatctctctcctccgaaccctaaacattccttcgcgtcgcaggtcgccgggggccttcgccgccgcctccttgcccctataaaaggacccccaagcccgccggtacctgccgacacccccgccttcgcctctcgccgcccgtagcgccctagccccgtgtagcctagcgccgccgtcgtcgccgttcgtccagccatgcgccggcggcgatcccgttgtcgtcgtcgctcgggaaagtcaccgtcgtggtcgccgtcgcgtcgccgtcctcgtacgcccctccatcgctgctgtagaccatcggagcaccgccgtcgtcgtcaagccgaaggttgccgccgcttctttcctcatcgctgtcgccgtccggtgatctttcgccgccgctttggtcaccggtgagtttgccgtgccgtccgctacccgtaggtgctctccgttcgcgctgtcgtgccgtcgttcgccggcgagcatgcacgcccgagcccccgccggtggtgacgtcaccgctgacgtcatcgtcatcgtctcccgtggtccggccgtggaccggtcgatctcggccgttcgttttggatggaaagatctcggtcgttcgttttcgtgagccgccgccgtgcacccggttcaccgcgaaccctagccgctgacgcaataattaccttttccttttcaaaaataattcattattgcgtcataattcaattaaaatctaaataaatgatttaatccgatttaatctttgaaaattcataactaattcatcttagctcagatttagttggttcaagtctctaaatttttctaaaattgagatctacatgttaaaaatatccacatgtactgttcatgcttgtttatgtgctgttttggtgattttgctcctttctatttagattccgacgtttccggagagtccgtttttacaggagaagaatttgaagagttccaaggccagcaaggcaagtcacacagatcccaaacaaccctttgagcatattgatcccatttaaagctattgtttctattcaactattgcatttattttcgaatgtcattgggtcgaattaacctattgtttgttatagcccttttgttcttgattactttattccttgataccttgggttattataacttgactagttgggctatttatattggttcagctagatattagatatgattgcttagccatgcttagaaacattagcacattattgggataacttatgacttactattatttaatgttggcttaatgatagttcacgatggtccatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattacggagcaccagactgagaagtggcggagataagcccacgggggtcactggggagtccatgccttgtttataagggggtgattatgatccaggaaaggtgcgctgtggtggattgtgttgtgcgaggggtactgtcacagctcctttccgaggtaccgtggtggtattgaggcacatgtcgacatgttgtggggctgtgtcttgtgggtacagtggtacacctctggccagagtaaaactattcgaatagccatgcccgtggttatgggcgggtctaacaatgtctttcgtgattagtttcacacttctcatcataataaaagatgttataactggtaataatttgattagctcctggtttggaatggtatattcctggtttggagatagatccgtacagccgggtatggttgttcgggatggttgggcctgagcagcatgggtgtgctgtttagtgttgattaaaattgatgattaattactctaatgttttataatcctcaaatgtttgctaaatgctgcttttgcaaatgagccctatattatgccattctttgatatccttgtgcacttgcatatttgctgcgtggcttgctgagtatgtcatatactcaccttgcaatcattcatcagaggaagagttctacagtgatgctgatggtgtggaggattaggtgtagccctggtcaagctgcctatggagtggagtcgtctgcgccatttatcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatagcacatgcacttcataatctcttttagtggttctcattcaaaatttattccagtgttgttagtactgtacatctaatactgtactaatggctcatttaccagcaaatgttttacaacattgttttattttgctgcaatgaaataaatttagcatgttgattttataactttcttttatttcttttggaacctgttgttcaaaagtacaaaatttgtgaccttgtttccaactgtttcaacttatcttgcaagcttggtttactttatttgcttaccttttactttgattttctaactttattcaaattaatccaaaaacttgtgctattaattggataaatgtcttaactccctcctttcacttgtctttagatgccgcgctacaagcctaaatacttgtttggtgttgagggatttgtccaggagttgcgtacgatgtcctttgccataggatttgggactgcccctttgtatgcccagattcctcatgatcgtcacgaagagaagtgccgagtcaaagtcaccttgaacagtaatagtgaagatatcccatcagtgatgttcgaagctggagaaggaaactacatccatgcatgtcaggaggtggcaaggatcgccataggagagctccgcgatcgctacagtgatcagttggccgacactgagtatcgctaccatcctcgccaaccccagggaagtaaccatggcagctaccttgagactgaggggattgagaatgatgctaccacaaggcatttggttgagatgctgtgggctatggatgaaacccgtgcggaggttgtgctagcagctcaagatcgtgaagactggaatcgtggtaagatttgcaggctagaggacaaggtggatcgtttggagaaggaactagccgcgttgaagggagaagaaccaccgcagaaggccaggattcgtcttaccgcaaggaagagagctctatttgtccctcgctaccaattggcgccaaaggtccgtgtggtggagaaagaagttaccccagccctagcggatcctccggtcgtcaatgtaagtgatgatgaaggagaagaatcgaagcacacccattcaaaggtcgagtggggagctactcaagatgatggagacgagccgaacgagccttcaatcaacttcgatgcccggaagacctagagtgccttgttaagccgttgtattagatcgttgtgttagtttgttcgtttaagtttggttgtgtgtgtctcacatgtgatttacatcagtggtgggatgtaagtgcatgcgtttgtttgcttttgagtgttaggaagttggtgagtttagtggtgtgagagtcttcagttttgtaataatgaaactcagttaagatcagtaaaagttaagttagtagaaaaattaattctctgtcctaagtagttttccccggtttctcttcttgtgatcctgcccatgccagatggtgcacactcgcagcaacgggaatggccccaacaacaacaataacaacaacaacaatggagagaatcccacacttgcccaagtcctggctcaacaggcacagcttatgaacatgatgatgcagcaactccagaaccaacagaaccagggaaataaccatgcacctccccagaacaagttagcagaatttcttcgtgtgaggccgcccactttctctagaaccactaatcctgttgaagctagcgattggctgcatgccatagagaagaagttggatttgcttcagtgcactgatcaggagaaggtctcatttgcatcacatcagctgcatggccctgcctctgagtggtgggatcacttccgccttaacagaacttctgctgaacctatcacttggcttgaattcaccgctgctttccggaagacgcatataccatcgggagtggtgtctctcaaaaagtaggaattcaggtcgctcacctagggatcttgcacggtcaccgagtatctgcacgagttcaaccgtctggcttgttatgctccgaaagatgtgcgcactgatgaagagcgccaggagaggttcttggaaggacttaatgatgagctttcttacccactcatgactagggattatcatgatttccagaagttagtggataaggctattcgccaggaggacaagtacaaccgcatggagtagaagaaacgccggattgctcacttcaaggcacaacaggggaatagtcagaggccgcgtcttactttaggaccccagtccatgccacagggaggttcttcgtctgttgttcgtccgcagcgtcagttcttcaacaacaatgctggcaacaacatccgcaatcaagctccacgccctgttgcagctccaacacagcaacagcctgccaagagggagcaaggtagcaagcccggggtgtgcttcaactgtggagacccaggacattactctgacaagtgtccgaagccccgacgcgtgaaggttgtccctgcccagagcaactctaccacaccagcatcaaaggcccgtgtcaatcatgttgctgctgcagaagctcaaggtgctccagatgtgattttgggtacgttccttgtcaactcagttcctgcaacagtgcttttcgattctggtgctacacattcatttttatctatgagttttgcgggaaatcatgggatggaagtagaagatcttagacgtcctttgatggttagtaccccaagtaatcaagcactctctttgcaacgtagcccctctgtcagaatagaaattcaagaagtaccatttctagccaatcttatcctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtctttaaggtcaagactgaaccaaatgactttggaagagattcctatagtccgggagtatcccgatgtgttcccagacaatttacctggtatgccgcctaaaagggatatagagttcagaatagatttggtaccaggaacaactccgatccataagagaccttatataatggcggccaatgaattagcagtagtcaagagacaagtagatgatttgcttcagaaaggatacatcagaccgagttcatctccatggggagctccggttatttttgtggaaaagaaagatcatacccagaggatgtgtgtggactatcgtgcactaaatgatgtgactatcaagaataagtacccgctgcccagaattgatgatttgtttgatcagcttaaaggtgccactgttttctccaagatagatcttcgatcagggtatcaccagttaagaatcaaagaggaagatatacctaagacagcttttaccactaggtatgggttgtttgaatgtactgttatgtcttttggacttaccaattaccccgctttcttcatgaacttgatgaataaggtgtttatggaatatctagacaagttcgtggtggtctttattgatgacattcttatctactctcgaacaaaagaagagcatgaagaacatcttcaccttgcactagagaagctacgagaacatcaactgtatgccaagtttagcaaatgtgaattttggttgtctgaagtgaagttccttggtcatgtcatctcagccggaggagttgccgttgatcctagtaatgtggaatccgtaatcaactggaaacaaccaaagacagtttcagaggttcacagtttcctaggcctcgcaggatattatcggaggtttatagagaatttttccaagattgctaagcccatgacacgattacttcaaaaggatgtaaagtacaagtggtcagaagaatgtgagcagagttttcaagagttgaagaatcgcttaatatcagctcctattttgattttgccttatccaaagaagggttttcaagtgtattgtgatgcatccaagcttgggttaggttgtgttctgatgcaagatgggaaggtggttgcctatgcatctcgtcagttacgtccgcatgagaagaactaccctactcatgatcttgagttagctgcagtggttcatgcgttgaagatttggcgtcattatcttttcggtactcgtacaaaggtatacactgatcacaagagtttaaagtacatctttactcagccagatctgaacatgagacaacggagatggttggaattaattaaggattatgacgtgggaattcattatcacccgggaaaggctaatgttgtagcagatgctcttagcaggaaaggctattgcaatgctacggaaggacgacagctgccattggagttatgcaaggaatttgaaagattaaatttgggaattgtcagtagaggtttcgttgtagccttagaagcaaagcccactctaattgatcaagttagagaagcccaaattaatgatcctgatattcatgaaatcaagaagaatatgagaagaggaaaagctatcggtttcttggaagatgagcaaggaactgtatggttgggcaagagaatctgcgtccccgacaacaaagatttaaaagatgcaattctgaaagaagctcatgatactttatactccattcaccctggtagtaccaagatgtaccaggatctcaaggaaagattttggtgggcaagtatgaagcgtgaaatcgcagaatacatagcagtatgtgatgtttgtcagcgagtcaaggcagaacatcagaaacccgcaggtttgttgcagcctttgaagattcctgaatggaagtgggaggaaatcggtatggatttaatcactggtctacctagaacgtcattaggccatgactctatttgggtgatagacgacagacttaccaaagtggctcatttcatcccagtaaagacaacctattccggaagtcggttggcggaattgtatatggcaaggattgtgtgtttgcaccgcgtccctaagaaaatagtgtctgatcgaggcagtcagtttacttcaaagttttggaagaagcttcaggaagagatgggttctaagctgaactttagtactgcttatcatccgcagacagacggacaaaccgaaagggtaaaccagattttggaagacatgttgagagcttgtgctttagacttcggtggaagttgggataagaatttgccttacgccgaattctcgtacaacaacagttatcaagctagtcttcagatggctccttacgaagcactgtatggtcggaagtgccgcactctgcttttgtgggatcaaacgggagaacgtcaggttttcgggacggatatcctaagggaagcagaagaaaaggtgaaaatcattcaagaaagattgtgcgtggcccagtctcgtcataagagttatgccgacaatcgtcgtagagatctaagttttgacgaaggagattatgtgtactttcgtggcacgcctcttcgaggagttcatcgttttcacaccaaaggaaaattggcaccacgttttgtgggaccttataagattgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccagaaattgagttatccgtttttgtaaagttcaatggagtaatcactcggaagaagaatcaacttgggaacgagaagatgaattgaagtcagctcatccgcatctgttcgccagttcttccaaatctcgaggacgagattctgtttaaggggggtaggtttgtcacaccctaaaaatcctaaatatataaattgtttgtcgtcgctcgggaaagtcaccgtcgtggtcgccgtcgcgtcgccgtcctcgtccgcccctccatcgctgctgtagaccgccggagcaccgccgtcgtcgtcaagctgaaggttgccgccgcttcttcctcatcgctgtcgccgtccgttgatcttccgccgccgctttggtcaccggtgagttcgccgtgccgtccgctacccgtaggtgctctccgttcgcgctgtcgagcatgcacgcccgagccgccgccggtggtgacgtcaccgctgacgtcatcgtcgtcgtctcccgtggtccggccgtggaccggtcgatctcggccattcgttttgaatggaaagatctcggtcgttagttttcgtgagccgccgccgtgcacccggttcaccgcgaaccctagccgctgacacaataattcccttttccttttcaaaaataattcattattgcgtcataattcaattaaaatctaaataaatgatttaatcccatttaatctttgaaaattcataactaattcatcttagctcggatttagttggttcaagtctctaaatttttctaaaattgagatctacatgttaaaaatatccacatgtactgttcatgcttttttatgtgctgttttggtgattttgcacctttctgtttagattccgacgtttccggagagtccgtttttacaggagaagaatttgaagagttccaaggccagcaaggcaagtcacacagatcccaaacaaccctttgagcatgttgatcctgtttaaagctattgtttctattcaactattgcatttattttcgaatgtcattgggtggaattaacctattgtttgttatagcccttttgttcttgattactttattccttgataccttgggttattataacttgactagttggactatatatattggttcagctagatattagatatgattgcttagccatgcttagaaacattagcacattattgggataacttatgactcactattatttaatgttggcttaatgatagttcacgatggtcaatcgtgattggttaattaattacttgccaactaaaacttgataatggtgggttgtgagcacatggttttgagagtcgtgctcatgaaaattaaggaccggttcacgagtttcggttgtgaaacattaaccgtgccaaccacaatccagcgtgggcaacggctttaccttttgtatagcatggttcattgcggagcaccagactgagaagtggcggagataagcccacgggggttgctggggagtccatgccttgtttataagggggtgattattatccaggaaaggtgcgctgtgatggattgtgttgtgcgaggggtactgtcacagctcctttccgaggtaccgtggtggtattgaggcacatggtgacatgttgtggggctgtgtcttgtgggtacagtggtatacctctggccagagtaaaactattcgaatagccgtgcccgcggttatgggcaggtctaacaatgtctttcgtgattagtttcacacttctcatcataataaaagatgatataactggtaataatttgattagctactggtttggaatggtatattcctggtttggagatagatctgtacagccgggtatggttgttcgagatggttgggcctgagcagcatgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgttatatactcaccttgcaatcattcatcagaggaagagttctacagtgatgctgatggtgtggagtattaggtgtagccctggtcaagctgcctgtggagtggagtcgtctgcgccgtttatcttatttttttccgctgcttagatctttattgattgagaggaactatctacctctgtaatgacattttattcgcttatttattagagtaataattgtactctattatcaacttgttattgtgtgcctcggatgattcctggacgagggttcacacacatgtaagcatttggaattttggatagaaattccgggcgtgacaatatatacttaaatcaagtgattgggatagatcggatgccatgccgagacagcataaatcacttagatcgaagtatatattaacaacaagattatagatgttcatagcattgccgatcagatagatctagcacgtatcggctaatactccgataccactctatattaagatattaaagcaagtaaaatatatcaaacagaagcctaatataatttgttgtaataagatcttaatataaagggcagatctagcatgtcaattaagcgcatgagataataaggctaaatcaggtaagatcggctaaaaccccgatactaccctaatcgacaaccaaaagcaggctggagattgaaattctaatcacgacctataaggtcaaactcaactgatgcagctataagtataagtatgaaaagaagaacaaaatctagacaatcaagccgttggatgtttcatagagtggtggatatcctatacaatctaagccaacatagatatttaacctaatcggctgccttctaatgatagatcttagccgattgaaggttagataacgatattgtcgtagattatacagaatatatgataactcgatgaattacataatcaagattagagtatcataaagatggaagcactaatcccgagaacgcaagccgccataacaagttttacctctagttgaagatcaaaaccgatgcagctcaacccgaaagcaagaactcgtcaaaacaaaacgaaagtaaaagggtggcgatgcgccaagattgtattgaacgtatgttagattgattacatgaggctcggggtctatttatacccgagatttagaaaatatgtccatgtcggacacgacttttatctctaacaaactctaagataccataagtctctacagcagactcttgcccaaacatatctctaagaaaattacatgaaatatcctaattaatagatacaattgccttcttaggactctatccgtgcgtggcaatcctcatgaagcacattaactcaacctgacaacgtatgctatgtcatattgtcggattcggctcaatcggctaaccttgtccaactcagactccgccgatcctggtcgcagccgatctccatctcggattctgcttcgactttatcactgtcacgctaggaatttctatccacaattccaaacgcttacatgtgcgttaaatcctcatccaggaatcagccgaggcacacaataacaaattgataaaagagtactatcaaactactgattaatattcgcaaaatattaaattattacaggggtggatagttcctctcaaaagaataaaattctacgtagtggaaaaataaacaaaagactaaatagctatggcgactccactccacaagcaacttgacccgaacaaagcctaatcctcctgatcatcaccttcactgaagtactcctcctctgatgaatgaatattgcaagaatgagtatatgacatactcaacaagccacacagcaaatacgcaagtgcacaggatagcaaacgatggcataataaagctcatttgcataaacaacatttaataaacatttgagagaatagtaaaacagttaagtaattaagcaatattaaataaacactatacaacacacccgtgttgcataggtgcaacctcatctgaacaaccaaccccggttgtacaaaccaaacctccgtaccaggaatataccattccaaaccaggagtcaatttaattatcacaggttatcaccaataatgagtaatgtgagactaatcacgaaaaaacattgttagacccgcccataaccgcgggcacgactattcgaatagttatactctggccagagatgtactactgtacccaaaagacacaacttcacaacacgtcaccgggcgccttaataccttcatggtacctcggaaaggaactgtgacagtaccccttgcaaaacacaacttaccacagtgcaccatacctggatcaaaatcaccctctttacaacccagagcatggactccccaatgaccttcacagactttttggcgcttctcaatctggcaccccggaat

SEQ ID NO: 29882 - DNA, 3181 bp, Oryza sativa
  unsure (1)..(3181): unsure at all n locations
gtggtaaatttgtatttcctcttnnnnnnnnnnnnnnnnnnnnnnnnnnnnnnnnnnnncaggttttaattatcaaataattatcataacacgattaaccatcgtgagctaccattaaatctaaccataagtaataatgtaatatgattcatcccattaatgagctaatgtttctaagcatggctaagcaattatgtatatagcatttagctgaaccaaaccaatatataaggttcaagctaatcaatttattacccataggaaaataaagtcatcttcagccattaattaattaggaaaggctcaccacccaatgacattcaaaattaatgcataagttgaaataaaacattagctttaaaaaggttcaacatgctcaaaaggttgtttgggatctatgtgacttgccttgagcttcttcaaacgcttctgaaccttcctcaacgtaaacgctctcctccggaacgtcggaaactatagcaaatgaacaaaatcaacaaaatagtacaaaaacaagcataaacagtacatgtggatatttttaacatgtagatctcgatttaagatgaatttagcaacttgaaccacttgaatccaagttacgatgatttagttatgaatttccgaagtttaatcacattttcatccaatacagaaaattagtacgatttatataaaagatttatgatgtcatcacgacatcatcgccggccatggcactggaccacaaggttaccagcgctacagagctcggttgggctttccgaagacaccaacacgaagaggacgacgacgcgaactcaccgaagcaaagaactacgacaaacgacgactgacgacgaggtccgacggcggctcggctcgggtcaacgtcggcgacggcgctccggcgagatgcagcaacggcgaaggggcggacgggatgctcctccacctggcgaactcgacggtggtgacggaaggcggcggcgacgaccacagcagcggcgcggcgcggctgaagcagcgacggcgacggcgacgctagggctcacgtggtggcggcgctacaggcgacggctgcggcttggacttgaggcaaacggaagaggacatctaggggatgctatttataggctccgaataaagagatcaaactcggaacgaatggaatcgaaaccggaaaatgcgatggttagtttggagagataaactcgaaacgagttagattcggttgaaatacgaggaattaaactccgttttttgaaggaaacgaaagaggacaatgaggagataaattcccctcatccaatcggactcgcgagcaactgatggaggcggattcaaaggggaggcggcagaagaacagtgccgagggaggcattttagactttcagagaaaaggaaaagaaaggaatggagcagcaggctggcatggctggcagcccaagagaggctttgtgggccaaaatgaccaacggcctagagaaaggttttaaaacttttccttctttgaataattcgtgaaatgctatttcgttgattaaaaatacttcccttactcaaataattcctagaaaaatctagaaaatagataatcaaacaaagtatttaatgaaattttatctaactcagttttatgttgcgatttttcctagattattagagtttaacttgtaagcttttaaaataatttctaaaaatgcattaaagaatgaattattaaattaggcgattttccgggcgtgacaaacctacccccttaaaatgaatctcgtcctcgagattgagaggaactagcaaaaagttgagtatgagctgacttcaattcatcttctcgctcccaagtggcttcttcttctgaatgattgctccactgaaccttgcagaaccgtatgacgtgattcctggtgtttctctcattcacctccaaaattctgactggcttctcaacataagttaaatcttcttgaagctctatacgctcaggatctgtttcctccgtaggtacacgcaaatatttcttcaactgcgacacatggaacacgtcatgtattcctgccattgacggagacgactctagttgataagctacttcacctctccgactcacaatcttaaaaggtcccacaaatcacgatgctaatttccgtttggtctgaaaacgatgaactccccacagcggtgtaacccgtaggtatacataatccccttcttcgaaattcaaatccctacaacgattgtctacatagctcttctgacgcgactgggcagtacgcaacctttcttggataatcttcactttttcctctgcctctcgcaatatatctgtcccaaaaacttgacgctcactggtttgatcccaaaggagcggtgtacgacacttccgaccatacaatgcttcatatgaagccatttgaagactagcttgataaccattgttataagagaattcagcgtacggcagattcttatcctaacttccactgaaatatagaacacaggctctcaacatgtcttctaaaatttgattcactctttctgtctgaccatcagtttgagggtgataagcagtactgaaattcaaacgagtacccatctcttcttgtagtttctgccaaaactttgaagtaaactgactacctctgtctgacactattttccttggaacaccatgtaaacatacaactcttgccatatataactctgcaagcttatttcccgagtaggttgttttgacaggtatgaaatgagcaactttagtaagtctgtcaactactacccaaatagaatgatgtcctgccgacgttctgggtagaccagtgataaaatccattcctatttcctcccatttcaactgtggaatcttcaacggttgcagcagaccagctggcttctcatgctccgccttaactcgttgacacacatcacatagagccacatattccgctatttctcgtcgcatgctggcccaccagaattgttgctttaggtcttgatacatcttagtgctccctggatgaatggaatacaatgtttcatgagcttctttcatgatagtatcctcatctccttattgttgggcacgcaaattctatctcctagccacccagttccttgctcatcttctatataatcgatnnnnnnnnnnnnnnnnnnnnnnnnnnnnnnnnnnnnnnnnnnttatctattnnaagccacg

SEQ ID NO: 29883 - DNA, 21372 bp, Oryza sativa
  unsure (1)..(21372): unsure at all n locations
cgcgggcattgaattgctaatcctnnnnnnnnnnnnnnnnnnnnnnnnnnnnnnnnnnnnnntgtttctaatactatatgtagatgacatattattgattgggaacgatattcctatgcttgaattcgttaagacatcgttgaaaaatagtttttaatgaaggacttaggggaagcagcatatattctaggcataagaatctatagagatagatcaaagaggctaattggattaaggcagagtacatacattgacaaggtgttgaagaggttcaacatgcaagattctaagaaaggtttcttaccgatgtcacatgacattaatcttggcaagaatcagtgttctcaaacgactgatgagcgaaacaagatgagtgtgattccatatgcctcggcaatcggatccatcatgtatgctatgctatgtacacgtccagatgtttcatacgcacttagtgcaacaagccgataccaatcagatccaggtgagactcactggatagctgtaaagaatatccttaagtacttgataagaactaaggatatgttcctagtctatggaggacaggaagagctcgttgtaaatgattacaccgacgcaagctttcaaaccgacaaagatgattttagatcgcagtctggatttgtgttctgcctgaatggaagcgctgtgagttggaagagtcccaagcaagatacattggctaattctacaacaaaaaccgaatacattgccgcttctgaagcagcaaaagaggctgtttggataaaaaaattcgtttctcaactaggtgtgatgactagtacttctagccctatggacctctattgcgataatagtggtgccattgcacaagccaaggagcctagatcgcatcaaaagtccacacattttatggcggtatcacctcattcacgagatagtgagtagaggatatgtgaagatatgcaaaatacatccggatttgaatgttgcagatccgttgacaaaggcactccctcagcctaagcatgaggcacacactagggcaataggtataagatacattcatgattgactctagtgcaagtgggagactgttagtgatatgccctagaggcaatcatagagataattgtatcacatactatgtttaaatatttatccgacattgttccttgaaatagataactccttattggttaatgaatatgtgattctttcatcagactctttatttgtttgtaactatttctaaaggatccctgatccaatatcatatgtagaacaaatatgtttatatgatcagaacatgtattaattgatgatcatgtctcatggatcatggtatagagatactaaattaataatctggacacatgttggtgaacatgttgttcgatagacccaacatgagacactgcaagagctatatgtgttgtgtcatcagtgatcttatttagtgttggtgttgaatccttagacttgagattatcatggttctcaacatgtgtagtagcttacttacggactactaaactctactatgtaaatgggtagctataaaagtagttttcgggtatgctatgaaacatgtagtgggatataaataaccaagatgggatttccccctcctatggagagatatctctgggcccctggatgttgtagattatggaagtgcatgaccatgccaaaggtgattgaggagtcaatcacaagttatataatctatcaacaggttcgagtgaatgattgagctattagaggatggcacatatctagccttgagcttagtcgatatcgtgaggcaccgggttcatacaagtatacagtagaggtttagccgatatgatctttatgtatgcgtagtgggtcaatacgttctgctaggggccgctgttgatgcgtggaccgaaaaggagttttcgggttacagccgagtatatatgaacctacagggtcgcacgcttaatgggcctgaataaggggattggatagagatccaatatgagcttaatttggatagggatccgaatcggagtcttacggcccctgaagggctcgagtgatggatcctatatatttgtgaggggtgtgaccggcgaaggcattgcatcacgtgagaaaccctagtcgtcactcccctcccgagcaaaaaccctagccgcgcgcgggtgctagcacatctgcgcgtggcgttccatccctatacgtgtggataccggtaaaggcgccgctagtttgcggtgctgatcggtgtgggagtacggcaaggagaacacacgagaaggagaaggtcgagtcggtgcgatcgactacttcctctacatcgacgcgcgctacttcgcgagagttccttcgacttctcagcgtcttcttccgctgcacagcgcgtcgagtggtaactatctatgatctaatacttgcatggttcctggtttacgcgatagaaaattttgatttatcctatcgtagccttcgcgtatcccaacaatataatcattagatagcaatctattcttgaattcatacaaaaaagaacataggaatgagctcacctctaaatttaattgtcgcacacgagctcttgttatcggtccttaaatgaccattggaggattgttgtgtgtaaccgaggtagtgatgtctgcatcatcctccccctcttgaattgaagtcgtcctcaactcaagctcatcctcttctcccaagtatggcttcaaatctgaaatgtaaacgtgggactaaccctaaagtcgggaagcaactcaagtttatatgtattatcattaatcttctcaacaattttaaaaggaccatcagcacgaggcatcaacttagactttctcaattctggaaatctatcctttctcaagtgcaaccaaactaaatcacccggttcaagcttaacctcttgcctacctttactaccagcaattctatacttttcagtcatcttttcaatgttgaggttagttgactcatgcattttcagaataaattcagcgtgtgccttaggatcattatgaaccctctcactagtaggtaaaggcaaaatatcaattcgagcacgagggttgaaaccatacactatctgaaaaggactttacctggtaggagaatgtgttgcccgattgtatccaactcccacatagggcaaccattcttcccactttttaatttttttcttcaaaatagccctcaatatggtacccaaagtttggttgactacctctgtttgtccatctgtttgggggtgacatgatgtaaaaaacaatagctttgtacccaagttgttccatagcgtgcgccaaaaatgacttaagagttttgcatctcgatctataacaatagtagaaggcataccatgcaagcgaacaatctcatggaaaaacatatcagcaatatgaacagcatcatcacttttatgacatggtatgaaatgtgccatcttagaaaaacgatccaccacaacaaaaatgctatccctccccctcttagttctgggcaatcccgaaacaaagtccatagaaatatctgcccaagaaatagaaggtacaggaagaggcatatacaaaccatgtggattcaaatgagacttagctttctgacaagtggtgcaacgtgctacgaacctctcaacatcttttctcatccttggccaaaagaaatgcatggccaaaacatcttccgtcttcttagctccaaaatgtcccatcaagcctcctccatgcgcttcctgtattatcaaaagacgaacggaaccaactggaatgcatagacggttagctctataaacaaatccaccattgatcacaatttttttccaagtacgtccctctttgcaatttaacatcacttcattaaaatcaggatcaagcgcatattgttctttaattgattcaagtacaaaaatccgacaatcaagttgggacaagaaagtatagcgcctagacaaaacatctgcaatcacattatctttccctttcttgcgtttgataacataaggaaaagattcaataaattcaacccatttagcatgtctacgattcaaattattttgagaccgaagatatttaagcgattcgtgatcggactgaataacaaattctttatgccacaaataatgacgccacgtctctaaagaacgtacaagagcatacaattccttatcatacgtggaataattcaaaacaggaccatgcaacttctcgctaaagtatgcaacaggcttaccatcttgcatcaacacacctccaatgccaactccactagcatcacattctaactcaaaagtcttaccaaagtttggaagttgtagcaatggtgcgtgtgtaagcttgttcttcaaagtgtcaaacgacttcccctgtgtctttccccaatggaagaccacccctttcttcatcaactcatgcaatggtgcagcaaaggtactaaaatctttgacgaaacggcgatagaatcctgcaagaccaaaaaaactcctcaactatgtgatggtttggggaaccggccaactctttatggcttcaattttcgtctcatccacctcaattccctttggagtaacaacatatccaagaaaagaaactcgttccgtgcaaaagatgcacttttcaaggttagcaaacaaacgtgcatcacgtagggcattaaaaacagcacataaatgatccatgtgttcatcaaaagacttgttgtaaatcaatatgtcatcaaagtaaactaccacaaatcgtccaataaaaggccttaaaacctcattcattaagcgcatgaaagtactaggtgcattagtcaaaccaaaaggcattactaaccactcatacaaaccaaatttagttttgaaagctgttttccattcatctccaagtttcattctaatttggtggtagccactacgcaagtcaatctttgtgaaaattatagaaccacacaactcatcaagcatgtcgtctaacctaggaataggatgacaatatcggatagtaatattattaatggctctacaatcaacacacattcgccaagaaccatctttcttaggaaccaaaattacaggaactacacaaggactaaggctttgacgtacatacccgctgtccaaaagatcttgaacttgccgctgaatttccttagtctcctctaggttagttcgataagcagcacggtttggcaatgatgctcctggaatcaaatcaatttgatgctctatccctctcataggtggcaatcccggggatatctcagctggaaagacatcctcatactcctgcaaaaggttagtaacaacaggaggtatcgaacgagcaatatcatctagagaaaccaaggcttatttgcatatcaagaaatagcacatatcattatctgaaattacagcaatgtcacatttcgtagcaagcataacaccacccttcaacttaattccctcaaccttagaactaggtgaaagcttatcctttttgggtggaaaaacagatttagccacttgctgattttcagactcatcaagtttcaaactagcagctcgctctttatcagcttctacaatttcagcaggggtaaaaggtagaaaagtaattttcttttcattatgcacaaaagtgtatttattactcctatcatggtgtgtagcatcattatcatgttcccaaggacgacccagcaaaagtaaacaagcttgcataggaaccacatcacaatcaacagaatctgcatatgagccaatggaaaatgaaaccctacaaacctgtgttacctttgctcttccggaatcgtttaaccactgaatatggtaaggatgtggatgtgtacgtgttgtcaagccaagcttagtgaccaaatcagaactcaccaaattattgcagctacctgcatcaatgatcacacgtgcacgatggttgttgatgacaaagaaaatctgaaacaaattatggcgttgcaacctctcaggctactgtacctgcgtgctgagcacccgctgcacaatgatggtcctgtaatccgatgtgtcatcatgaccaaagacttcgccatcctcatcctcaacttcttcttcctcctcttcctctttcacgtcggaggtggtgatgtagccatcttctgtagcaacataggcccgttgactagggcaatctttttctgcacatgcccaaacccttggcaatggtggcactgaatgcgtcccgtcgaggcgatagatgaggaactcttggcaggtatctgcgaagaacctttacctgactctgcttggtggagatggttttggtgccgtagaagctccagatgcagctggtcgcttgctcgctggctgggaatgcacccgaaaagagacagccttgggcagtcccgcagatggcgtcgtgcgcggagtgtatgtacttgccttgttcttgccctgatggtcacgcccctgcaattccttctctgcaagcatagcaaaccgaaacaactggttgacagagttaaattctttataatcaacaatattctgaatttcctccctcaaacaagagtaaaaacaacaaatagcatcctcgaccccctccactatgccacagcgtctcacacccttttgtagctcaccatagtaatcctgtacagatttatccccttgttccaaacgcatcagtttcttgcgcaaatctctatgataagatggaggaacaaacctatcgcgcatagctaccttaagttcttcccaagtagtaggtagtaccccctcatcagacaacccagcccaccacatgatagcaaaatccttgaactcactactggcttgtctaactctatgttgctcaggtataagttgggcattaaactttgttctactgccatctcccaatcaaggtatttctcagcatcataatatcccgaaaaagatggtattttaaacataaccatagcataaggataatcgggcacacgattattattaccttgttggtggcgagtgccacccatacctgtgcggtttgtgcgtaggtgacgtcgtagctgtgcttgccttgtagctggtgtgtcaatatagccactggaatcatacaccgtatcttccggatgagcatcgtcgtcaccactcaccacttcctcattggaaggtgtctccaacgcggcaacccgatcagttagcgtggatatccgtttgtccaacctctccatgtggttcaggaagctgagtttagtgaaggcatcttgcacagactttccaacggcctccgtgatgtcctttttcttggagagttcatagttgctcttagctgacatagtcagcaaaatcctggggactcttctcaccttcgttacctgccattgaaacaccaaaacagaaacaaacggtgaaggttatccctaataatctactacgcaggtgtagtggtgcctctcaacgattctcagcaatatggagtacctaaccaagctcttataaggttcttagtagcaaagcaaaggatacctggaaggcgtagtcagcgatgcagggatcaagaacctgtgctgtccagaagtaaatatgtggagctaggaaggccaaatatatgtatatgagtggtacacaatccaatgacagatagtaatgctgaataaaaatcccaagtcacttgcccttagttgctggtctactcgtgtattagacagtagtggtaacaataatggttcaaggaaaatgacactagtaaatagcaaagaaggacttgcaggcaagcttcggcgagttttagcaaaaacaacaaaaccgaactggcagataagctcaacggagcacgtcgtgagcttaatgcagtagtggaaatcaacttttctttttttttcttttatttttttgatatttttttctttttccagaacacgaaaataggcacacctctaagttacagctaaatcggagttgatatgtggcctatggaattttctgaaaccactataaacaaggtgcaggaacttgtgggctcgaacagacaattttgcaagccaaattttagaatttttttctcttatctgaaaagttaaaatttgcctgattccgagtccgtatgcaaaagttatggctgtttgaagttttggcttctggctaagttttccaaaggggatataacctagcctattttgcggtggaattgggatatggtggcagcggagtttgtaggatgttgtggtgatgcgtggtgatctggaattgggtgtttatgatggcggaaatggctctcaaaggatagggttataaaggaaaaaacacacgactagactaaaacacgcactagaccagcaataggaacttaaactaggactcaaactcaacactacggactctgaaaaagaatcatgcaaaggctaaacacggtctaggttaaggttactaacgactaaattttttttggcttttctgtagactctaggataattacgaaaaacaaaaactaatctagggcaaagaaactgagcgaacctgacggtgaacctagagctctgataccacttgatgtgcactagggttcccgatcttccgaaatgttttgataaacaacgatttgggcggagtcgcgacacaaatcgatctgtcttcttgaacgcgcacgctcttgagccccgcaatcgcagcaccacgtctcctctggttatcacccgtgtcgaaacgcggatgacctcgccgagaaggctaatccctgtttgccaatcgaagaacacaaagaagaacgagacagaaaacaaccaaaattgcagatgaatgattaagctcacgagttgtggtcttacaaaccgatctagcggcgaaactgttctcgacagattaatctaagcaaaacccaaagacctaaagatggcggcggtacttatatatagagtttagggtcttgcaacccgctctcgacgcaacgctaatgagttccaacgcgatacacgggccaaaagtccaaatacggtgacgcaacaccgggacagaatctggacatcaacttgttcgggcgattcctattgactcggaaagaatttggatgtgggaccagaaccattggaaaggttatctttttagctttccatccatataaagaacgtgtagcgcccgttccgtcgtggcgcctagcgggaaaactatctcttaaaaaccctaattgcgaaatctggttccttgcttggtgtctatccccgatctatcgtcaaagttcaatcccgaatctaaatccttcccaaatcaaatccctccgcagaagtctattttgcctccctcaggttcgatgggccgaattcctcttggcccatcttcccccttcccatctccccctctctctctctctctctttctcccgctctgcccatgagccgcgccgagccctccctttccggtctcgctgccggtcccaccgatgccacccaaattgccgcggccgccgcgcgcgcgcgcgccgtggtggccgaccgggcactcgccggtgccgtccgagcctgccgcgcctgccgagcctgcccgtgccttgcacccgtgtcgtcgcttcactccaaaccgcccccgacgttatcgccggtgttatagacccgggcttcgtcaattcgcgcgctagccttcaagggacggagggagagctcctccttcctctggcgcgttcgccccgttcccttctttcttttccaaagtgggaatgggcaaagccccccttttcttcctttccttttcccttttttctctttcctccgccggcgtcattcccctcctccttgtcgccgatttggccgctagccggagcgcccgatcactggcttgaccgtccaatgtcggttcccctctcccaaaccgactttgtcgcccatataaacccaagctcccccactttcctttcctctcccattcgccctcgctccaccgcgccattgccgtcccctctgtcccgcccccgccgtcaccgccgccgtcaggtgtgccgaaggagccggtgcgcgttaggacgcggaaggggactccgggcgcgccctcttcttcctcttccccggcctgagggtggagagatcactcccgtgccgtcagcctctcgtcacagcgccccgcctcgtctcggtagtgcctccctccgttctccctcctcgttccatctcctccccttagactcgggtagtagcacgagtagcctcgccgtagctaactagcgccgccccgaccgttgcagccgctcgctgtgtgctcgccgccatcgccgcccgtgcttcgtagcgcccgcttgtcgccggcctcgctcggcgtagctccgcctaatccgacgctagcaacggattcccggagttgcgtagatgctctagctcgcccgaatcggtctcccgtcgcgccattgccgtttcacccttctcccgccgccggttgccgctaccgcaatccgccgccgtcgagcatcccccggtgaatccgagctgttggctcgtctcccctcgtcccgagcaacttcccggtgtgctcgctttcgcctgtatcgccgtggttcgctccgccgcccgccaccgtcgtccgccgtccgttgcggcagacgtcgtcgtctacctcccgccggcccgcgtggcagccacgtaagtgccacgtcggcgccacctcggccgcgaccgtgtcaagctgacaacggttcgcagctttccccccgccccactcgcgcgcgcggtctaccgcgagccgtgaggctgcgcgtgggcccaccgcaccgcgtcctccgcgaaccgcgcgcatgcgccgcgcgtccctcctgaaaccctagcacacctcgcatgcacctcactcacggtgagtcgagtcgccgacaagcgagtcccacccaggaccacgcgggatggacccggcccaccggctctctctctctcctccccgcccgcgcgcatgttctgggccaccttctcgggccggccggctcgttaagttcggccgagccgcccctttctctcgggccgcgccctagccgcccgaggaaagtctaatttccctccctccttcttttcttttcttttctttttcaaaaaggatttaaataaatccttttcctttagaccaaaaatccaataatcttagaaattgaatatcttcccaaccgtaagtccgtttgactccgttcaacttccaaaattcctcaaatctcgagatctatctaatggcacgcttagaggtcaataatagggctttatttttgccgtttgctgagttatcccgtttcgcgtgtagtttcggagcccgaagacccgcagtgcgaggatttcgaggattaagctcaagatctcgagcaaggcaagccacctttgaacatcttgagcctatatttgaacttaattatgttgcttgaaaaatattatgcattaataggattgcacttaatctgcttgtcccgtctgcaaggcagattggcggacctacctaacttgttgcatttgacccttccatcgaaattcttataccatgttcccttgtaaccacctagttacgcctcggtaatcgtgcactctgcacgagtaacgacggtcgccttcaaacttaaaatctgagaaacatcttgggtaaaacatgggttttataaaagacttggaaaacctgacaccagggtcggtgcttgcgaacctaaatgaatttccaaaatcgcggaccggggaacgtaccgggtgtacggtttcccgctcttgcacttaaggaccgtttccttggaatttcatctgaacataagacaagtacgaccacatgggtggaatgggacacccctggctgagtaactagctaatcgggggagccatgatgccaagagacatgtggattcaacggggtggtgtcggggaggacccccgggtttcctggcatagtatggtctgggacctaatctagtgttggtctgggacccctctcgttggcatatggtgaacctgtgtcggctttccaaatgccttgtcatgaaagccttaaggtctctagtcgtggccgttctgcacgggctggatgatctgggttagtaatgtcgtgtgggtaaagtgtaccccctctgcagaggttattaaactgttcgaacagccgtgcccacggtcatgggcggatgtgaggtgattcctagcgtagttttgtttgactactgctttgtgaaatttgctgatgtggtttgggattgatgtttggaaaatctgcggctgatgggatcatccaggcccaggtggccgtttaaaagccgttggccgggtgccaaccttgatcaattcaaaagactgataccttgcacatacttcgaccagacgagacgcactgtctcatctgtatcgtttgagaagcactcacttagttgtttcagaaaagagtttaaataaaatcaattgcaaaaacaacagcctttccttgaagcctgcattaaacacttatttcccatggcttgctgagtactcccgtactcacccttgctgtatataaataatcccccccagttgttgaagaagatgaagcggatcccgctgacgaggagttcttccaggagcaagccggctacgatgagttttagggttttcggcctagttcccaagtcgcgcctgtgatgtttggtccaagtcttggcttccgctttccttttgtaatgcagttgtgagctcgggatctgtccgcagcccaacatgactgggctcctactctataataaagagacctctgttgctgtgatattctgtcttcctgtgatactagcactgtttcctgggactggtatcgattaacaggttaatttggagcgtcacgggctagttctgctcgggactagtccggggcgtggcaagagatggtatcagagcacaggcttggccctagggcgaaacccgacgtttaggacgaccctaaggatgctaagttcaaaactacttgcgaaaagctaaggctccttttggtttctttattttcaatagtttgttgctaaaatggttattgatcttttctccctctttcaaaattgtagatggcagtgaacgccagcttcagttcccacggttttggcgagggtcaccacgtcgctcagcttcgtgacctcgcccgcttccttggcttctcgtgtcccgagtacacggggtactccgtggaccgtgttccccctcgctgtgagctctgtgtacctttaccctcgtggaggtatacacggagctggcctttgcccacaccacttcactgtggccaggcccactctccagatcgcgtaccaggacctctcctggactgcgcttcgacgcttggcccatgactacagccaccgtctcgggggctctgccttctggcagctcccacgccttccttctggccacgcagacgccaggtacccttgtccgtacagcgagtctcagccagtgctgactcgcatggtggagctttcggaggcttaggccactcagcacgacctactcctcgaggcttaccgctcctttgcccgccgatacgccgctctggaggcccgtctggccgaggagggtgtcacctcagttgacactgtctcttgggactcagcccgcctatgccacgccagccacctgtcctcccacagctctcgcggctcttcctgcactcccagtggcccgcgctcccccagctcgcgtgcgccgtactcaccagtgtactccccctacccacacccagttagcccctcctacacccccggacacaccccagttgcttcctcccgccgtggcccacgctttatccgcactgtgcggaagcatgttgttggttcttccaccgtgttccgcttcgactacccagctcccccaccgccagcggcccgtactgctgccggccctcgacaggttccgccggtcccttcgcgctagccgatcgacgtttcttcgactgaggagccgactacaagaggcagccaggcagacgaggagtagaggaggcagtcttcagcagctgtccgtgtgttaggcccttttgttccgccgccaactcttttggagtcatggcgagatagtgcgtgcgtgtgtttgatgtgggtgttgtttggtagtctggttctcgtaggtggtgtgcgtacagtcaagctcggcgtagctctgtgacttgtccacacccgttgtatcaggtgtttttatgatttgaaaaatccagtttatgcctagtgcgtgctatctgagttgttatttactttgctccttgccctcctaagtgcttatctgattcttacctcgccctcttcggtttagatggctagccgcccccgccgtgctgctcatgcatcagcctgcttcggttttgaggaaggtagagttgagccagaagcaaatcatgagtcagctaatgagcaatctcaccacagcaaccgttcgcaccgtactgcttcccgcaatgcagaagttgagcaaccccgccgcagcaaccgctcgcatcacacagcttcccgtatagcagagatggaacagtctcaccaatctcaccgcgctgctagtcacaattctggagaagaacgcatcccttccccacctcatgtggaaaacaacatgcaacacctgatggcagttcagacacagatcttgcaaggattagccgcggctatagccggctttcagcataatgcgcatggaaatggccaccctcacatgagcaacaatagatccaaactgaccgacttcctgaggtctcggccgccagagttctctcagaccgtcgagcccgttgaggctgacgattggctgaaggatgttgatagaaaactcaacttagtgcagtgtactcctgttgagaagacgctctacgcctctcaccagctaagaggacctgctgcagattggtgggagaattactgcaatgcacaccctgaactcactaacattgcttgggatgagtttgctatggctttccgtgcagctcatgtgcccgaaagcaccattgatatgaagaaagaggaatttaacaggcttaagcaaggcaacaacagtatcaatgagtacctaagtcagttcaacaagttggctcggtatgcccctaaggaagtggacacagacaataagaagatcaggaagttcttgaagggaatcgcagttggaatgagactccagttgcttgctcatgacttccccacttttcaacatatgatcaacaaggcacttctacttgaggatgccagaaaagagtctgccgaagaatataagaaacgcaagtctaaccatcaggggaattcttcccgaggcgcacctcgccctcgctatggtcaacccatgcaataccactagtcggtcactcaagctaaccgccagccaggctacgcccctcgtcctcagatgaaccgctcggcacctcagccacagcagcatgccccaagtggcaatactgcgcccaacagggttacctctttcaagtcaccgctaggactgtcagcagttcagtgtttccggtgtaaccagatgggtcactatgctagatagtgccatcagaatcctaccaacaccaactcagggcatgctaatggcagcactgccagaactcctactccagcagcagctctgtctcgtcctaactctcaggcaagaggacaaggttctcgtgcctccaacaactttggtcgaggccggatgaaccacattcaagctgagaccgctcaggatgttccagacgttgtgatgggtatgttctctgtcaactccgtacccgcaatagttctgtttgattcaggagcttcccattctttcatatcacaagcttttgtgaaaagaaatggttggaaaacccaaaatttacatgtaccaatgatagtacattcccctggaaggaatataagggcaactcaaatatgcccggaagttaaccttagaattgaggaagttgacttcctagccaaaccgatagtcctggactcgcaaagcttggacatcatcctagggatggattggttggctaagcacaaaggacagatagattgtgccgaaaggtccatcaccttgcaaggacctggaggaaagcaagtccgctttacctctaacacccctaccacaagtcggtctatcctaacctgtttacaagtcacctccttggagtcggtgcccatagtctgtgaatatcctgacgtatttccagaagaattaacgagtatgccaccagaccaagagattgagttcgccatagaactggcaccaagcaccgcaccaattgcaaaaagaccctaccgaatggcagctaatgagttagcagaagtcaaaagacaaatcgaagaattggagagtaaaggttatgtgcgacccagctcatccccttggggagccccattgctcctggttaagaaaaaggatggctctgagagaatggtaatcgactatagagccctgaatgaagtaactataaagaacaagtacccgttgccacggattgatgatttgttcgatcaacttaaaggagcaagagttttctctaaagttgacttgagatcaggttaccaccaattgaaaatcagatctgaagatatcccgaagactgctttctcaacgcgttatggtctatatgagttcacagtgatgtccttcggactcaccaatgctctagcattcttcatgaacttaatgaataagatcttcatggaatacctggaccagtttgtcgtggtattcatcgatgacatcctgatatactccaagaatgaggaagaacatgctgaacacctgaggctgataatgggaaagctcagggatcatcaactattcgctaagttctcgaaatgcgaattctggttggaccgagtagcatttcttggacacgtgatctcctccaacggtgtcaaagtagatcccagcaaggttgaagctgtacttgcttggaacccgcccaagaatgtgtcagagatccgcagcttccttggcttagctggatattatcaaagattcattgaaggattctctaagctagccagacctatgaccgagctgttaaagaaggaaaagaaatttgaatggtcagcagcctgtgaagacggctttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagctcaggcctcatgaagtcaactatcccacccatgatctcgagttggcagccgtggttcatgctcttaagatcaggaggcactatttaatcgggaacagatgtgaagtatacacgatcacaaaagtcttaagtacatcttcactcagaccgagttaaatatgagacagagaagatggctggaactaatcaaggattacgatcttagaattcattaccatcccggtaaagctaatgtggtcgctgatgcgctaagtcacaagacctattgcgatgtagctcaaatatggccagaccaagatcgcctgtgcagagaattggagaagttaaggctgaccgtggtacagtcaggtgtccctaccagcttgacagtgcagcctaccctagaatcgcaaatccgggaagctcagaaagatgatgaagggataaaagaattaataaaaagaatacaggagaagaaggacaccgatttctccatagacgatcaaggcacaatttggtgcggtccacgcatctgtgtaccggccaagaaggagttaagagatctcattctaaaggaagctcatgagtccgcctactccattcatccaggaagtatgaagatgtaccaggatatcaaggcatacttctggtgggctggaatgaagcgagatatcgcagaatacgtagccctgtgtgacatttgccaaagagtcaaggcagagcatcagaggccagctggtctgctgcaacccctatcgattcccgagtgcaaatgggaagagatagaatggatttcatcaccggtttgccaagaacccctagtgggtacgactccatctggataatcgtggattgactcatgaaatcagctcatttcgtgccagtgaaaaccacctttgatggaaagaaactagcagaactctacatgacccatgtcgtatgtagatttggctgtcccaagaagattgtgttagatcgaggcactcagttcacctcaaggttctggaaacagttgcatgaagctcttggaaccgatctaaattttagtacagcttaccatccgcagaccgatggtcagacagaaagagtaaaccaaatcctagaagacatgctacgtgcgtgtgccatggattttgaaggcacttgggatcattgtttgccgtatgctgagttctcatacaacaacagttatcaggccagcattcagatgtcgccaaatgaggcaatgttcggaagaaagtgccgcactcccttgtgttggaatgaggtgggcgaagcactggtattcggtcctgacatactcaaggcagcagaagagcaagttaagctgatccgagaacgtttaaagacagctcagaaccgtcagaagaattacgctgacaatcggagacgtgaccttgagttcgaaaaaggagaccatgtgtacctgcgggtatcacctctccgtggtatgaggaggtttgggatgtccggcaagttagcaccccgctacatcggcccctacctcataaccgccaggcgtggcgaagtggcttattagcttgagttacctgaaggtctcgcagatgtgcacaacgtgttccatgtatcccagttaaagaaatgtcttcgagttccagaagaacaagttcccctgggtaatatcgagctggaaaggaatctgacctacaaggaaagaccgatcaaggttcttgaagaggcaggacgtcagactcgaaggaagaccatcaagttctataaggtccaatggagcaatcattccgaagatgaggcaacctgggaacgagaagatcttctccgcgccgagttcccggagctgctcccttagggctgaatctcggggtcgagattcttgttagggggttagtctgtagcgcccgttccgtcgtggcgcctagcgggaaaactatctcttaaaaaccctaattgcgaaatctgtttccttgcttgttgtctagtgaccgtgccatctcggatctcaaatccccgatctatcgtcaaagttcaatcccgaatccaaatccttcccaaatcaaatccctccgcaaagtctattttgcctccctcaggttcgatgggccgaattcctctcggcccatctccccctccctccccatctccccctctctctgtctctctgtctctctctctctcccgctctgcccgtgagccgcgccgagccctccctctccgctctcgctgccgttcccgccgataccgccaaatcgccgcgccgcccgcgcgcgcgcgccgtggtggccgaccggccagtcgccgccgccgtcagtgcctgccacgcctgcccgcgcctgccgcccgtgtcgtcgctccgctccaaaccgcccccgccgtcatcgccgtcatcattgactcggccctcgccactccgcgcgctagcctccaagggatggaggcagagctcctcctccctttgccgcgtcgccaccgttccctccttcttttcccaaagtggcaaggggcaagccccctttcttccttccttttccctttttctcttccttcgccggcgtcattcccctcctccctgtggacgatttggccactagccggagcgcccgatcactggcttgaccgtccaatgtcggttcccctctcccaaaccgactttgtcgcccatataaacccaagctcccccctttcctttcctctaccattcgccctcgctccaccgcgccattgccgtcccctctgtcccgcccccgccgtcaccgccgccgtcacgtgtgccgaagcagccggtgtgcgttaggacgcggaaggggacttcgggcgcgccctcttcttcctctacctcggcccgaggccggagtgatcactcccgtgccgtcagcctctcgtcacagcgccccacctcgtctcagtagtgcctccctccgttctccatcctcgttccatctcctccccttagactcgggtagtagcacgagtagcctcctcgtagctagctagcgccgccccgaccattgcagccgctcgctgtgtgctcgccaccgtcgccgcccgtgctccgtagcgcccgctcgtcgctggcctcgctcggcgtagctccgcccaatccgacgctagcaacggattcccggagtcgcgtagatgctctagctcgcccgaatcggtctcccgtcacaccttcgccgtttcccccttctcccaccgccggttgcccccgccgcaatccgccgccgtcgagcatcctccggcgaatccgagccgttggctcgtctcccctcgtcccgagcaacttcccggtgtgctcgctttcgactgtatcgccgtggttcgctacgccgcctgccaccgtcgtccgacgtccgttccggccgacgtcgtcatctacctcccgccgggcccgcgtggcagccacgtaagcgccacgtcggcgccacctcggccgcgtccgagtcaagctgaccccggtccggcgttttccttccggcccactcgcgcgcgcggtccaccacaagccgtgaggctgcgcgtgggcccgccgcaccgcgtcctccgtgaaccgcgcgcatgcaccgcgcctccctccccaaaccctagcacaccctgcgtgcacctcgctcacggtgagccaagtcgccgacaagcgagtccccccgggaccacgcgggatggacccggcccaccggctctctctctctcctccccgcccgcgcgcatgttttgggccgccttctcgggccggccggcccgttaagttcggccgagccgcccctttctctcgggccgcgccctagccgcctaaggaaagtctaatttccctccctccttcttttcttttcttttctttttcaaaaaggatttaaataaatccttttcctttagaccaaaaatccaataatcttagaaattcaatatcttcccaaccgtaagtccgtttgactctgttcaacttccaaaattcctcaaatctcgagatctatataatggcacgcttagaggtcaataatagggctttatttttgccggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29884 - DNA, 6561 bp, Oryza sativa
  unsure (1)..(6561): unsure at all n locations
naggtctctaatcgtgacggttctgccgggcttgaatgatccgggttaagtaatgtcgtgtgggtaaaagtgaccctcctctgcagaggttattaaactgttcgaacagccgtgcccacggtcatgggcggatgtgaggtgattcctagcgtagttttgtttgactactgctttgtgaaatttgctgaggtggtttgggattgatgtttggaaaatctgcggctgatgggatcagcaaggcccgggtggccgtttaaaagccgttgcccgggtgccaaccttgatcaattcaaaagactgataccttgcacatactccgaccggacgagatgcactgtctcatccgtatcgtttgagaagcactcacttagttgtttcagaaaagagtttaaataaaatcaattgcaaaaacaacagcctttccttgaagcctgcattaaacacttatttcccatggtttgctgagtactcccgtactcacccttgctctatataaataatcctccccagttgctgaagaagatgaagcggatcccgctgacgaggagttcttccaggagcaagccggctacgatgagttttacggttttcggcctagttcccaagtcgcgcctgtgatgtttggtccaagtcttggcttccgcttcccttttgtaatgcagttgtgagctcgggatctgtccgcagcccaacatgactgtagtcctactctataataaagagacctctgttgctttgatattctgtcttcctgtgaaaccagcactgtttcctgagactggtatcgataaacaggttaatttggagcgtcacgggctagttccgctcgagactagttcggggcgtcacagaacgccccaatccgagcacgtatgcgacctgggcacccattttagtgcagactggtactggactccgaattgcacccgaggtcgaattggtttgggcctccaccttgacttcgacatcctcgatgatcctctatggctctaagtccctctccaagtgtctcctcgtcccctctattgttcctaatccacaatataatcattaggtaacaatccattctcgaattcatacaaaaaatgaacataggagcgagctcgcctctaattttaattgccgcgcacgagctcttgttatcggtccttgaatgaccgttgaagcattgttgtgtgtatccgaggtagtgatgtccgcatcagattggatgaggggaatttatctcctcgttgtcctctttcgtttccctcaaaaaacggtgtttaattcctcgtatttcaaccgaatcaaactcgtttcgagtttatctctccaaactaaccataggattttccggtttcgattcctttcgttccgagtttgatctctttaatccgagcctataaacagcatccccaagttgtcctcttccatttgcctcaagtccaagccgtagccgtcgcccatagcgctgccgccacgtgagccctagcgtcgccgttgccgtcgctgcttcagctgcgctgcgccgctgctgtggtcgtcgccgccgccttctgtcaccaccgtcgggttcgctaggtggatgagcatcccgtccaccccttcgccgttagtgtatctcgccggagcgccgtcaccgacgttgacccgagccgagacaccgtcggacctcgtcgtcggtcgtcgtttgtcgtagttctttgcttcggtgagttcgcgtcgtcgtcctcttcgtgttggtgtcttcggaaagaccaaccgagctctgtagcgctggtaatctcgtggtccagtgccatggccggcgatgatgtcgtgatgacatcataactcttttatttaaatcgtaataattttctgtattagatgaaaatctgattaaacttcggaaattcataactaaatcatagtaactcggattcaagtggttcatgttgctaaattcatcttaaatcgagatctacatgtgaaaaatatccacatgtactgtttttgcttgtttttgtactattttgttgattttgttcatttgctttagtttccgacgttccggaggagagcgtttacattgaggaaggtttagaagcgtttgaagaagctcaaagcaagtcacacagatcccaaacaaccttttgagcatgttgaacctatttaaagctactgttttatttcaacttatgcattaaatttgaatgtcatcgggtggtgagcctttcccaattaattaatggccgaagatgactttattttccaatgggtaataaattgattagcttgaaccttatatattggtttggttcagctaaatgctatatacataattgcttagccatgcttagaaacattagctcattaatgggatgaatcataatacattattacttatggttagatttaatggtagctcacgatggttaatcgtgttatgataattaattgataattaaaacctgattaaaggtgggttgtgagcacatggttttgatgatcgtgctcatgacaattaaggactggttcgctagttactgttgtgaaacattaaccgtgccaaccacaagccagcgtgggcaacggccttaccttttgtatagcatggttcattacggggtgccagactgagaagcggcgagaagtccatgggggtcattggggagtccatgcctctggttgtagaggggggggattctgatccaggtatggtgcactgtggtgagttgtgttttgcaaggggtactgttacagttcctttccaaggtaccgtggtggcattgaggcgcatggagacatgttttggagctgtgtcttgtgggtacagtggtacatctctggccagagtataactattcgaatagccatgcccgcggttatgggcgggtctaacaatgtttttcatgattagtctcacattactcattattggtgataacctgtgataattaaattgactcctggtttggaacggtatattcctggtatggaggtttggtttgtacaaccggggttggttgttcagatgaggttgggcctatgcaacacgggtgtgttgtatagtgtttatttaatatttcttaaatacttaattgttttactattctctcaaatgcttattaaatgttgtttatacaaatgagctttgttatgccatctttgctatcctgtgcacttgtatatttgctgtgtagcttgttgagtatgtcatatgctcattcttgcaatattcattcatcagaggaggagtacttcagtgaaggtgatgatcaggtggattaggctttgttcgggtcaagttgcttgtggagtggagtcgccattaatttttccgctgcgtagaattttattcttttgagaggaactatccacctctataataatttattattttgtgaatattaattagtagtttgatagtactcttttatcaatttattattgtgtgcctcggctgattcctggacgaggatttaacgcacatataaacgtttggaattttggatagaaattccgggcgtgacaagttggtatcagagccatgttgaccttaggacaagccaaatggtaaaccttaagtagccttcaaaatattttgaaaaattaattaagttggcagcacatgcaagggtatgtacaaaattttctaaatcctactttaccaaaacagaaagctgttcttttcttttttaaaaaaaactttactgttcagtgtattaaatagtttgattttatgaatttcattggttagtcagcactgtacatctattatggtattgatgcaatcaagatagcaccagtactactcatccctgttaatggtgacactgtaccgtgcttatgatagatcctaagtattttagttttattttattcatttgtctaaagcaatttgtctctgtccaaagttgatttcattttccaaacaaaaactttgtttagttctgttcccacgagtactgtacaggaagaaaatatatttgcttctttttgtttacttttgaagtctatgcccctgtataaattaaaattttcgaaaaaaaatttctgaaaaaaaaacgaattggtttctgaaaatttatgtttcggtcagaaaagaaaaaatcgaaatttaattaaacaagaaaaaaattagttatgtttgctccttttcttttatttttctttttgggtcaaattaattaagtctagtttgtgcagctaacttaaatatatgcattaattcctcctttctgtgctgctttagatgtcgccccatccgccggaaagattgatcgatgtggtaggattcgtcagggggctgagaatgatggcatttgaagtaggctacgacgttgcccctgagtatcgtcagattccccatgaccccaacgaggagcaatgtcgtgttcgcgtgacgttgactagtgatcgtgaagaccttccgtcaataaagtttgaagctgggggaaaaaagtatagtcatgcttgtcaggaggcagccttggtggccattggagagctacgtcatcgctttgatgaggagttagagtcatcagctttttagtatcatccacacaagccacatggtcaagactatggagttcacaactaccctgaagatgaagatagcaccactctgaagcatgcggtgtatatgcttagcgccatggatgcaataggcgtggagcgggagaaagcagctcatgataaggaaaactagaaccatggcaagatttacaagctggagagcaaggtgtaccgtctgcagaaggaactggccgagcttaagggagaagcacaaccgccagcacccaagcttcgcctcaccgcaaggaagagaacccgtcctccacgtcatatccagttggcttcgaagactcgtgtggtgggagatgctgtgcctgatcatgctgaacctgtcatccatgtcttaagtgatgatgaagaggaggaagacctagaagaaagagagctagctactccagaggaagaagatccatctcttcgttccgacgcaaggcgggattagttgcctagttagaccgttgccatagttcgatgtgttagtttgcttgcttaagttcgctcatgcgtgtgtgggtttagcgtgtttcttacatcattggtgggatgtaactacaggagtttagttcttttgcttatcagagagtaagttagctggtgagatagtgttaaatcaacttaaatgtaacatactcagttaagagcaatatataatttaaattaattaaaggtctttgttctaatggtatctctctgtcgttctttccttttgcccgtgcttttcttttgatggtgaacacccgcactgaaagtgaagtggtcacaatgaagaagatcccacccttgcccaagttttggctcagcaaactcagtttgattaatctactagtgcagcaagcgcagaaccagcaggcaaataacaacaatcaaccaccacctccacagaacaagttggcagattttctacgtgtcagagcacctaccttctcaagcaccactaacccagtagaggcaggtgattggctgcatgctgttgaaaagaagttaaatttgattcagtgcaccgagcagaagaaggtttcttttgcttcgcatcagttgcatggtcctactgctgaatggtggaatcactttcgtcaaaatagagctgcgggaaagcctatcacttggcgggagtttactgctgctttcaagaagacacatataccatcaggtgttgtggcacttaagaagagagagttcagcgcactcaatcagggatcccgttctgtcatagagtacctccatgactttaatcgcctagctcgttatgccccagaggatgttcgcactgatagagaacgtcaggagaagtttttagagggactgaatgatgagttgtcttatgcattactggctatggaataacgggatttccagcagttggtggacaaggcgattcgccaagaaaacatgtacgataggatggaacagaagaagcgtagggctgctcatttcaaggctcaacagggtagtagccagaggccgcgcattctatgggacctcaagctgcaccatacccacagggaagatcctcttcagttgctcgccctcaatgccagttctacaacaacaacactggtaatcgcagcaacaacaatcgtaatgtggtcactcgtccagtagcaactccaactcagaatcagcctgtcaggaaggaacagggaagcaagctaggggtgtgcttcaattgtggtgatccaggacattatgctaataagtgtccaaagcctcggcgtgtgaagactgctcctgtccagaacaactccaatgctccagcaccgaaggctcgtgttaatcacgttacagctgcagaagcccagaatgcacctgatgtggttttgggtacgtttcctgttaacactatacccacaactgtgctttttgattccggtgctacacattcctttttgtctaaaagttttgcgagcaatcatgggatggaagttattagtcttgggaggcctttactagttaatacctcaggnnnnnnnnnnnnnnnnnnnnnnnnnnnnnnnnnnnaatgaagttctcagtgacagt

SEQ ID NO: 29885 - DNA, 734 bp, Oryza sativa
  unsure (1)..(734): unsure at all n locations
cgagggntttgagtgcgaaccgatgaattctccgtgaattcgagctcggtacccttgatcggggcacaatagttcgaccaggcattgtgcaaccttggagttagtgtcagggtcatgccaaaagacatcttcgacaagctcaacttaacagtgttggcaccaacaccaatgcaccttcaactggctcattcgtcagtccgttacccggcagggatagcggaagatgtgccagtcaagatacgggattttttcatcccggatgacttcgtggtgctggatatggacacgggaaaaaagacaccgctcatcctgggatgcccgttccttagcaccgcgggagccaacattaacgtgggaacaggaagtatccgtttccacatcatcggcaaggaagagaagtttgagtttcaaccgaggacggaacaatgctccatggtcagaataaagtacgggccgaacccacagaatattcaagaggtcgaagtggagccacccaagacggacagcctggtgaaattcatgcagaatttcctagagaagaaaacaacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29886 - DNA, 992 bp, Oryza sativa
  unsure (1)..(992): unsure at all n locations
cgcgtggatgtanatcnnnnnnnnnnnnnnnnnnnnnnnnnnnnnnnnnnnnnnnnnnnnnnntcttttcttttctttttcaaaaaggatttaaataaatccttttcctttagaccaaaaatccaataatcttagaaattcaatatcttcccaaccggaagtccgtttgactctgttcaacttccaaaattcctcaaatctcgagatctatataatggcacgcttagaggtcaataatagggctttatttttgccggttgctgagttgtcccgtttcgcgtgtaggttcggagcccgaagacccgcagtgcgaggatttcgaggatcaagctcaagatctcgagcaaggcaagccaactttgaaacatttgagcctatatttgaacttaattatgtggcttgaaaatattatgcattaataggattgcacttaatctgcttgtcccgtctgcaaggcagattggcggacctacctaacttgttgcatttgacccttccatcgaaattcttataccatgttcccttgtaaccacctagttacgcctcggcaatcgtgcactctgcacgagtaacgacggtcggccttcaaacttaaaatctgagaaacatcttgggtaaaacatgggttttataaaaaacttggaaaacctgacaccagggtcggtgcttgcgaacctaaatgaatttcaaaaatcgcggaccggggaacgtaccgggtgtcggttttcccgttctgcacttaaggaccgtttctttggaatttcatccgaccataagacaagtccgaccacatgggtggaatgggacacccctggctaagtaactagctaatcgggggagccatgatgccaagagacatgtggattcaacggggtggtgtcggggaggacccccgggtttcttggcacagtatggnnnnnnnnnnnnnnnnnnnnnnnnnnnnnnnnnnnnaagagggttntatcattgnnnttacaatgntcaaaggacca

SEQ ID NO: 29887 - DNA, 2083 bp, Oryza sativa
  unsure (1)..(2083): unsure at all n locations
cgcgcactaggatcgactcgctataaggcgactncgagctcggtacccaaaattactaacataaaactaaaaatgtgaatattttgcaatggttcaacaagtacaacagatctcaaggtcttacattgtaaggatatgatctccagcttcaattactgaaatattcgcatacttcttcacatcaggatacaactttgccaagtcctcattgacaaagtcatgaagctctgcagcaaattctacacctgttgggccaccaccaataacaacaaaatgaagattcttcttcctctcttcctcagttaggtttggaagggacgctctttcgaaacatttcaggacactcttcctaattttttgagcatcttctacttcctgacagaatgcacatgacgattcaattcaccatgcaaaatatgttgcaaaattgaacaacataatggatataacatactaaagaaaaagaagttatgacgaaagatggaacaaggatattctttgtttgacaaagaacaagtatatgtaaagatgtaaaagcaagtttgctgaaggtaattcagacattgaccaagagataagctgaaagagtcgtaactgataagatgataaaataaaaccgagttttggtacaacagttaatttctttcattaacctactgccttattagtactgacctttagaaaatggcagttttcaacaacaccaggggtattgaatgtattaggtctagctccaacactgacgaccaggtaatcataatctacaacaaattcactatttccatctgagtctgatctgcagtggatctttttggtagttggatcaatcttgtagcactctgcttcccaaaatctaaatgcgccgcctctctggaaataatgtacatgtaatatttgtgagaattcttgcattacaaaatgatgcaatatatcaataatatagctaattgattattaattcagtaaggtcttacctttctcacaatattacggataggctctacaatactacgtgcttcaactgtgccacatgtcacactaggcaacaaaggtgtgaaggtaaaatagttgcgaggtgatacgacatgaacatcgtacaaggaagtgtcaatatttctcaagaaacttgcgcctgcccaaccagttccaacgataaccaccctcttcttgccagttccatcatttatttgaagtacttgattatcctggcaagcataagtcaaagaaccaacactgcaaagatatttgaataaaaggtgtgtgagaggagagactcagagtcctgaaatatatacaatataaaatattatgaaaactaatattaagagtgcatttgccatctcagtgagttttaagttgcatttactagtttttgatttgccaatgaataccaactaatgaacttatcagagccataacagaacatgtaaataaaaatttcttccagctataatgaatagcacacctctgctgctagtcttcttcactttcaaaacagaaagaaccacaagagaagtattcactaaaattgcttgagacgcttacaagattttgctacatggcccaaaaacagaaatctggcaatacaaatgttatttcacttttgtgatcaaacaatatcatgaacagtatctgctgtgcacaattccaatatgatcccgggttacaataagaaatatgaaggacaaaccatcaccatgaatctatctgggacaaacatgtctagcatcatggattaatagctatagcacattctcttaagcaaaagggtgagaatacaatctgcttaaatgcccactcctctgtcccacaaaaccccaatttatttgaagaggtcccaggccaccgtccgggtttaaatccatttcagaatgggcctttttattggccgaattaattataattaataatttatgccgttaaataaccaaggaggccaggttttggacttttgggggacaaaacaatcctccgtttccttagaatgggaaggcgcggattcaattataccaatgtcatggaccaggatataccaacccgattaagccattggcccaggtgggacccatggttccacgcccct

SEQ ID NO: 29888 - DNA, 1018 bp, Oryza sativa
  unsure (1)..(1018): unsure at all n locations
ccgcgacactgagaacnnnnnnnnnnnnnnnnnnnnnnnnnnnnnnnnnnntgaaaacgccgatttttgttggcggatatttaagagatccgtctaaaaaaagagtatttttttatggcggacctaaatacaaacctttttcttttttaataatttcatggcatgactctattttttctttttaatgtcatgaccctaaatagataagatccagagcagctgcattttttttcaatccaaattcaaaatcaatttaaatcggcatcagatccatactcaaatccacatacagattcatcacattttcaacaagcaaactgcaaaatatgcagatgaaattgccaacaccgccgggagctgctgccaaaaatgctggccatgcgtcgagccgccggcggcagctggatctgcagcccgtgcccggagccaccgccgcgccacccactacctgatccaccgcctcccgcgcctcgagccgcaagcatgtggatggatacgctgcccaggagcatctccgccgccggatttgtcgcccgcacgccgccaggaaatattttacagaccatgggcctgctgagcagccattgctgtggctgtggatgcacaccgcggccacagctagtagcttaggtacagccgcaacaatggctgccaagcagggcgtgtattatttgcatgtatttatatgtaggattgatgatcccttgcatgtatacactttttttaggttcgagggtaattatttttgcatttttgagcttacatatagtggaaaatttgttatgcatcagaattcggccataacatacgaagctggcaaacactatactatgctatattatcttcgaggtggagttggtatttgtaatcgtgtgatatgcatccttaccgatcctaacatatcatatatgctgatacatagacannnnnnnnnnnnnnnnnnnnnnnnnnnnnnnnnnnnnnnnnnnnnnnnnnnnnnnnnnnnnnagacnggagatcaaagtcaacaaaggcccaa

SEQ ID NO: 29889 - DNA, 2323 bp, Oryza sativa
  unsure (1)..(2323): unsure at all n locations
nnnnnnnnnnnnnnnnnnnnnnnnnnnnnnnnnnnnnnnnnnnnnnnnnnnnnnnnnnnnnnnnnnnnnnnnnttttggtcccatgttaaaattcttccttggatgtcaaaaatctgcaaaacaagccacgtgcatcatccaatttgagtttgatttgggccttagaccttgtaattatgtcatgggataagtccaaggactggacaccctaggacatccctaatcatacttattcaatagccatcaaagtttagagtggtttttctatcgtcatgcagtttcaacgctagtcagtttgtagaattctaacttcaagttcttaatcattcatctacaattgagttacaatcgactttgttcttgcttgtgtttttcgattcgcatatagagattatccttctcggcgaagtcaatcaggttttaaactattgataaccaaaggagatatagaattatgattggagggtttgaaatcatgttgattggaagctggatcttgtatgtcaagtttccgcaaaaatcgataattatcttcacttgatggaagatcgaacactcccttgtcatcaatcgatcaagatttttgtcatcatcgaaactttcgatgttacataaggcagacgctaggatgtaatttatttgttgcttatgttgcaatagatttccttatatatatgtagatcataaaagggaaaaaaacaatttttactctattaagccttgtttgaccgtggtattgcatatgaggatgatgacatggaaaaatttcccattcccccttttcccccttcttttctcttcatcccccaccgttggatgcgccagtggcagcgtcatgcaagtagcagagatagggaggtagcaaaagaacggtgttggccatcagagaaagaggcacccgtagcggggttggcccgacggcagagcagatgctcaagctaaagccgaccatggtgatcccgagctcccggtcgtctcctttctctccacctcgagctccacttgacggtgaccaagagcttttcctcctcctccacctcctcatcgtgcgcactcttagtggacgccaccacctccgctccttcgcctcttcgttgttttcacatgcgtccctggttggtcgtcgccgcctcctcttatctgtctcgtctgccgcccttcgttgttgtcacgggtgcccctggtcattgtagtcacctcctcttgtttgtctcttcatctcatccgctacctcctctcctcctcttcacatgtgcccccgggtatgcgccaccttctcctcttctccatctcttcctcaccgttgcgtgcactggatctgtgcctcctccttcgacttttcgctgaatatgcgctcctcctcattaccagccggccggagcaaggacacactgccccaagggcggagtggccgatgacccgacgtggatatccgacggcgataaggttgtttgcggccatgggagggcggaggaggcatcggtggctgtagagaaaccctccctcacccctaactttccagaagcagtagcaggcgatgacaacggcggtgagggagaggaggtggtggcagcatcgaagcagcaacagcaggcagcgatgactacagcaacaacggagaagaggctgcaactggaacatcgaagcagcaacagccgacggttggatggtgagagaggaggaaaagggaagaaaggaaagagggagaggagattggttaggaagaggagctcccaaaaaataaataataaaatgagggaaaggggaaattttggcataggggatcctctagagtcgcatgacaggcatgcaagatcatggtcaaataaggctttggacccggatgatataataaacggggtttagggatttcaatacgtgctttgcaagttcatgaatctaggtaaaatttatttacatgttaaaaaaaaaaaccgctggtgcaatttactcatcaatacttaaaaggtgatgttatttctatcccttctctcataaggcacatatttgaaacggactttggaagccaccgatgataaatggaatatgtactacagatctttttctatttgtttccaatatgatatatttttttttattctaaaccttccatataatattttgatattttgtgaaagataaaatttgctacagattttttgatattttttccgaaagattacggcctttgctgtgagacacccgaagatagagaatttgctcgtggacacttaaannnnnnnnnnnnnnnnnnnnnnnnnnnnnnnnnnnnnnnnnnnnnnnnnnnnnnnnnnntggtagcaggagttctaaatgggcacg

SEQ ID NO: 29890 - DNA, 977 bp, Oryza sativa
  unsure (1)..(977): unsure at all n locations
ttttgtaggggcccgggaaaattaaatcccgggcggagaagaacaaccccaagcggtttaaatgccaaagaaaacccttcataagtccggcatgggcaattaaattttttgggggtggttaaaaaaaaaaagggaaaaaaaaagggaaaaaaaaacaggaacccgtttcccgggaacccccgtgtttttttcccttgggaggcaaaccttggttatgggccgccgcccccgccccttgttggcccaaaccgttttggcttgggccggccacccttgggcctctggttggcttaatagccagcttaagaaaaggaaggggaaaaaaaagaaagaggaaggggcattttggtacttacacaactctttctctctccattttaacctgtaataataatataatgggagaagtgtccagcagctaattactgcttttaaacagtgtccgcaatcaaatacacgattttggggtgtctcacagcaaaatccacaatctttcggtgtactgtagcaaattttgcctttgtgaaaagttccctttctatagaacctcgaccggggctgctccactagctctcttcttcccctcaccttgctcttctctagcaaatccttgtagtcttgtgagcggtggtggcaggtgtatcctagtgacttgcaccaagttcttctcctgttatattttatagatgcaatttatgtttataatagacaaaacttagcaattctggacctcattaatgcacacacgtccgcgtaatagctaggtatgatttgcgcttcttaaattcattctttttcagttttacaaatactgtcatccttgatagccccatgtatttacattttacttcattttatttgtgtccttcatgtcgtacttagagttttatttatannnnnnnnnnnnnnnnnnnnnnnnnnnnnnnnnnnnnnnnnnnnnnnnnnnnnnnnnnnnnnnnnnagttttcaatggggca

SEQ ID NO: 29891 - DNA, 1691 bp, Oryza sativa
cgttgggagattgctacgtattggttcgagaccaaccgagcgagtagaatcatctctcgaacaccaaatggaagtcgccggaagatttgctacgtactggttcgagacccagcgagcaaagtagaatcatctctcgaacaccaatgaaagtttgcggtgcgagagattgctacgcactggttcgaggaccagcggacaagtagaatcatcttttggacaccaatagaggttgcggtttgagagattgctacgtactggttcgagaaccagcgaacgtgtagaatcatctctcgaacaccaatgaaggttgcggtgcgggagattgctacgtactggttcgagaaccagcgagcgagtagaatcatctctcgaacaccaatggaagcactagagttggtttattacatgtgtatctcatgtggccagcatgactcacacacccaacttgtagcatatccggatgtccgttcgcaatcatgtcgggtgatcaagccgacaacgttcacgaggaattatccgttaacaacatttttctcaaatagtccagccacggccggcgctatgagataggtcgtcggtctttgttggtaggttgggcgcgacgactctgcatttgtcgagattgttctcaataatgcggtgtacttgatcacaacctacttgagtgctcaattattcctgaaaaatattttctagaagacaagatatatagcagataatatcaagtgtgtactcaaaaaactacatggattttctagcattatcaggatataacgagcatatataaatatcaggcattatgtaaaccgtaaacaagcatgatttatatggaagaaaatagagtgaaccctgtcacgtcccaaaacgactctaaaatatatccctaaaattatgcctagaataattaaaatctgtgtgcaagccttcaacaattaaaatgtgcaaagttaaaagtcaaataaggcttggaggatttttgtatatttcctaaaagcctaaaatgcataaataaattttagtggaattttcagagcacaaataataattgttaagaaataaacaaagttaaaatgattttataaaaagaaaaactctagaaagtcccctatccctccctctccctcttgggccggctcggcccatctctctccccctcttttctctcccccgcgggccattcggcctttccccgcgcgcgccgctgaccggcgggaccgcccgccaccctcgctgaccggaggggcccaaccgtcataacctttctttcgacgctcccgacgtctaacccgagccctatctacgtccccagcgctaatcacgtcgaccccggtcatcacgcatgcaatcaagaccggggaaccatatctcgggattcccccccccctctcccccatcaaaacactctttctgtccctcggatggagttggcaacccctagcactatcttcgcggaaccaataatggccaccgagatttaccgaccccatttgcaccaattgtaaagatgctctgacacaccaacccatgtaaaagctagccgtgaaacgcacagcgtgtccgccacaaaccgactctttacacgcagagtgaactaaggccaaggtccctggataacccgaggcgaagaaattcggtctgcaacgacatggccaggaccacttctcctagagaaggctcttgggataccaaaa

SEQ ID NO: 29892 - DNA, 1376 bp, Oryza sativa
  unsure (1)..(1376): unsure at all n locations
cacattgtactcccntgcatatattcggcactgtgggtgtgtcttgttaagtacggtgttgaactcagtctggctcatnttttcccaaaccagaagagaagcccctgaagatgaaggctttggtgtttagctcatgcctgccgtcaagcgcctgtggtcgtcgccatagtcttccgctgtttcccgtttgtctttgtgtgtgctgggccttcgccgccctgtaataaattaactatttacgcttccgcttgttgaactctgaactgtatcaacttttggtgtaccttgcctcctaggacaaggaataatgcacgcacgtaaggaacgcccgttagattatttccggtcgtgacaagcccccagcgttagatcgtagtcgatttaacatcggggacactcgcgcaatatatattgtataaaaacatgctctaggtaaacataataaattatagatccgacaatgctgtatgatcttgaaaagtaggtacagtaaattgtatataaaatattgcgtacctttgtagatatatgccggatatatctacagaattagtagatcaatttaaaaaatcaatctactaaatacctgatcatgggtggctggacacgtactgactccatacatatgcatgtgtactgtgtacgtgtaaggagcaggcatatttgttgaattcgcgtcatcaggacgagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgcgccactgtcgacgtttgatgtcgcgattccggtatttgcatagtatggggatcgtcggtactaggacatacgcgagactgaggtaaaagagacagaggcgacgatttttatacaggttcgggcccctgaattgtcaggtaataannnnnnnnnnnnnnnnnnnnnnnnnnnnnnnnnnnnnnnnnnnnnnnnnnnnnnnnnnnnncaagcgggcgttccatcgcagt

SEQ ID NO: 29893 - DNA, 5228 bp, Oryza sativa
  unsure (1)..(5228): unsure at all n locations
cgcgatggtcgcccnnnnnnnnnnnnnnnnnnnnnnnnnnnnnnnnnnnnnnnnnnnnnnnnnnnnnnnnnnnnnnnnnnataatcacacgagtacaatatttggggtagcctatctaactgttgtcgacatggcggtctgtatgtctgactcgtagtcgacaacagggtagtcttcctcctttagttcctgcccggcaagatcagagatagcacttttgtctctcctgacagtatccagagacagcgtaggggactagccgtgcttatccctgaagtcgatatccaacgtgttgtcttggcgtatgttggtttgtatgttgtggcttctgttgttccgtgtatgttgattatggtcggtgttgattgaggtggtcgtgtcccctctcctcctaaggggtcttgtatttatacccataagtgtccccttgtccaagtaaaactagggaaaccaatatggatacaatccgagtagtacttgtcgtttccatacagaactctggttgtctttccttatccagaacttctcctatatccgtaggttgtttccgtataggacatggtatctggtgggtgctgccgagatttagtcaactactattaggtatgtggtatccataaccctgacaatttcaaagttttaaacattgatatattaatgactttcttatatgcatattaatttcaattgaaagccatcttgttgtccatccttcctgacaagatgtagtgtacaagtcattctttagttcagcctcgctcacttggtatcacagaagcataacctagacgtaactaattcagtatagaagcaaaaagtgcaacagcaacaacgagggtggaaactagaaagaaggatttattatgttccttagtttattcagtcacgaaagagtgactttaaaaaaatgtacacttcttccaaagtgaaaattatgagatgtcttacttatggaatgctcctacatgctgaggttgttcttgctgacaccctcgtttctatgagaagattaatctaacatagcaagtagatagtttactgcaaacaaaatggataataaacctgatgtttcaaaaaaactagaggaactcatgcatgatgtacccaaaggaaaccggttcttgacacactacaaatctgtggtagttcttttccatctcgaaaacgaatcaaggctgtgtttggaatcagctgttcccaacatgcaaagtgcgcacggaaaacagggcggtccattagagcgtgattagttaagcattagctttttttcaaaaaatggattaatatgatttttaagcaacttttgtatagaaactttttgcaaaaaaacacaccgtttagcagtttgaaaagcgtgcgcgcggaatacgatggagatgggttgggaaccctggattctgaacacagcccaagtctatccaaaaagtttagacaagaaaacacgtaacaagttggtttacaagaatatgaattacgtcaatcctgcactacatgtatagcaaaatggtgatttctcgtaaatctctcgaatggtgatttaagaattcagtgcaaacctaattcttgctgtaaaatcaaatgttcggtaccacaacaacggaacaataaaaagcacttggtgtaccataatttttgtcactcttgttgaaattttgtaatataaaatgcatgaggccacacgaccttaatgttcaacgtgtcatgcattagtgaaataatagctcacaaaacataacgaatatagctagataacggttgcaatccttaccaaactaacgtataaagtgagcgatgtgtcatatcattatttttctagcctgctaaccaacatgtacaccttccgatcccaaaaatgacaacttccagggatgaacctaaacaaggtttagggtttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaatgaagatcattttcgtctttgctcttcttgctattgctgcatgcagcgcctctgcgcagtttgatgttttaggtcaaagttataggcaatattagctgcagtcgcctctcctgctacagcaacaggtgcttagcccatataatgagttcgtaaggcagcagtatggcatagcggcaagccccttattgcaatcagctgcgtttcaactgagaaacaaccaagtctggcaacagctcagggtggtggcgcagcagtctcactatcaaggtattaacattgttcaggccatagcgcagcagctacaactccagcagtttgatgatctctactttgatcggaatctggctcaagctcaagctcaagctctgttggctttgaacttgccatctagatatggtatctaccctaggtactatagtgcacctagtagcattaccacccttggcggtgtattgtactgagttttaacaatatagtggttcggaagttaaaaataagctcatatatcatcatatatttcacctgagaaactcggggtgatatatcctcgtacatcgtcataactaattaccatcattggtactctacaatattactatgtgcttacattcgatccaaagctactttgtctttaagatataaatggagcgtataaaggatgtccatcctttaattctagtaagaacaaacacgaagcacatatgtcaaatactaaatccactacaacaaaattatagaccatacaaagcacgtaaagatgtagcaatccacattgattcttcatccactactaaaataagcgcatgtgaaaggccgcatatgcatgatcattgtgaatatgacatgcccttatcgagcaaacgtgtcacttcatgcaaatatgttgtttgtttcaagcgacatcaagatatgatttcaaagttttaaacattggtatattaatgactttcatatctgcatattaatttcaattgaaagccatcttgttgcccatccttcctgacaagatgtagtgtacaaggcactctttagttgaggctcgctcactttgtattacagaagtataacctagacgtaactaattcagtataaaagcaaaaagtgcatcagcaacgatgagggtggaaactagaaagaaggatttatgatgttccttagtttattcagtcacgaaagaatgactttaaaaaaatgtacacttctttcaaagtgaaaatgatgagatgtcttacttatgtaatgctcctacacgctgaggttgttcttgctgacaccctcgtttctatgagaagtttattctaacatagtaagttgatatttacagcaaacaaaatggataataatcctgatgtttcaacaaaactagaggaactcactgttaacgaccaaatttggtaaagccatgggctgggttcaaagctagagtcgaagccggatttggaggaattctttttaagaaagccagagtgtgtatcggctacgggcggcatcagctgccgtacgtatcggctacaagcggaatcggctgtcgtatgtatcggctaacgccaaatccaatgaagacaagccgatgtagccagtcttgaaaaagacaggtccacaactatcatcgggatcaatcgaagtgcttcatagccattgccacacaagaatcggtccagcaaagggcaattgtatctattaattaggtttagtttccttaagagatattttggtaagagtccgcctaagggacttgttcgtattttacattgtaataaagatagagtcatgtccaacaaggagatgttatgtactttgggtataaatatgacccgagaccttataatcaggggacgacagctcaataatacttcggcgcatcgccaccctttttctctttcattgtttcgacgagtttttgctttcgagttgggctgcatcaggttcgatctccgacgaagaggtaaagcttgttatagcggattgcgttctcaggattagtgcttacatctttatgacactctaatcctatctatgtgaatcaccgagttatcatatatgctgcataatctagattgatctcgtcatctaatctcatcggctagcctctatcatcgaaaacggccgacagatttagatatcaacattaagctagattatgcggtatatctaccatatcaaatgagtcttcatcgttcttgcttagatcttatgtttcttttcacacttaatgctgcattggttaggttcgatctactaagtactgtcttgaaacattttatctagctctttctatgaatgctaatagagttagtatcggagtttcagccgatcttacctgatttagccatcgtgtttccactacttgggtcttgatcgtctaaatttgccctttatattaaaatatcatctatttgaagtgtattaagctctctatcaatctactagttcaccttatgtcacgaccggaactaacccaacgggcgttccttacgtgcgtgtattattccttgtcccaggaggcaaggtacaccaaaagttgatacatttcagagtttatcaagaggaattgaaaactcattcaaacataaaaacaatgaaattactgtcatactgataccatccaacgtatcaaatcttgtgcattcaatactgcatttatatatgccttgcctacattgtttttattccctcaaagcattaaaaagaatatcaccaaatctgtttccaccctataaatagtatctcttcttcatgtatcaataccaatcttggaatcttccaagataatcacaatgagggaaagtcgagtgattacagtaactcttcttctatcgcatatgttgttctaatcataggggggaagaaattcagtatataagccaaaggggaaatactagtcaaggtctcacaaattatggggttaataaaaccatcgaggtaagtgcaaaattagatcgggtaccgagctcgaattcgcccatatagatcagtaatcaacacgctc

SEQ ID NO: 29894 - DNA, 3207 bp, Oryza sativa
tgccgaaggtgctcctttcaaaccaatcgcacccggaccacagcctaaacacaattttaaggggttttgattaaaaggggaggtgtgtaatccaattcccaaataatccatccatttcaatagtgtccaggtaatgagaatattcccaaattctagagttgtaaaaccaccctaatgttggcttaataaacaagcaaagcatctaccttaaattcatactagtgggtaccataagtagagttgtccactagttgggggttttggttaatctaaggtggaccaaggtgattattaccattaccaataatattaggttcataacaaaaggtaaataggcatggctaaataaaccagtgataccgcggaattttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctatacgaccaacagaaatgaaaagggtttttactctaataaactccatataacaagtaggaacaaagcacaaaaatgggttcttgacttcttaaggaaaaattagagacttgaacggtccaattccgagttcaaatggccaagttatggccatttaaagtttatatgctctttaaatgaatatttgcgaatttcttcatttaaaatttaatttaaaaaggggtttattgcgtcagccgaggggaaggggcacgcggaccgggtccacaggagtggggcccatgcggcagcctcacggtccacggtggaccaggtgcacccgggctcacaccggccggcgtcgtgggtaacacgcatcagccgcacccgagggcgcgggcggctgatgaccgggccccacgcggcagccactcggcccgcccgaaggcggccactcggcgcggccggcgggaggcggtgcccgcgcccctattgtcaccgacggcggccataggcacggcggagcggcggccgagagaggggaagggaagggggaaaagaggcggcggtccacggctcaccctaggtcgacggcgacgacgaaaaaggcggccggagcggaggaaggcggcggcgcggctcgggtcgacggggtcgacgacgttccggcggtcggcgaactcggcaagggggtggacggggtcgacggcggtgcggcgaagccggaggaggcgacgccggggcgggagacggtcccggcgagcggagaaggccggccgaaggtcggtggcaatagaggagagagagagcgacggcgcgagctcgattccggcgagaaggaaggccggcgagaggcggaaacggacagaggaggtgcggggagggtttaaatagggttggaagggggagagagcggccgaaggggaagaaaaccggcgcgggaggtcggccgccatcaatggcgctgccgagatttgcgggggcaaatccgcccgtttgaacccaagagagagagggaaaaatggggggaaagggagaggggatcacggggagtgatttcccccactttattgcacgcggggacggcgggatgcggcggatttggcggcggcggcggcgcttggcgcaggcggagcggcgggaggatggggatgacgggtgggccccacccgtcagcgagggtggcgggcgggcccgcccgtcagcggcgcgcgcgcggggagaggctgagtgggccgcggggagaggagagagagagagggggggaggagagatgggccggcccggcccaagggagggaagggggacttttaaggtttttctttttataaaactttttcaactttgtttatttcttagtaattattatttgtgctctgaaaattccactaaaatttatttacaccttttaggcttttaggaaaaatacaaaaatcccctaagccttatttgacttttaactttgcacattttaattgttggaggctttcacacggattttaattattctaggcataatttaaaggatatattttagagtcgttttgggacatgacaccttgcttgttagattggtctacgtttcgtatatttcatctgtgctaatattgtagtataaagtggtatcggagtaatagtcgatacacgttaggtttgctcaatcggctatgctgtgagcatacataatccctactttgaagcacatttagatattaagtgatttatactgtctcggcatatcgcccgatctatcccaatcacttgatccaaatgtgctttcattggatagattgcgtactgctgacgtctacagccgattgggtagatctaataatttctatgccttatattcccttgctgatctgatgcaagtaacatcggcttggctccgaacaatacgttatcggcaatccagccgatcggctatcgttgatggatttaactttgttcctttttctttcttgctggttgcaggatcaaaccaactagcgcgctcggaacccgaaagcaattttggacctgcgctagagttaagcagatctctcaggccagtacgtgtgttttccgcatcaacacactttttggcatgcccggtgggaccgactttcgtaaaattttcttcatggcaagcctcaagtagagagaagttgatccaaaaaatgtcatcccaataacaatggacaagctgaccctggagcagaaggcagaatttgaaaagatgagagatgacttgcaaaacgattcctgcattcattcgcacagactcgttccgacaccatggtccagaaatataaggtagttctgtcgaacaacgatgacgcggaaacaagttctggcaaagacgacaaagccaagggcaacaatcaggaggaagatctcgaggcgctcaaatgtatgcaagaccaggttgattatgccgttcatcatgctttggtcaaccaatcaagagtacttgtcaacatgttgaccaacatgatcaaatatgtggttgacggcacgatagctgagcattaagccaaaggtccagtttttctgcctggagggtttttccaaactacaaaactgtcagcatggacaggcatcaacccatctcgagtgccgccccaaacagcccgtggctttaagtgtgcccccctggggcaaggggcaataacattgggcaaaggcagcccggaattcatccttacattcttatcaagccacaaacct

SEQ ID NO: 29895 - DNA, 4039 bp, Oryza sativa
  unsure (1)..(4039): unsure at all n locations
agctaccgatgctttaagggtcagattgtttcctctgtctctgtcaagattggccttcacgtggttttcatcattgccatataattttgtacaaagttgggccgatctggagaaacagttccataagtacttttatagcagttccataagtacttttatagcgggattcattagatgaagttgtccgatttaacgtcaatcaaacagaagcatgacaaatcggttcaagattatatccagagattcagagatatgaggaacaggtgctttagtttggctttaacagattcccagcttgccgatctcgctttccaaggcctactggtgccaatcaaggagaagttctcagcccaggaattcgagagtctagctcacctagctcagaaggtgacggcacacgagcaaaggtttcttgaggctagaaaggcatataaaaaggtgaacaatgttagcacatatgtctctgaaaccgaagaggatgaggaccctgaggtagcaatagctgaatgggcaaggaacaaatgagtggtcacgtgccaatgggtcaaggactctggaaaggaggaaaaaattgatttcgacatcaccaaagacgataggatcttcgatttattgcttcgggagaaacaaatccaccttcctgctggtcatgtaattccatctgctacagagctagggaagagaaaatactacaagtggcataacacaaggtctcacaacaccaatgagtgcacagttttcagacagcagatccaatccgccattgagcaggggagaatcaagttcgacgacccaaaaaaatccatggagatggacggcaatccttttcgtgtcaacatggtcgcccaagcgaggggatagccaatagaagaagctatcggcccaatgccgctatgatcatcagcaaatatcaagggaagcttgagaggcagaaagaggagtgttacaaagccaacaacagtttcgatcctcattgggactacaaattctttagattctactaaaacgaagggatgaggttaccctcgaaggaaggtgtgcccgtgatgcagtgatgccgacgaaaaccacgtcggtagtacaaaaaaatttcgtcccggaaaggaaaatcggtcggtgcagaagaagctgcttgttgatcagagattgggacttgctagccgattggtttctattggattatattgctatactatattatcatcagctgattgccttcatatcattatatacattggacatatagccgattgctcaaaaccctatcgccatcggctggtatcggcatcggctggaattactccatgggcttgtcaactgatcggctcattgatctgctatttgcatatcttgtcagttgcaggatcaaactgactggcacgcccacatctcaccaaactttggacctgcactggagctaagcagatctcccaggccagtgtgtgtttttcgcgtcaacaggttgttaacgattatagagtgttttattgagtagttcagctactagcttggtggtatcagtgattagtagcttttttttgagagttttattaagtttgtttctaaaccatgtagatgaaataacagaattggaacttgtttggtcaagtatatcagttattaattctatgacaccagaaaattacattgtttcatcgcatttaaaggctacaggtatttttcttttttacggagtgatcaaaccggatcaagggataaactactgcaaattatatcttctcgccctagtggacttctttatggagtgaactatatcaaatgttttgcttttgatgctgatctaattagtctgctgatcgttacggagatgttggtcatttccaactcttaatcttgctaatttttttccttcttttgctccttgataggctcgcttggcaaggaatctcccccacaaaattcagaaaagaggagggactgcataatcaggtactgcatactccccctcacagcttcagtaatgcttgcatgaaaaagttattaaaacaggctctctcaaaacaaaattcatttctttgccagttactaagcttaccgtctttaacaactgagaattgctttattaaagaaaaatcaaagtaaatatgagtgatcttgagtgttgtaaatttgatggtataacagcatagaagcacatggattttatgctgctatgttgctgtaacacaagtttgccaaacatttatgcagcatctccatgttctatctagtagtggtttattttgtgtacaacagtgagatattactcccaatgaaatttctacagatttttataaacatattgaaatatgatccattctctaaaaatatgaatgatttgcactatatcatgtaataatctagctcataatgtattacttactttgttgtattttaatcatgaatgatttgcactacgatatttccacatttggttgattaagtatctgccaatcaattgccattcatcctttttattttctgggagcaattttaccatcattttttgcattgcacctttgactgatatttctaagcattgctatttccttttgagtacctcgacaaacagagttgagcccattgtatatcctataactgattaatgcttgtaggtatggatctatttgagcttcaacaaagccctatcagaattttgacatttcttgtgcatgtcaaaggttctgaatagatacacttcaccatttcttttattgcaggataacatttttagctattgtttccggttaattttcaacatatatagattcatctatgttgacattgacgatcagcgattgtgccaactttattcagttaaaacctgatctagccatttgcagttgtgcaactgccgttgataattttttttccttcttggtatagtcacatcattagtttgttgtatatgcatgtaggcacttattatttatcatgtgcagattttatccattggcataagttatactaatatctgttgttttatcctttgtgttcacaaaatttgtattgttgaagatcatttgaactttgaagtctattgattttggcgaattctgaattcgagcaaggttaccattgaccatattatttggataattttatggttgtttctgagatggatttcgtgtccaaaaattgttgatcactgattgcctatatatatgtgggtgaaccagtttaaaggttagcaaatcatatccaaatctctgtcaggtgctattttggcaatatttccatgtattacatgctcaatcatgtcaactcacaagacatacaaggcaatattgctatatctttccataaatatcatgatagcaacaaaggtaacattatcctccttagcctatatatgagtgggtgaacaagtatgaaccaagaaaaaatactcaccactgattgtcggctgcataggactgctggaacttcaactcgtcatcttggtattgttctccaatctatctcttttgtgttggaaattattatactttagtttgcacctattgatctcctacttcttctgtattgtagtaaggcatggcatccatggatgatgtggatgatgaggatttttcaccacatcaagccacaactaaggagtcaatgaactctaaggatgatgtgaaggtgcaaccttcatcaaggcaaacagcaaacaaggggaattattacatggccacgtgaatgccatcatgatgatgtttcagttcatatgtgatggctaccagcgtgttgaaagttccatggaagaatacaagtccaagaaggtagaaaaaggacaaggtgagaaaaggaaggtgggcgaagggtatgatcctcgctggtatctcccatcgagaaaacaatgaagatctacaatgacaacgtctccaatgaacccaccgagaacgaaccatgatttaatattgttgctattgtgttttgaccttagaataatataacatttcttgtgaattannnnnnnnnnnnnnnnnnnnnnnnnnnnnnnnnnnnnnnnnnnnnnnnnnnnnnnnnnnnngaagttgaagttccaagccgt

SEQ ID NO: 29896 - DNA, 1027 bp, Oryza sativa
ttggggcgcccaaaaaaaattttttgggggagaaaaaaaaaagaatttgcttgtgccttatggcatggctgtttggtccactggtattggaacccgtcccctcataatggatttcatgaagcaagttggtcaggtatatctcgtacagaactcataagagaatacatttcaacatattacactaaattatgtttttaaaacacttatttaatttataggcaaaccgacgagtgctagctactgatgaatggctcagggttcatggatgtgatgatgtatatgctctcggtgattgcgcgacaataactcaaagaaaagttatggtatgtgtgtacttctcaatgcaaagataccatattttttgttcaagtaaagaatgcaccatattttgtcattggcaagaacatctcgatatgttatggtataattataatttaacatgtttcatcgcctgctctctagaatactaagctagcataattgaatttcaaatagtggcctatgtacagcaattagcccttttcagtgttaagttgccagttaattatatctaagtctttgttttgataataagttcatatgattaaatataaaaaattacaaatgctgaaattattatggtttaaagactgcaactttgtgtgaagctgtttagccatctcaaacatatcactattatagttataaagatttacaccgtggtgttcctttctgaaccaacttcaaaatttttggaggatgttttcagttcctacttcaaattctttttgtgagaaaggcaagattgacatgatctagcatctacccagatgagtcgtcaacgccaactgaacataaacgcctgccattgttagcacaccaatgtcatgttttggtcactacttttagatattaattcttgacattctgtactggaacgcggtgatatggaaatttcacgaagattttctttttaattttttcggataagcctaccaaggaccattgttggctcttacaattgcccaaaaaaattaaaaaacgtttc

SEQ ID NO: 29897 - DNA, 775 bp, Oryza sativa
  unsure (1)..(775): unsure at all n locations
ncgcggcacttaggagcanctnnnnnnnnnnnnnnnnnnnnnnnnnnnnnnnnntttgtgtgtgctgggccttcgccgcccatgtaataaattaattatttacgcttccttttgataaactctgaaatgtatcaacttttggtgtaccttgcctcctgggacaaggaataatacacgcacgtaaggaacgcccgttgggttagttccggtcgtgacataaggtgaactagtagattgatagagagcttaatacacttcaaatagatgatattttaatataaagggcaaatttagacgatcaagacccaagtagtggaaacacgatggctaaatcaggtaagatcggctgaaactccgatactaactctattagcattcatagaaagagctagataaaatgtttcaagacagtacttagtagatcgaacctaaccaatgcagcattaagtgtgaaaagaaacataagatctaagcaagaacgatgaagactcatttgatatggtagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29898 - DNA, 785 bp, Oryza sativa
  unsure (1)..(785): unsure at all n locations
cgggcccgcgtgtggaattcgacatactatttcgcgtattcgagctcggtacccgttaaatagtcgagaagatgtccgtgattgtaaactagcagtaggtgatacaaggtgtttaagcctgcctccactactgcacaaaaagagatatatcatcttcagtttactcagaaatcttgcctttttataatatcaatgtgtcctttattttagtattcctagtacatctcactgatcagaacacattcacatacccacttttcgacaccagaaatcttggatcagcataaataactcttgtaagtgcaggtgacctgggcaacagctgaggtttttccccaagtttgggggccaaggtacctccaaactgtagcaacgccattgaaatacttgctggatacccacaaagcttcaaccttcaatatactagctgccatttcacagagatagagtcaggtgaagcataacaaaagcaatacacaaaagaacgatattcgagtaagttcacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagg

SEQ ID NO: 29899 - DNA, 2724 bp, Oryza sativa
  unsure (1)..(2724): unsure at all n locations
taacggtgtnngcaaggtgtatcntagtgacttgcaccaagttcttctcctgttatatttaatagatgcntntaatgtttataatagacaaaacttagcatttctggacctcattaatgcacacacgtcgcgtaaatagctaggtatgatttgcgcttcttaaattcattctttttcagttttacaaatactgtcatccttgatagccccatgtatttacattttacttcattttatttgtgtccttcatgtcgtacttagagttttatttatagctatatatgtgaaaatttatagtatctgaagttcccgtgaatgcaaggattaactgtttgtttaaccaaatcctgcagtttgttgtagctaaattttgtaccctatagttgtgtgctactcgttaccacccgcattttacattatcaaaagtgcataacagacttttaaatctgaatgaattgtcgaaacatcataactaaccgcacgctagcttttttggtttacttgtttaaccgacttaattacttcaaccatccccacaaaaaaaaaacttacttcaccataaagtactgcttttgtatgaatgatttgtgtatattttatattaaacatttttctcatctagagtcgacgtcacttcctcatcatgtttatttgatttgaaagggacggaatgcataaacaggagaccattattggtactaataggtgcaagcaggggattctcttaaaggtctacttcctatataaaaaatcaaactagggataaatctgatcacatgtaaatctgtgttcagatttatcgttagatttgattttgtttgcacagaggggtatggcagatacttgaagtaacaggcatgtaatgcttcttctggccgttcacgataaaaatagcaactacagatattttgatcaagattttaaaaaactgctccataaaaaaaactatagatttagtattaaatttatcacaaaactatataattaaagcaagtaaaaaaactatagatttctaaatataaaattagcacaaaactatagattttagagtttaaattccttgtattaccattatgtcgaaactatgagtgttatagaattttgactaaattggtgctaaatttattttttatgataactttattattaaattagtagttttgtgatacgccatcttaaatttgtagttctgtgataaattaaatgctaaatatataatttgtgatataccaacttaaatttatagttttaggatgatttagtcaaagtattattttgtatcttgtattgcgcattgcaagatacataaatatgaaaatgtccactctcaattaatactctaaactattttttctgttctatatatttgcctcttgcataaaagaatgtctattatgtattcattttcttaggaatatatcgaggagacaaataatgtttttgtatgaatgatttgtgcatattatatatcaaaccttttctcatccaaagtcatcacttcctcatcactttgtcctgtttatttgattcgacagggacagaatgcataaacaagagaacattattagtggcaggagattctattgaagatctgtggcagctacttgaggtaacaaggcaagtgatacttatggtccattactcgtgacgaaaatgagatcgatcgtttgtgtattcatgtctcagtatttatttacaagatatacaaatgtgaaaacgtccactaatatcaattactccctctcaggtaaaaaataattatcattttaaacaaaactaatgttaaactttaaaaactttaactttgaataacttctaaagtattttccttagatcttaaaatgtattttaataaaatcatatatttattagtacttctataatattgtaatgatctctattgtaatagaaaatagtggtaaaaattagtttttggagatcgtgttgttatatccagaacgccaagtatttttaatctggagggagtattactctaaactatttttttctatatatttacgatctcttgcataaaaacatgttcatcatatactcattttctgacgaataaattaccgatctgaagttgatgccaaaatttaggaatctcgtttccgatatacctttcagcctctatcatcagcatctttttgggcaatagactaaccctcacatatgcagtgaatttcccacttgttgcctccacatgaactcctccacgccattcttcctctttcctcctcactacaagcccttcctctcgccctagcttctcaactctgtccagaactgacctggaatccgcacccggcacgacgaatcgaactcgatctggcaatggaccgatcaacccgcttagatcgcatcccgaggcgaacccgattatgtcgaaagcatttagctccattgcttgctccaattcagcctcccagcctcccatttctccacctctagtttagaatgagaggatgcagcttggatcataccgaatgatgacaagctcccatcttgttggaaccaagggtgatcgaagatttcaccaatcttgatacgggtatcgggttccggtcaagcatccgcccgataagagagcggagctccggcgagcaccatttcgggcaccggaacttggcggcgcagatcttccggtacatggccatgaggttgccgtcgttgaacggcaggtagcccgccggtgagcacgaagagcaccacgccccagga

SEQ ID NO: 29900 - DNA, 815 bp, Oryza sativa
  unsure (1)..(815): unsure at all n locations
atcgcccatgtctcgtttcgcgaaagaaccgagtatcnccgcctcggattcgacgggaacgaaggtgccatctccggcgcgactgagaaagtcctagacgctgtcgcaatccaatgagcnccatttccattcaatatgcgttctgtaatcacctctcaatgccgtcttttaacacaaccaagaacacctcatttggtgcacccaatctccaggaacgcgaccgcgtcaactcggaacaccgtagcgctctggacgccgcagcttcacctttgcctgtcgcccggcttcaacagttcgtaacaagctgagcctcttcgccacgagcttcatcaacaccttcagatcaagaatcccgaagtaatcgacgcgaggtggaccacgatgggagatcctcttcttcttccccaattccggccgccgacgccattcctttctttctccttctctggtcagcttcggcgcaatctttttcgcctagagctaccttgtgctgatctaaaccgaagcacgtaccctttctatgcagtacaagcccgggggtacaccgtagcagccgcgccgtcgccgaaccagtacaccatcgccaagacttcgccgagccgcgttcgcttcttggtgagtccctagagtccttaccatacgcatgcacgattagatcgagcctcaaaacccacatgcatgtgcaagccgagcttagccactgcctctaacaccctaacagccgctatnnnnnnnnnnnnnnnnnnnnnnnnnnnnnnnnnnnnnnnnnnnnnnnnnnnnnnnnnnnnnnnnnnnnnnnnnntaatcaatcgcgg

SEQ ID NO: 29901 - DNA, 791 bp, Oryza sativa
  unsure (1)..(791): unsure at all n locations
acgccaanataagagcatctgactacactatcggccgaattcgagctcggtaccctacagtatcctgatactttggtagcacctgagtttagaagatcgggtaactggtttaatggtggcggaagaaaaggccgaggccaaggaagaggaaggggatggagtggtcgttcttatcgacctgactctgatatggctgcgtatgatgggggcgacgatgaggagatgatggatacagccactagcccttcaaaacaagtggctaaacactatgctccctctacatccgtaaaaaagagattggctctggaacaggtgacgtcaccaaatctgaagagcaagcaggccctactactggagaatacacctgtgcaagatgatggaaatataaatactgaagctctcccaaaggaagttgatgagtcaaacagtaaggaagaggacagttcaacatcactagacagtaagcgtcagaagaaggtggatgaaggcagcaatacagatgacttggcaacatcggcgggctccctcgaggagtaccgccgggcctaatgtctatcctagcttggaactgtcggggcattgggcgagcccggacagttcaagatttagtctgcatggtgcagactcactggcccgaaaatagtcttcctagcggagacgaggcaaaatcaaaacgttgtgagaaacctaacatggagattaggtctgcgacgcttctttgtagtgaatggaaggggggaaggaggtggcattgcccttgttttggatgaaagcattaaagttgacctaan

SEQ ID NO: 29902 - DNA, 1298 bp, Oryza sativa
  unsure (1)..(1298): unsure at all n locations
cgcgcatggattgcacttcngtttgtacattgccactatatgaaattgaagtttgcatccctgcacgtcgactctagaggatccccataagtcgttatgaagctatttggtttaatataagaatcctttgactcggttgtgcagcaggcatggggagaaggagaagttgtgcgcaaccttggggacttcaaaaccaagatggcctacacaatggacgaacttgtcaagtggagcaaatcaaagattggcaacataaagaaaggtattgaaagtccgaggaagaaattaggtgaactcagaatggcagggatgcttgactctgaaccaaaggtgaaaaagatcaaagagcagcttcaggaaatgcttcgccgtgaggagatatggtggagacagcgatctcaaatcacttggctgaaggagggtgacaaaaatacaaagtatttccacctgaaagcgtcctggcgagctcggaagaataaagtgaagaaattgcgcaggcctaatggcagcctggtgtcaaatgaaaaggagatgggagaggttgcccgtgatttcttccagaatctatatatgaaagatgaaaatcttgaccctactgaacttttcaatttgttccagacaaaaataacagcggaaatgaatgagtctttgatgaaacccttctctgaggaggagataggagacgtcttgttccagatagggcatttgaaagcgccagggtccgatggtttcccggcgcatttcttccaaagaaattgggacccttaagactgatgttattagagtgtgttaacagtgaaatttggtaagcctggagtagtcaacggcttagagtcagcatcggctttgaagtctgagattagccgatgagagttgtcaagtcgtcagttgtcggattcttgctatattcggttaaggaaattgatctactaaatgaagtttatccagaagagaccgagttcaaagagaatgcggcatggcaagttatctattaattaggaatagtttgtaagtttccttttatctttaggaaagtttctttcttgtcctacaaggactagtatctacccataggtataaatatgtacacccggggtcattgtaaactatcttcacgatcaatacaattcggcgcatcgccacccttttacttctacttttgtttttacgttccggcggaacttggcacccgacatggggctgcatcgtnnnnnnnnnnnnnnnnnnnnnnnnnnnnnnnnnnnnnnnnnnnnnnnnnnnnnnnnnnnngggtaactagaagtataatcatgtgcaca

SEQ ID NO: 29903 - DNA, 4040 bp, Oryza sativa
  unsure (1)..(4040): unsure at all n locations
ccgcgattagtcgccnnnnnnnnnnnnnnnnnnnnnnnnnnnnnnnnnnnnnnnnnnnnnnnnnnnnnnnnnnnnnnnnnnnnaacttggcacccgacatggggctgcatcgtcttcgatctccggcgaagggatcagtccaatgttccgtcggcccaggcaattgtatcgtctacgtcggcatcgttcaaggctgcatcagtacattcgacctcttggattactctggtttggataatatatttgcctggctatttatcatatgtctatgttaatctagtcctagcatctcaatttagctctatcggatgtctctcactttagggtttctgccggtatcggctaaatcgccttgctagattagattagtttagacatctaccaccctgaaaactcagtcatcggcttgattgtctagatattatttttctttttatgcttagtgctgcatcagttaagtttgatctactaagtcgtgcttagaaccataatttctagcctgcttcttgattgccaataagggtttcatcggggttacagccaatgagttatctggacgttgcatcggcttacaaggattgcatgtacatataagttggatttagccgatcgcaacaaaggttttactgttttatctaatcctgtggatttaatgacatcggacctccagccgatgtatgctttaaccttcggatcaatacttgttctactatatcatattgttagccgattggtttctactgggctattcggatcagtgcttattatatcttgtttctagccgattggtttctactcggttatattgttattttattacatcatcatcaaccgattgcctttatatcattatctatattggacatatagccgattgcttaaaccctatcgctatcggctggtatcgacatcggctattatcagctatcggttggaactactccatcggcttgtcagccaatcggctgttttatctgctgtttacatattttgtcagttgtaggatcaaattgactggcacgctcgcatctcatcaatctttggaactgcacaggagctaagcagatctcccaggccggtgtgttcgattttttcgtcaacagagtggtacaagcattttttgaaaacggcgaaatgcaggagggagcaaatgacactgtcatagttatgattccaaaaactaagtcaccggaggagatgaaggatttctggcccatcagtctatgtaatgtgatatacaaggtgatagctaaatgccttgttaatctatgtaatgtgatatacaaggtgatagctaaatgccttgttaatcgactcagaccgctccttcatgatgtaatatcaaatgcatagagtgcttttgtatcaggttgcatgatcacagacaacgcgctcatcgctttcgaatgcttccatgccatccaaaaatgcaaaagggagaaccagaatttttgtgctctgaaattagatctttcaaaggcctatgatagagttgattgggcgtttctggatggggtgttgcaaagaatgggttttggagaatcatggaggaagtggacaatgtcatgtatgacatctgttagatacagtatctgtttaaatgggaacctgctagatccttttaccccaacaagaggattgcggcaaggtgatcctcttagtccatacttgtttctgtttattactgacgggttgtcacatattctggagaagaagagcttggaaggttcaatccaaccaattaaggtgtgtcggggagccccggggatctcccacttactttttgctgacgatagcttattgttttttcaagccgaggttgatcaagcgagaatttgctggaggcgctcagtctatacgagaaaagcacagggcagcttattaacccagcaaagtgttctctgttgtttagtgaattttgctcataggagaggcaggaggagatcaaagctgttctgcagattcaaagagcaggttttgaagataaatacctaggccttccaactcccgaaggtaggatgaaatcagaacaattccaaccaatcaagggaagattttctaagagattaacagattggtgtgagaggtttctatcagctgcagggaaggatactctgataaagagtgtagctcaagctctccccacctacacgataggagtgtttaagatgcctgaacatttttgtaatgattatgaatagatggttcgcaatttttggtggggacatgacaaaggggagaggaaagtacattggatatcctgggaaaagctcacgagccctaagcttcatggtggcctgggctttcgggatactcggtctttcaatcaggctttattagcacgtcaagcatggaggttgatcgcggagccgaatagcttgtgcgctcggttgctgaaagcaaagtattaccccaatggctcccttactgatacagctttcccgtccaatacttcaccaacttggaaaggaatcgaacatgggctggaattgctaaagaaaggactgatttggaggataggagacaggcggactaccaagatttggaggaatagatgggtggcgcatggtgagaaagttgaggttatacagaagaagaattggaataggctcacgtatgtacatgagcttttgatccctggaacaaacgcctggaatgaggcattaatcagacatgttgcgacggaggaagatgcaaatgctattctaaagatccatgtgccaaaccaggagacatctcactttcctgcatggcactatgagaaaacaggccttttttcagtaagaagcgcctataagctacttcctccgtttcacaatataagtcattctagcattttccacattcatattgatgttaatgaatttagatagatatatatgtctagattcattaacatcaatatgaatataggaaatgctagaatgacttacattgtgaaacggagggagtagcatggaacttaactaagagtgctcaagttcaggccgcatcaagtactgctaccaatggtgaaaggaagctctgggagaatgtgtggaaggcagacgttcaaccaaaagttaagatttttgcatggaaacttgctcacgacaggctgcccacttgggagaataaacgaaaaagaaggatacaaccagtaggcatctgccctatctgtggtgtaaaggaggaaaatggtttccatgcgactgttgaatgtacaatggcgagatcgttgcgagaagccatcagagagttctgggcgctaccgccggaaaggaagtttgctatgactgggcctgactggctccttgtcctgttggatagcttgaatagttcagacaaggcgcgtgttttgtacttgttgtggagagcatggttcctcaggaatgatatgatccatggaaaggggacggccacaattgcagagtctgtaaatttcctcgtcaactatgagaaggtactgttgccgatccgacaacaaagcgatgacatcaaaggaaaaggattaatgtataatgaaccaatggtgaaattactgcaggttcagacaaccaatcaggttgataaatggcacgcccttcccgaaggttcagcaaaggtaaatgtggatgctggttttatagaagacacaggagtttcagctgctggaatcatcattagagactgcaggggtttagtgctgtttgctgtgcaaaaaaatcctgtgctactgctgtccaagctgaggcattggcatgtctagaaggattaagggcagccatggaatggattcatatgccaagaatcttggaaactgacagcgtagaggtgttcaaggctctgtcacaacaggagctgtcgagatcacccttggcagcgacaataaaggaagcgagagggatgatgcagtgtctctaaagtgtgcaggtttgcaagatcaagagggaagcaaataggattgctcatgctttagctcaaatggctatgaggtctagatcgtgtgtggagtagaagttgtgtgctcccgcaggaatcttaaacaagatagaccaagaatgtaatcatctcggggatcc

SEQ ID NO: 29904 - DNA, 1296 bp, Oryza sativa
  unsure (1)..(1296): unsure at all n locations
ctttcataatacattccaattatcctttccttttgtatctggtacgtatttgaattaatattttaattactcttatttttttcatatgataacataaatttcataattgtttagtgccctgtgttgttgaacaatatttgaagccgttttcattttatatgctattaaaaacccttttttcattgttggttacacttcttattatgctgcattttcagctgatctttttagcattagcataatattgttattcctatgtccagcaactttataaaggtttttaatactctgtattgttctgtattgtacaggaaacaagaaaggtgggagctttcttcattgaaccactgcacaaataattcctttgacggtacgccattaaaatcctcttttccccttgatcatatctgccactgtagactgactaagttgttttgcattaattttagtagcggttgctgcaaccttgaaattatcttaacttaatagtgagacaagaaaaggaagcgagttgaattgcataagtttttcaataatttgaactgtcaatttgaaagtgaactgtcaatttgaaagttcaacacattgtgcatattcggttgtcttgacaacaatattgatgttatatttattggagtctgaactcctatctgatgttatatttattggagtctcggctcctatctttattattttattcttttatttgattgaatagaataaaatgaagggtgtaatattcaaactatttctttttttatacttcaaactgtagaagatttgccggatatattagaacgagaaaagaagtagtaaaccagagccttacatatgtctgttaaaaggaaaaaaacatctagggaagatatgaggattgatttacataaaaaaagagagcgattgattgaaagatcatgaaacagacagatccttgactattaggctaattttttccttcactagaaaagcgacttagaatccattcttcaacaattgttggaaaattctattgtgtaccagccatatgttccaccacatcatcaacaaaggtatggaattacagagctcactccaccaatctgtgatggtttgcatggcttgctgttctggggcttggaagttcatccaattgcacactttatcctaactatttctacatttatatcgtaaactatatctttagaaatgtgctatttgacttaacatgtcaatgtaggccatgtgatatttcatttanngttgcttgcacttgcagcagccgacccaactttcactatgagtactgtattttttaag

SEQ ID NO: 29905 - DNA, 1250 bp, Oryza sativa
  unsure (1)..(1250): unsure at all n locations
aaaaactatcaaaagattggatgttttcattttaaagtgctngtaaatgaactcaatcatttttgttaaaagaaatatgtgttgctctgataactcaaacagatacacaaaacctaantattccctcgaccttgcattgttttagtttgacaacttctattttctattttatagataaatttataagtactaaaaattacaccgtgctaacgtagtatgttacatggtaaatataaacatatgaattccatttatcataatcgaacaatttaaaatatatcagtggtcaaagtaaagcaagcaccagtcaagattataaaatattaagaaattgatggggtattatataatggccccttaatttgaagtgctatttgttagtaagataatggtttttcactttgacatccctctttcaaataaacaagtcctttgtcgatatttgttacccaaattaccaactttaaattattatatttctgagtaccataaatttatcttacataagcttatgaataaatattagtttatttattctgactagctaatgggtttggaaaaatatgccccacccatcaggtaagattcaattctagccatccattcttttcatctcatttaatcctaggcatcctctccttttcatttcccaactccacctcccataaccattttgccaaacagggtctaagtgttgcacattcagtccttcatgtaattaacatgctgcaaaatttcgtatatgtatttacgttattttgattcataaatgttttttttccttgtagaaagcagggataatatattgggatgatatatatatggaataggggtcacaacaaatgtttacgagccaaaggtgaagcatcattgggttcctagtggatcatggatacaaattgaaaatggcacaggatgtggagatgtggttagtgctagctcttgggtctagccaaacttcagcgatgataactttgctaggtttcatatttttgtcacgcccggaaattcactggtaatttccgaacttatttgtgcataaaatcctcgtccaggaatcagccgaggtacacaaactgacaatttaatatacaaatccatcataataataacgttacacacttataatatcccaaggtatcaaggaataaagtaatcaatgcaaacaggnnnnnnnnnnnnnnnnnnnnnnnnnnnnnnnnnnnnnnnnnnnnnnnnnnnnnnnnnnnnnnnncatggatctaatccca

SEQ ID NO: 29906 - DNA, 1640 bp, Oryza sativa
  unsure (1)..(1640): unsure at all n locations
cgcgcatgaactccagttannnnnnnnnnnnnnnnnnnnnnnnnnnnnnnnnnnnnnnnnnnnnnnnnnnnnnnnnnnnatggggctcattggattgcgacagcgtcgaggacttctctcgccggcgccggagatggcacctccgttcccgtcgaatccgaggcggggttcctcggttcttccgcgaaacgagacaagggcgagagagagaaggttggtcggccgatcggcttatatgcggtcgccggtggaggaggagaggaggagctcacacgcgtggcgcgcgggttctgagccgtgggcccgaatgtgaggctgacaatgggatcccacattgcagccctggcccacatggcagcgactagtgatagataaggagaggagattatataatattgatctgatactggtttctcccattgatttaagaataaaatatctatgtttgacaaggtgaagtactggccaacaccataaaaccaccactaatgacgaaaagctttggaaaattaagtgcatgacaggcaaacttagacgctaattaacctgtgaatttgccagtaaatattaaaaattttcgcacaaactacatcagttccattttatttttctattttgtctgcataagtataattcgtagttgacgttcaggtcggatatataagaatatttttgttttcttaatacgatatatttttatataatagaactgtaataatttattgctacggttattacatatgatttacaaaacatagtaaataatatgcaatattatttaaaaatagatttttattataagtagggaggtctgatgaataatttggttatgctttactgattaagactctagtatcatgaaattcagaaaatgattttttttttacataatgaataaactagttgctgcatctgagataacaaaaccgcagtcaattattacaatgtatttctatatcactttagaagaagtccagtcaatctatagatattgcaacaaaatcaatttcctaattttatgattaaaaaggcaaactaataatttagtgcaggatagcagcagttgcaagttgtggcttccatgccttcaaatctcaatggaccagctggtgtatatcaaatcaaccaatccaacgggacatcacatgactttcacaagaaaaaccagaaaaaccagggcctgagcaccttgtttctctattcaattttttatccaaaagggaaaaatgaaacacacacacaaatccagtttcctgcacattattatcatatatgtttgagaggtatttttgtttaactacataaaagcccacacactttgcggtgagattttgagaagaaaatcaagctaaaatatattaattgtggataaatatttttaatatatttagagctgatatgtgaaaattcttaggaatgaattgaacaaaaaacaataacaacatgttctcttaaaaaataacgacatggttattctagtggttatgtatcttcttatccaacgactgctatctttgctctaatattgcaatgtaatggttagaaagtgttgctttatatnnnnnnnnnnnnnnnnnnnnnnnnnnnnnnnnnnnnnnnnnnnnnnnnnnnnnnnnnnnnnnagctgtcgatcatgcgcg

SEQ ID NO: 29907 - DNA, 5480 bp, Oryza sativa
  unsure (1)..(5480): unsure at all n locations
acggattgtaccccagctnnnnnnnnnnnnnnnnnnnnnnnnnnnnnnnnnnnnnnnnnnnnnnnnnnnnnnnnnnnnnntatttttgttctaaaataaattttattcttaattatcaggattcacatttgcattgagagaaaagacgaaagtatccctcattaataagagaacgtggttgtatttcggtagatggatagataggaagtatgaaagggaactcttctatttacagagagatcaaataaggaaatatgagcatatttatatacctctaaaatttcagcttgatccttttcatgtccctgccgttacatttttctatcatttcactgttaagtttggtggctcatgtctttaatgcccttgatgatttaggtttggaaataagtttgaaaaataatgaaatttttgtttgagtgtatagtatatgcattttatgtaactaatgagactaaataattagtgcggaaaattttgacataaattttaaaaataaaacaaatgtaataaattaaaatttttattttactagaaaagatgtccgtgcgttgtaacgagtgaataatattttaatcttattattattatacaatttagctatggtgaaattcactgtaggaatttgcttggatatttttaagataatcatgagctgcagttaggagtccgattttcatctcaaactagtatgcaagtttttctaaaaagatttcttatacgacttctttcgtattttcaaaagcaaacgaacttaaaattcgacacaaacaccaatatgtatttccaaaagagaacgaacttaaaaccaactcaaacacggatgacgtaccaaaatactggcaaaaatatttttaatttttataatagtagagaaatctaataggacaatagatttcttttgattgggagcattcataaaaaatatcgtgagcatttatagtcctagctttgtatggatgctcctcatttttatgacttttgaacaaataaaacaaatacatatgttttattttattatctaaaaataaattttatcatatactccctccgtccctaaatatatgggattttgcttggatatgacgtatcatagtacaatgaatatagacataaagctgtctagattcgttgtactgtaatacgtcatatccagccaaaattccttatattttgggacggggggagtataatatatcgcacaacaaacaataataataatagtctcatgtgataaacttttacattttcaataatgtaattcataaatttttatattcattcaaaggataaaatggtcatttttgtagaaattagacggtcatctgacgggaggagcatagaatggatcaaaatcaaattttagactatataatgaagtaagcaaaattcagaggcgtagaagggattagctaaaattttaggggtatacaagggattttctctatatattttatgaatatttagtactactatttattaaacggtttttgccgcttaatttgattacctcgtctaatccaatgatgcttcacgctttcgtgtgattggaatttgggaattccctcatttgtttttgcgttggattaggacaggaggggtcttttccttcttttttttttcctttgggtgacaattgttggagatcttttgggggggttggtgacgcgatcgattgcgtggttttggtcggccgtacgaatgttgcagccatgaatttgattgcgtcgatgttggcctcctccaaagatcataggatgcacatgttgagatgggctccagatccagctctcaatcaaaaatttgcagctttatcaaaaagagaatgaattagcgggttagagtgatcaaaagaatgaaacaaagaggtgaaacaaagcacgcgagtaagatttagaagctaaagccctatgaacagacctggagtaataatgacgggtctgattgaatttcatgaataagtttgctctgtccgtagatgtcatgtcgtcatgttaatttgaactttggatgattgaaagcatgaatgcccgaagcacgaatgatcacaaaactaggcgaagtgatcggtcggccggatgaaccggtttgtgtggttccaaatatgctggaaggtaagacagctacttgatgcagcttctttactttaatttcagagccttaattaattagcggagtagtcacggaatcacgtggctgtgcagctgctaatgaacgtcatggagtactgctaattcggtacgaacaaaatagaggaaaaaaataggcaaggaaaggaatatatgaacgtcactcatgactcgtgtattgcatctgcatcataactctatatttcttcgtctctgtgaatagtgaactccgtagctagattgaaacgtactgttaacgaaacaaatgcgcatcttgtcgttattttacttctaatgtgcttgggaggtacaactgaatatactatgcgaataattagacagcagatgctgtgcgatatgatatgccaatatatgtatgtctgctaaattactccctcgctccgattacaaagaagaaccagggtaactttttgatttcagagtagaaacagctcctcatgggtttcctgaaatccgaccgaaaaccgataaaagccgataactttcagtcaatactatacgaaaatcggttaataccgaccggttttcacaaacggagacatagtagtttcacgaaaaccaatcggtttttacagaattccattggttttgtgaaccccgcaaagaacacgttgtttttggcattaaggtacaaactttgattgataacttttattaaaaagatatttcaactaaaactagagtattataaaaaaaaacttttagggcgacccaaacctagagatgaaaacgatcgatcgataatagtctcttctttttatttttacaaaaatagttgaaatcttttatatttatgaatttaactatttaatgtaaacttcaatgtgatgctaatagatagtagaaaaactaatatttggaaactgtacctgctgataaagatattattattatactccctcggtttcatattataagtcgctttaacttttttctagtcaaaatactttaagtttgatcaaacctatagaaaaaattagcaacatctattacaccaaactagtttttattaaaactaaaatttaatatattttaatagatctttcgtttcatgttaaaaatattgctatatttttctgtaaacttagggtgtgttcggaatccccctttcccaactcaccattctctttttccgcacgcacgtttttcaaactgctaaacggtgttttttttccaaaaggtttctatacgaaagttgcttaaagactcatattgattgatttttgaaaaaaaaaagctaatacttaattaatcacgtgttaatggaccgctccgttttctgtgcggagagtttagttccaaactccctagccgcgaacacagccctagtcaaacttcaatttgaccatgaaaaagtcaaaacgtttgaaacggagggagtattaattttgtagaagtggataatatggttggaaaattttcttactgtttttaccggtacccgggccaaacctactgcttctgtgcttcggctgtgtttgtttgggtgatagggagtaagaatgcacatcgttttccgcgcgcacgcttctcaaactactaaacggtgtgttttttgtaaaaattttctatatgaaagttgctttaaaaaatcatattaatccatttttaaaatttaaaatagttaatactcaattaatcatgagttaatggctcacatctttttgtgtatcttccaatctcctcaatccccttctcctcaaacacacccttcaagtatcagacagtgagaactgggaagacttcaagtatcagacagtgagaactgggaagactgaagagatcagtggattatacaaattgtcaaagagcgagggcacgtggagtgcacggcgcggcgccgaaatatataattctgaaggtcattcggggtgatcgataggtgggaaacgagaaatgtgtgtgcaagcgcaagcgtgcacgtctaacgctcacctacagattcttccgtcgtgagagagatgcgtatatcgatcattgtccacttgaccacataattatgtggtgtttaggttactagtactagatgatacagacgtgcatgcagcatatagcgatcatcacgttaattcgcctgttcattactgcttgtttgttggatatagagtaatatgtacaggaactctatatcacaatatattaattaacttaatttgtcgttgatcgaaaagagtagtcgtatactcgtacttgctaccgcacccagaaatggtcacttggaccacgttctagcgtggcatatgctcgattgcccaatgtggggatcccaaagccacatgcatagtagtactgtgctgagtcagcgtgatgcgacaacactgtaacactccaagtacttcgtgtgaaaggaatgcaccattataaaatactagcgtttgtttagtttacgttaaaattgaaagtttagttaaaactagaataatgtgacggaaaaaagttgaaaattcatgtgtagaaaagttttggtgtgatagaaaagttgaaagttttaagaaaaattttggaactaaactcggcctaacagttaagtttactaagagcaagtagtttaataatatagcactctaaattatctatagttaatttaatagctaatttatacaatagttatctataaatatatattataaaattaatacctgattccacctatcatatacacacaggtatcttggaatccatactgcagctgtctataagtctatagtccgctgcttttctctttattttttgtcttctcgaaatgtgtttatagctagcttataatatacaattgtacctactcctgatcactgtagctcatatagctcatagaatggcacacattaatctacaattaacaataatgccgttctccataacaaaacaaagagagaggatattaagttaatttgcatcgatctagaaccacatgaatttcacgtgaggtggtactttaatcgccggatgaatatacgtcaagacaaattcgatatgtatgttgcaaacaactgggagcgattatttgttcttccccatacaactactagtgcatgattgtggggcttcttgtcctgttccctgcttctggccccaacaacgtttctttcttctagaagggagtcttgtactgttgctccctttgtcacgtcattctcgaaaggtggcttatcataaagttcacgacatacttaaatacacgtgttttgctatggataaaaatgaattatacatatgcacattgtttagagcaagttggttgtaannnnnnnnnnnnnnnnnnnnnnnnnnnnnnnnnnnnnnnnnnnnnnnnnnnnnnnnnnnnnnnnactagcgtgtcatcaatgccgt

SEQ ID NO: 29908 - DNA, 1609 bp, Oryza sativa
  unsure (1)..(1609): unsure at all n locations
cgggggattgnnnnnnnnnnnnnnnnnnnnnnnnnnnnnnnnnnnnnnnnnnnnnnnnnnnnnnnnnnnnnnnnnnnnnnnnnnnnnnntcgtagacgcactcgaatcgagctaattttggaacagaaacataatcttcagttggaaacaagaagtggattcagaatcgaagcaaacttaacaaaaagggaaacaaaaatgaatctgaaatgattggggatcaaatcgaagttaaaaaaaaaaacacccgatgccataaacccaaaccaaaacccagagcgtgaacatttcaaaaccgccgccgccgccgctgtgtcccctagcgccaccggcccgtgagagagagaggaagagtgagacagtcagacagagagtgagagagagaagagagagaggaagagcgagagagagaagagagaggaagagtggaagaggagtatgacaggtgggtttcatattttttaataaatagaatgctgactggattatcacgcgtacaccacgtagaccaaaaccaccgcggattgggtcgagggggttaattcgttcggtatgcatagttgggtgtgaagaatgtccggttttatgattaggggggtaattcggtcgaccactacagtacgggaggtaattcgtactttttccttttataaaggatcctagtggttacaagagcctcagtaacatcttaggtcctgggttcgactccacgagggagcgaattttccaagatttagcggcattgtgctttcagtggtaagcgacgtacccgtcgacaacgaggcgtctgtggtgatttcttcaatctccaggatttactagttcagtcttcgaagatgctcataggggtagggttttgcgtgcgtgtgttagtaaggatgagtgtgcgtgtgctgtgagtatctgtgttgtgctgtgtaatttaaaaaaaaaagaagtacatacagttgttgtaaaaaaatacaactgagtttgtgggtggtagatacgctgccaccatcattatcttcacttgcgagttgtgataagatcatcttcacttccattcgtttttagccttcttgcatgacagcagcaggctgtctagctagtacagggaattttatttccgtatcatgagatcgagtttttccataaaccaaaggcaacagctctaaacgtgttatttcttatagaacaaaaacatccgaatcggaagcattagtggcctcataaacaggagcatgaattaattaacaacatggatcgaagtgttaaaactagattattctttccaatcacctacttattaaagaccaaacgacagctacgaaagagtcacccccgatcgaaactcgaaattaaagttgtagtccatccaatagtcatattttatcttagcacacagaccaacgataagtgtttctacttatcatctatttaaacatgatactagtcattcctcgtaaacaagcgattcattaatatttacatttctcgatgtccatgtagccaatcttgtgtggaagaatggagagtcacgcattaannnnnnnnnnnnnnnnnnnnnnnnnnnnnnnnnnnnnnnnnnnnnnnnnnnnnnnnnatggagagttgcagtcaagcgcgt

SEQ ID NO: 29909 - DNA, 2085 bp, Oryza sativa
  unsure (1)..(2085): unsure at all n locations
ntaagacattattagttaaaccattcactattttatttcattagaaaactattttttcgccccttgacaaaattgaaaaagctatacatactaacttttttttttactaaattcttactaacaataatgtgtcatgctataagtgtatctaattttttttatgatttttatctatataaatcaaacggttgagatgattattagtaaaatttagtaaggaaattttaatacgtgtagccgtgctcgataaaaaaatgtaaccactcttaacaccccgccccccggccctgcccgcgcgcgcatttaaacacaataatcctttcttacacacatgtaaagggttcaagtacgttgatctttttctagattaggcgtgaaataaattcacaaagtttgaaatatataaaattatcaaactagatttaaaaataaaagcatctgcattaacagaattacataaaaataaaccttgcattacataccattgcaatgtcaaataaccttagcaatttatattatttagataattaattattataaaggtctagagggctaaacaattctagcaaatttcttaatgttgtttattttgttttcatattgatgtgataagattttgaggtttaacaaaatgtcttatcaaaaaatgtttttcaatgcatggaaattaaaaagagactacttcctctatcctaaaaaacttcattgattttacctatgcatctgaacaattacttggccaaattcattggcagaaataataaaggtgggtttttggaccaaagttgcatcttgataagtacttggccaaatttggggttagaaataaagtcattttcttggacggagatatataagaatgtctgcctataatttgtatgtgctaatttcaagttaaaaagatacatggaggaattttcaactagtgatgcatctacgatctagtatatgggtggtccaacccaatttttttttctaatcacagtaaatctaactatcctaatatatacaacgcatgtataaatgatagaagagtaaattccctgtgtacccctgaaaactcactcgatccctttcatgcctctgaaatttacccgatcccttctatacccctaaaatttcaacttgatccctttcatgcccctaccggtacatttcccttcgtttcactattacgtttggttggaaatttctattttgcccttaatgctttaggtttgaatataagcttgaaaaacgattggaatttttgtttgagtgtatgggatgtgcattttatgaaactaatgagactaaataactagtgcagaaaattttgacataaattttgaaaaaaaacaagtggtataaattaaaatttttatttgaaattttagtagacaacggattttttatagtgagcattagtagtcctatcttttagaatgcttttcttttttatgacttttttaaaaaataaatacatattttttattttattatctaaaaataaattttgtgataaataatacatcacacaacaaccccataactataatagtctcatgcgacaaactttcatatttttagtaatttaattaataaatttccatgtttatccaaagggtaaaatagtcatctttatagtaattagacggtcaactgaccgcaggggtatggaagggatcaaattcaaattttggggatatacaaggaagcaaccaaaattcaagggcatagagtggattagcttaaaattcaggtatatacaacggtttttctcataatgaagaatggaccataagtgtaccatgatattttaataaagcatcttaaaacatataaaattagtaatatagctataaaagtttgaataagatcaccatattacttttaattcttatcggatgtacgtcttctaatggccatgaaagtgctcattatatcttcttcatccccatcttgttcttgagtgtgctcgtctaccataaccggggaagaaagcaatttagaagcattcttctttgctacatgttttccaaaaagagatgcaatcaacaatctactatataatactacaatttaatatcacaatgcaaccagagt

SEQ ID NO: 29910 - DNA, 1947 bp, Oryza sativa
  unsure (1)..(1947): unsure at all n locations
ccctaacatatcatatatgttgatacatagaccccatgagatgcccatttatataccatccagtattaaacacgttttcttttgctgccaaatttaccaacgagaaaaatatacaatacctaccgggctgcagcaaatcaggacaacaacctcttgaagaaccgcggcagtagggcaagaagcggcagcgctgtcgggcccggtcttgcggcgtgaccgtgcgagggaggcctgctgggtggggaatggtagggctagggatttggtcggggagctgtggacgacaggacacgggaagaggggaggaatgggggagatgagagcgagagagagaagggcacctcgtcggcggcgcgcgtgcttgaggtgcagaggtcggcaacggccatgccgtggcagcagcgatgggaatgggggcaagggaagggaaggtggggggattggatggttcgagcgactcggggagggaagtggagcggagcctcccgggagataagatttgcgcggaggcatgcgtggcctacgcattggcaccgctggcttccatctgggccgtcggcttcccagccgacggagttggtgtcggggctcggggcatggtttttgcgttttgagggaaatgcgtttcatatgtttccgacgaggagtattctagaataatacctactacatctagaatcatgttcattatttattagtgttgtttttttatttctttcgatgaaagtaggtaaggtgtctattttgattggtaataaagaacagagtttacataaatattacatatgctctagcagataaatagttaaaacataacgattttttaccataacggtggagggagccaaactagaaattaagaaattgggagtaaacattaaccaaaagtgcatgtatgattgttatgtaagatttattgttatatatttcaataaacattattgtaacatgagtcatgtatcttctcgtttgcagaaataattgcatgggtgaagtaaagggggcgggtatacacagtgcttggatgatcataaagttgatcagggactaaccaatatccttccccaaatctacttccatgataccacgtcatttctcatctattgaataccagagataaagttctacacttttttatttggattcgggcctcctaacagcatcaattttaaacggacatgccgctgaactagacggactcttagggtccataagtacttgttaaaatgtttatggagtctactttcaaatagttttggtcccatgttaaaattcttccttggatgtcaaaaatctgcaaaacaagccacgtgcatcatccaatttgagtttgatttgggccttagaccttgtaattatgtcatgggataagtccaaggactggacaccctaggacatccctaatcatacttattcaatagccatcaaagtttagagtggtttttctatcgtcatgcagtttcaacgctagtcagtttgtagaattctaacttcaagttcttaatcattcatctacaattgagttacaatcgactttgttcttgcttgtgtttttcgattcgcatatagagattatccttctcggcgaagtcaatcaggttttaaactattgataaccaaaggagatatagaattatgattggagggtttgaaatcatgttgattggaagctggatcttgtatgtcaagtttccgcaaaaatcgataattatcttcacttgatggaagatcgaacactcccttgtcatcaatcgatcaagatttttgtcatcatcgaaactttcgatgttacataaggcaaacgctaggatgtaatttatttgttgcttatgtagcaatagatttccttatatatatgtannnnnnnnnnnnnnnnnnnnnnnnnnnnnnnnnnnnnnnnnnnnnnnnnnnnnnnnnnnnnnnnngagggtgtcaatcaaaggcgcg

SEQ ID NO: 29911 - DNA, 1594 bp, Oryza sativa
  unsure (1)..(1594): unsure at all n locations
ccccaaccggagacgcaagaggcatgnagatcggcttcctcttccccggtgtcgatctgaagcngtcatcaccaatccctccttcaccggtgagcgcacgcattgtagaggcggtcgtggacggcgaactccacggcatggccctgctccagcgtgacaccgctgctgccatggaggacctcgccgcgaaggcggaggcggagcataaggcgctttgagtagggctcggtgaagacgaactccgcggcggcgaggacgacgccgaggcggtcgaagtggcagaggaggagcctcatgagctccggcgacgggcagtgcagcacgtcggcgtgcgtcgagagagagagagggaaaagaaaagaggagagagagagaggaagccgtgtgccgggatgccgccgtgcgtcgtcgccgtcggcggcgaaccctggtgatgcgccgccgccgccgcccctctgtggccgagccgtcctggctcgggccggccaccatcgcgcctctgctcggctcaatagcaagcgtgaggaagaggaaggggaaaagaaaagaaagagggaaggggcattttggtacttacacaactctttctctctccattttaacccgtaataataaaataatgggagaagtgtccagcagctaattactacttttttacagtgtccacaatcaaatacacgatcttcgggtgtctcacagcaaaatccacaatctttcggtgtactgtagcaaattttgcctttgtgaaaagttccctttctatagaacctcgaccggggctgctccactagctctcttcttcccctcaccttgctcttctctagcaaatccttgtagtcttgtgagcggtggtggcaggtgtatcctagtgacttgcaccaagttcttctcctgttatattttatagatgcaatttatgtttataatagacaaaacttagcaattctggacctcattaatgcacacacgtccgcgtaatagctaggtatgatttgcgcttcttaaattcattctttttcagttttacaaatactgtcatccttgatagccccatgtatttacattttacttcattttatttgtgtccttcatgtcgtacttagagttttatttatagctatatatgtgaaaatttatagtatctgaagttcccgtgaatgcaaggattaactgtttgtttaaccaaatcctgcagtttgttgtagctaaattttgtaccctatagttgtgtgctactcgttaccacccgcattttacattatcaaaagtgcataacagacttttaaatctgaatgaattgtcgaaacatcataactaaccgcacgctagcttttttggtttacttgtttaaccgacttaattacttcaaccatccccacaaaaaaaaaacttacttcaccataaagtactgcttttgtatgaatgatttgtgtatattttatattaaacatttttctcatctagagtcgacgtcacttcctcatcatgtttatttgatttgaaagggnnnnnnnnnnnnnnnnnnnnnnnnnnnnnnnnnnnnnnnnnnnnnnnnnnnnnnnnnnnnnnnnnnnnnnnnnnnnnnnnnnncacg

SEQ ID NO: 29912 - DNA, 966 bp, Oryza sativa
  unsure (1)..(966): unsure at all n locations
ccgcgaatggnnnnnnnnnnnnnnnnnnnnnnnnnnnnnnnnnnnnnnnnnnnnnnnnnnnnnnnnnnnnnnnnnnnnnnnnntgcgtgcaaagcccatacatattctacgcgcaactgtcacgcacaaaaacgaagtttttagtaccacatggaaaatctatgacgactgacaccggcataaaagacgacgcgctcgcatcgctcctggcgagctcggtggcgtgagcttgttaccccagctgcgggggggcgggagttggcatgtttcggctgctggagaaaatgaggtttctccctcgatcgaatatggatgcaaacatcctcccgactttggcccacgagggagggaaggtgtgagtcaccctgggctcttgacggctgcgtcatggagcgaagaggacgctgaatcgtgggagaggtgtgtggtggccggtgcccgacgacggcgcctggcgatgcgtggggagaaggcgagcagttgtatgtgaagaggacgctgaatcgtgggagaggtgtgtggtggccggtgcccgacgacggcgcctggcgatgggtggggagaaggcgagcagttgtagttgggacccgccacaccccgcacgtgcgcaagtccatgacgtgagcgctcccggtcattaggagccacgtcagctggcggcctccgccgttgagcttttccctgccaaccgacaccctttttcccacccattggcgaatgccctatagggttgggttgagataggagtagaggggagtgaggtggaagaagattgctaggtggcttgtgggctccacgtgggccctgcactgactcaaccaccacgttaacaaaaccggaaagcaatactaccttgggattaaaagtggaccgttttgcaagataaggggtcagggcccgttaaaactcaacgacaagataaggaccctagataacttttttggagatgaggcgcctgtgcatatt

SEQ ID NO: 29913 - DNA, 1689 bp, Oryza sativa
  unsure (1)..(1689): unsure at all n locations
cgcgattgtcgcccnnnnnnnnnnnnnnnnnnnnnnnnnnnnnnnnnnnnnnnnnnnnnnnnnnnnnnnnnnnnnnnnnnctgctaccgctgggcagtggtgaccaggttggtcatgttgtccaaccatcgctggacaggggtctccggctccgaatttatggggggatgccgtagaagggctcccgccgcctaaagtgcgcctcgggatgagccgccgttgccgtatgtcaggcggccccgtgccccgacactgcgcggtttctccccgcgcggcggcggggagaggttcctccctctgtgggggggtcgcggtgggcaggagtgggagagttgttgcgacggtggtgggggccgcggctcccgctagcatcgtcactcccggagggagtaggggtgtgcgccaccacttcttcctctaggacctcgaccatgatcgttgaggatggagggaaacttgtggtggaaggaaacgatttctctttcaaacgcgcgaattccccctacctggcgcgccagctgtcgaggaatgatcctctcttgcgggtgattgagggacccccttttgtgagttcggccgggggaaagggcgcactgatcaagaacgtatatctgcctagagtctttcgagaccgcgtgtgagagctgggattgtacaagttcgggccgctagggagcgtaataccctactcctgtgcgtgggatttaagggttgagtgttacaaaggtttctaaactccagggagaactcttactcttcttcctctggggcttaggctaagtgagagtcatccccccttttcagtgggcaaggtcctccttttatagttcaaggggataccacatgcaccgcctctacctactccttcaagggagggggcccacgccgcttggagcggaccaccattcgtgccttcaccggaagctaagcagccgtccgtcctcgagtggggcccagcgccgtcccctgcctgacacgggggacgcccttgtcattcccctttaagtgaatggagacttttggcggttcacctcacgtggagggggctctagacgatgcattgatgggacggggcatacctgcccccactccgccgagcacagggcggaacgtgggggcaccgccgcccgtccgattggatgtgatcggccacagaccggtcacgcccgattgacgcgggtcaatcgggcagcgccgcacgtccgccctcaccgcattaaatgcggtgtgggacggttggggtgctattcattgatggcggctcagattcggccaccgccccactcactccccccgccacgtggcggccgggcgagggcctcggggcgaggcagcctgagggtcaaaggggcgtgacgtggcaccccgaggccccctggctgcctttgcgtcgtccgagatgtggggggagggccaggctgtatggccgcgtggctggacgggattgagacttccccatacttctcatatcctcaggcccatatcaccgacaattattctcacccctagttagctaatgtaactagttagttcaggtggtggtttgggcttgtctcaatgtggtgtagtgttaaacagtgattggttaatattgattaaatannnnnnnnnnnnnnnnnnnnnnnnnnnnnnnnnnnnnnnnnnnnnnnnnnnnnnnnnnnnnnnnnnagtcgtaccttcaatgcccag

SEQ ID NO: 29914 - DNA, 1757 bp, Oryza sativa
  unsure (1)..(1757): unsure at all n locations
tactgcgcctnnnnnnnnnnnnnnnnnnnnnnnnnnnnnnnnnnnnnnnnnnncaggctgtatggccgcgtggctggacgggattgagacttccccatacttctcatatcctcaggcccatatcaccgacaattattctcacccctagttagctaatgtaactagttagttcaggtggtggtttgggcttgtctcaatgtggtgtagtgttgagcagtgattggttaatattgattaaatactacaactgtttttactgctttcaactactgcttttaaatgcaagcattatgcaaatgaaccgctagcctcctttggttatatcttgcatcatacctcctcttccggtatgacttgttgagtacagtgggaagtacttagtcttgctctctcttccccacaccagagttgaagttcttcttagttggagatgtctcgaagaaattggtttcgtcgctgccgtcaaggatgcatgtggagtcaagtcttcaggcttagctggctttcatcttttccgctgcatttgtaatcttttatatttttgtaaaacgtggatctgtatttcaacaattgtcgtttgtataccctggctggttctggacatgggtttaatgcacattcagcttagaaattctggttcgtgaatttctgggcgtgacagttgtccatcattcttgacaagatgtagtgtacaaggcattctttagttgagcctcgctcactttgcatcacagaagtataacctagacataactaattcagtatagaagcaaaatgtgcagcagcaacaataagggtgaaaactagaaagaaggatttatgatgcttcttagtttattcagtcacgaaagagtgactttaaataaatgtacacttcttccaaagtgaaaattatgagatgtcttacttatggaatgctcctacacactaaggttgtgtaatgccccgagtttcgaattagtatatttcggggaatattagaacaaatgcgcaaaagttcaatttttttaaaccgttgttcgaataggcgatcaggaaccatggatgtatagagctcgtcaagtagtgcaaaatatactaagtcccggggattgaaacaatgtgggacgttggatctcctttttgtctctttatgtaactaaaagaaaaaagaaacaacggttttgctaaaaaactggcgacagttttttctttagaaaactttcgattttctagccattagatgcactccaggattcgtgcaacatatacggccatatgggtagaataaaaaaaatctcgtgtgggctagacaagcattgaacgagctaggatctatccatcaaacttgccacacgttacgctgaggtacgggcactttctgattattaatagcatttgtagttatatatcacttacaccctaggtacataacacttatactctagttacatactctagttagttacatagcacttacaccaactagagtagttacagggtaattacatggtataaaattaggatttgtaatttttttcagggacatatatatgcatattacttttgaattgaaagttattatcaatttgggcactaagactcgtggtttgtactagtgcagactgttttcctgtaatcgttgatgacaaatcctatggttgaaaaatttgacagttctggacctaaaaaactgtnnnnnnnnnnnnnnnnnnnnnnnnnnnnnnnnnnnnnnnnnnnnnnnnnnnnnnnnnnnngaaaactgacgtacaatcgcg

SEQ ID NO: 29915 - DNA, 1381 bp, Oryza sativa
  unsure (1)..(1381): unsure at all n locations
agcgaattaatttcttctannnnnnnnnnnnnnnnnnnnnnnnnnnnnnnnnnnnnnnnnnnnnnnnnnnnnnnnnnnnncggatggatggtagggattagggacgatgatttggcctgaagcattgctaggctcaactcatcctttttatattagtatagatatagatgtacaattcttccaaagttaaaattatgacatgtcttacttatggaatgctcctacacgcggaggttgttcttgctgacactctcgtttctatgagaagttttttctaacatagcaagtcgatagtttactgccaataaaatggataataagcctgatgtttcaacaaaactagagaaactcacgcatgatatacccaaaggaaaccggttcttgacacactacaaatctgtggtagttcttttctatcttaaaaacgaatcaaggctgtgtttggaatcagctgttcccaacatgcaaagtgcgcacggaaaacggagcggtccattaaagcttgattagttaagtattagcttttttttcaaaaaaatagattaatatgattttttaagcaacttttgtagagaaactttttacaaaaaaacacaccgtttagcagtttgaaaagcgtgcgcgcggaatacgatggagatgggttgggaaccctggattccgaacacagcccaagtctatccaaaaagtttagacaagaaaacacgtaacaagttggtttgcaagaatacgaattacgtcaatcctgcactataggtagagcaaaatggtgatttctcgtaaatctctcgaatggtgatttaagaatttagtgcaaacctaactcttgctataaaatcaaatgttcggtaccgtatcaacggaacaataaaaagcacttggcgtaccataattttgtcattcttgttgaaattttgtaacataaaatgcatgaggccacacgaccttaatgttcaacgtgtcatgcattagtgaaataatagcttacaaaacataacaaatatagctagataacggttgcaatccttaccaaactaacgtataaagtgagcgatgagtcatatcattatctttctagcctgctaaccatcacgtacaccttccgatcccaaaaaatgacaacttctatggatgaacctggacaaggtttagggtttagggatgaatctggacaaatgattgtctaggttcatccctagaagtgggtttctccttatgggacggagggagtatatttgatggacacaaaagttactttcgtgatgaaatcaaaggggatttgttgaggcacctaatnnnnnnnnnnnnnnnnnnnnnnnnnnnnnnnnnnnnnnnnnnnnnnnnnnnnnnnnnnnnnnnnnnnnnnnatatattgccccag

SEQ ID NO: 29916 - DNA, 2212 bp, Oryza sativa
  unsure (1)..(2212): unsure at all n locations
gcgcgcattgnnnnnnnnnnnnnnnnnnnnnnnnnnnnnnnnnnnnnnnnnnnnnnnnnnnnnnnnnnnnnnnnnnnnnnnnnnnnnnccataacttggccatttgaacacggaattggaccgttcaagtctctaatttttccttaagaagtcaagaacccatttttgtgctttgtttctgcttgttatatggagtttattagagtaaaagccttttctttttcgttggtcgtgtagacgctgcagcttcggaagatccgctcttcgtggaagttgaagtcgacgtttgggaaagcgagcaaggcaagtcacatcatccttgaacacattgaatcccagtttataaaattatattgatttaaattattgcattatcgctttatttaaattcccgcgttatcactgttttgtttagccatgcctatttgcctttgtatgaccttattattgttattgttattattaccttgttcaccctagaataaacaaaaccccaactagtggacactctactcatggtaccactagtatgaatttaggtagatgcttcgctggttaattaggcaacattaggtggttttacaactctagactttgggaatattctcatcacctggacactatggaatggatggattattgggaattggattcacacctccccctctattcaaaaccctcaaaatggttttaggctgggctcggggtgcatggttttgatagtagcacctcggccataaaaggaccagtcttcgggcctctgttgcaaagcactaccgtacttccacatgtctagtggctaaggcttagtttgtggctcagtctggttataaacaaaagtacacggatggagatggacgaagtcgggggtcaatggacatctctagggcaaatgaaggctacacgagctgcggcccggtagtcgagatgtcatggcacagggccggtgtcctgctgctaggggctcggtcctgcctacctgtcccgaaggttccggccgtaggtggggttgggtcggtaatcttgtctttggctgggttgggttggaaactatgtcacgtcttccgtccgtataccgtggtggtatgtggcacgtggttacacgtgagaaagatgtgtcttgtgggtaaagatgtacacctctgatcagagtataacctattcgaatagccgcgccctcggttatgggcaagcctagcaatgtacccaagttattgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggactgtgtttacaaagtaggttggagcaactaagtgacttttaatgctgtttactgcaatccctaaccccctatattatggctcccttgtactcccttgcatttattctgcacttgtgggtatgtcttgctgagtacggtggttgtactcagtcttgctcaatttttcccaaacccagaagaggagttcctagaagatgaaggttttggtgtctagctcgtgcctgccgtcaagcacctgtggtagtcgccctagtcttccgctgtttcccgtttgtctttgtgtgtgctgggccttcgccgcccatgtaataaattaattatttacgcttcctcttgataaactctgaaatgtatcaacttttggtgtaccttgcctcctgggacaaggaataatacacgcacgtaaggaacgcccgttgggttagttccggtcgtgacataaggtgaactagtagattgatagagagcttaatacacttcaaatagatgatattttaatataaagggcaaatttagacgatcaagacccaagtagtggaaacacgatggctaaatcaggtaagatcggctgaaactccgatactaactctattagcattcatagaaagagctagataaaatgtttcaagacagtacttagtagatcgaacctaaccaatgcagcattaagtgtgaaaagaaacataagatctaagccagaacgatgaagactcatttgatatggtagatataccgcataatctagcttaatgttgatatctaaatctggccgcccgtttcgatgatagaggctatccgatgagattagattaccaa

SEQ ID NO: 29917 - DNA, 990 bp, Oryza sativa
gagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgcgccactgtcgacgtttgatgtcgcgattccggtatttgcatagtatggggatcgtcggtactaggacatacgcgagactgaggtaaaagagacagaggcgacgatttttatacaggttcgggcccctgaattgtcaggtaataaccctatatcctgttggccgaagccggtattgctcttattcaccataatcacacgagtacaatatttggggtagcctatctaactgttgtcgacatggcggtctgtatgtctgactcgtagtcgacaacagggtagtattcatcctttagttcctgcccggcaagatcagagatagcacttttgtctctcctgacagtatccagagacagggtaggggactagccgggctaatccctgaagcggatatccaacgggttgcctgggcggaggtgggtttgaaggtggggcgtttggtggttcccgggattgtgataatggccgcggtgaattagaggggcccggtcccctctctctcctaaggggtctggtttatataccaaaaag

SEQ ID NO: 29918 - DNA, 801 bp, Oryza sativa
  unsure (1)..(801): unsure at all n locations
nagggaatttattccagagccaatacctaaaatgaaaattatagctctagacatcccaaagcggtataaattagtaggaaaatatgtccgtataatccaatgtatttgtagcaaaatgtatatgattacccagaaaattgtcacatcctgatttttgtttcaggatttctaaattatttaataaattattattagaatttatattaaatgttcattaattacaaagtgaagttaaatgtgggaaataaaatttcctaaatttaaagcatggatggatttaacttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaatatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaattaaaaaaggtttttaaaagtctcttttggctttgggccgaaagccggcccannnnnnnnnnnnnnnnnnnnnnnnnnnnnnnnnnnnnnnnnnnnnnnnnnnnnnnnnnnnnnnnnnnnnnnnnnnnnncaaaaganntcgc

SEQ ID NO: 29919 - DNA, 814 bp, Oryza sativa
  unsure (1)..(814): unsure at all n locations
aggtggtcatccgatttcttctctattcaccaaacgcagtttcgttgaaatttaggtacaaacttgtagggcctgatcatcaccctgcaatcgtctgttcgtacaagaaggtcatccgttcctcacattgcaccaaagcctctgaataatgatcaagaacgctggaatgggtttgagtaacgtacagattctcaaacttcatacagtcactatcatataaaggtcatgttgatcatgcttcacaattgagcaacattctaggagcattcattcctgttcccattgcagcaccattcaaaccagcttctccatatttatcatatattgatcgcttctcatcatcagccaagacctgcaatcctatttatgttagaagcaaggtacctgtagccctacgtcagcatagtcataagaacctctgggatttggttatggtcagctgtactaacctcataagcattgctaatatccatgaacttttgttcagcaccaggatctctaaagaaaaatacacaagcatcccgattgcgttatttgattatgtagttatgagaaaggtaatgcaccacctagtaatcaggtttataatggatcgaaagcagataaagaagcaatatatcgagtgtatctgaaacgcaattcccatataatggttagtgcacacttgttcacctcaggatggtagctcccagcaatcttcttataggctggaaaagaaggaccattttagnnnnnnnnnnnnnnnnnnnnnnnnnnnnnnnnnnnnnnnnnnnnnnnnnnnnnnnnnnnnnnnnnnaggagtatatttccgctg

SEQ ID NO: 29920 - DNA, 1484 bp, Oryza sativa
  unsure (1)..(1484): unsure at all n locations
cgcgattatgagaccctnnnnnnnnnnnnnnnnnnnnnnnnnnnnnnnnnnnnnnnnnnnnnnnnnnnnnnnnnnnnnnnnnntgcatattagtttcaattgaaagccatcttgttgtccatccttcctgacaagatgtagtgtacaaggcattctttagttgagcctcgctcactttgtatcatagaagcataacctagacgtaactaatttagtatagaagcaaaaagtgtagcagaaacaacgagggtggaaactagaaagaaggatttatgatgtttcttagtttattcagtcatgaaagagtgactttaaaaaaactagtaatcatgcacgtgcaaggcacgtttttcatattacatatggcatcaacgtaatattttgctgtcgcaatatgtatataagacgatttatttcaatgtggtgataaaataaataaaccaagcttcatgttaatccccattcaagctaaaaaatgcaaaaaaaaaaagagagctcattgttgcatacgatcggaatacaatagcgcatgaaatctatgttggtaaaaaaataaatcactgaaacagagaaggaattaaagtttttatatagtcaagtcaaatttgaaagagagtaatgggttttgaaactaataagaatgtattattataaaaatgttgttattccatatatttccaaattgaagttggatcatccattaagatttctttgagttgattatatactacgggccctcagatcgaaaaaaaaactcttctcgaagttgaactccatttaacatacatggaacttccttagtattttgcgaacatcaatttcaaatattcattaataagaaacatacgtagtatttttctgatttttcaagtttacgacttattgtttaactgtcattcatttgttttgaaaaaaaaagcaattttcaattgatatagcacagccgcacaccccttctgagatgagttctgattagcatctcctgataacatggcatctcttctttacaagcatacaaaaggacatacatcagaactatttatgttaacaccaaataaatggcagagaaataactaattttgatttaattagattaagacagtcacaatatccagcttgcgcttgttgccggcgttgttgattgactgcttgctcatgctgaagtagcctatgaagatctgcacccaatgtccctacatcaggagcagactttcttgtgttaagttcatgagagcttgccaggcttgtgttaagttcatggcatctnctgaagtttatgcattcatcatctagctttatctcacattagatggagcaagctggggtcttccgatagcatcataagttggtgacccttcgcaccgtcgctgctatggaaccatgaagaagtgtctgtgtcacctattcatattggaactataattttggtataaagggtttttaaagttttttcccccagaggggaattattttttttttttttt

SEQ ID NO: 29921 - DNA, 1458 bp, Oryza sativa
  unsure (1)..(1458): unsure at all n locations
cgcgcccattgagnntttgattgaccattaggcgacacattgactatagggccaattcgagctgggtgcccttatcaccacattgaaataaatcgtcttatatacatattgttacagcaaaatattacgttgatgccatatgtaatatgaaaaacgtgccttgcacgtgcatgaatactagtttttttaaagtcactctttcatgactgaataaactaagaaacatcataaatccttctttctagtttccaccctcgttgtttctgctacactttttgcttctatactaaattagttacgtctaggttatgcttctatgatacaaagtgagcgaggctcaactaaagaatgccttgtacactacatcttgtcaggaaggatggacaacaagatggctttcaattgaaactaatatgcatatatgaaagtcattaatataccattgtttaaaactttgaaatcatatcttgatgtcgcttgaaacaacatatttgcatgaagtgacacgtttggtcgacaagcgcatgtcatattcacaatgatcatgcatatgcggcctttcatatgcgcttattttagtagtggatgaagaatcaatgtggattgctacatctttacgtgctttgtatgttcttcgattttgttgtagtggatttagtatttgccatatgtgcttcgtgtttgttcttattggaattaaaggatggacatcctttatacgctccatttatatcttaaagacaaagtagcttcggatcgaatataagcacacagtaaaattgtagagtaccaatgatggtaattagttacgacgatgtactaggatatatcaccccgagtttcacatgtcaaatatgatgatatctgagcctatttttaacttccaaaccactatattgttaaaactcagtacaataaaccgccaagggtggtaatgctactaggtgcactatagtacctagggtagataccatatctagatggcaagttcaaagccaacagagcttgggctggagcttgagccagattccgatcaaagtagagatcatcaaactgctggagttgtagctgctgcgctatgacctgaaaaatgttaatatcctcatagtgagactgttgcgccaccagccaaagctggtgccagacttggttgtttctcagttgaaacgcaactgattgcaataaggggcttgccgtatgccatactgctgccttacgaactcattatatgggctaagcacctgttgctgtagcaggagaagcgactgcagctgatattgcctataactttgacctaaaacatcaaactgcgcagaggcgctgcatgcagcaatagtaagaagagcaaaggcgaaaatgatcttcattgctacgggacactagatcttntctttttgctgtataatgccttgactgtgtgaacgatggngagggtttncattgcgcttgtctatttat

SEQ ID NO: 29922 - DNA, 1001 bp, Oryza sativa
  unsure (1)..(1001): unsure at all n locations
cggttgcttttgaaaatacgaaaagaagtggaataaaaattcttttaagaaaaccntgcatactagtttgagataaaaatcggactcctaactgcagctcatgatatctttaaaaatatcaaagcaaatccctcaagtgaatttcaccatagctaaattgtataataataataagattaaaatattattcactcgttacaacgcacggacatcttttctagtaaaataaaaattttaatttattacatttgttttatttttaaaatttatgtcaaaattttccgcactaattatttagtctcattagttacataaaatgcatatactatacactcaaacaaaaatttcattatttttcaaacttatttccaaacctaaatcatcaagggcattaaagacatgagccaccaaacttaacagtgaaatgatagaaaaatgtaacggcagggacatgaaaaggatcaagctgaaattttagaggtatataaatatgctcatatttccttatttgatctctctgtaaatagaagagttccctttcatacttcctatctatccatctaccgaaatacaaccacgttctcttattaatgagggatactttcgtcttttctctcaatgcaaatgtgaatcctgataattaagaataaaatttattttagaacaaaaatagtaataatccattacacctcccgaaatttcgcttgctcggctggatcctctgactctcccagtctccacgcccacagccgcaacaactggttaaaaagatccccgcgacgcgcacgcgacgcgacgaccacccagccacgcgcgacgcgccgcagcagccgcgcccgccatggcgaaccccatcatcccgagcagcagcggcagcgacggggaggaggcgaggaccaagctcgggcggctgaacgcggcggtggagcgttcgtgggtcgggcggcggttcaagctggcggcgcgcgggtcgacgttcaccacggagctccgcgccggga

SEQ ID NO: 29923 - DNA, 1602 bp, Oryza sativa
  unsure (1)..(1602): unsure at all n locations
cggagaaaaaccctttttttttcccccccccgggggggggggaaaaaggccccgcccacgncttacttctgggaggcgctcttcccgttcctgtacgtgaacatcctcgacaccacgggggggctctactccatggcgaggttcgccggcttcgtggacgacgcgacgggggacttcgagggccagtacttcgccttcatgtccgacgcgacggccatcgtgttcgggtcgctgctggggacgtcgccggtgacggcgttcatcgagtcgtcgacggggatcagggagggcgggaggacggggctgacggcgctcaccgcggcggcctacttcgcggcggcgctgttcgtcacgccgctgctggcgtcgatcccgtcgtgggcagttggcccgccgctggtgctcgtcggcgtgatgatgatgcgcgcggtggcggaggtggactgggccgacatgaggcaggccgtgccggcgttcctcaccctggcgctcatgccgctcacctactccatcgcctacggcctcatcggcggcatcgcctcctacatgctgctcaactcatgggactgggcctgccacgccgtcgcggtgctccgctcccggcgccggagaggggcgcgcgccgagacgaggagcgccgccgccggagacaatggggaacagaggaagaacttggaaatggcttaattagcttttttttttgcataatttcctttttaaaagatttagaaggtgattaggatttgctatatatactggaagatggttcaaaaggcttagtaggatgttcaagtaaagttattaatcaagtttcagtccctgagtgcctgtccattttcggaggtaatataacaaaacaatcatcatttgaaaaaaaaaaatcgaccttttacaatagatgtcgagaacttgtaaaagatttgcacattattccatcgaaataacatggtgcgaaggtctaaatatacaacgaaccaaaattttctgacaagctgatctaaattcatttgtctgtccacttttaggtgaaataacttgctcgagtgtccatctgtttgtcattttttttgaaagaactaaaaagagaatggaactaacccttgtgagcgcctgagcgggctcctcatttattgatttttttaatcataaaacaaggtttagaaaaaataaactataatacccttattaaatgaaatatagctagggttggaagggtggttagggtaaaatgaaaaaaatgaatactaagacatgattagtactgtagatgttaattattttgagataaaatttgaatactaatgagacaattattttagaacggatatagtatttttaaggagaaaaaaatatgaaatgttatgagaaaagaaagggcaaccgatgccggcgaaagtcaagaattgcgtatcaagtaaacgggtatgaccttacatgatggtatctttaattaaatattgctaactgatgccaacttatgtgaattggagtgatgggagcttttaagtggcactatcaatcagtcataacattttgacttgttgacannnnnnnnnnnnnnnnnnnnnnnnnnnnnnnagccgatcaacaaatgnnggccat

SEQ ID NO: 29924 - DNA, 804 bp, Oryza sativa
  unsure (1)..(804): unsure at all n locations
actgggaatgatcgcctgcttggnnnnnnnnnnnnnnnnnnnnnnnnnnnnnnnnnnnnnnnnnnnnnnnnnnnnnnnnnnnncgctgctggggacgtcgccggggacggcgttcattgagtcgtcgacggggatcagggagggcgggaggacggggctgacggcgctcaccgcggcggcctacttcgcggaggagctgttcgtcacgccgctgctggcgtcgatcccgtcgtgggcagttggcccgccgctggtgctcgtcggcgtgatgatgatgcgcgcggtggcggaagtggactgggccgacatgaggcaggccgtgccggcgttactcaacctggcgctcatgccgctcacctactccatcggctactgcctcatcggcggcatcgccttctacatgctgctaaacttatgggactgggcctggcacgccgcacaggggctccgatcccggcacctgaaaggggctcgcgcctagacgaggagcgcccccgccggagacaatggtgaacagaggaagaacttggaaaaggcttaattagcctttcttttatgcaacaattctttttagaagaattagaaggggactaggacttgctttttatacctggaggagggttcaaaagggctaagaaggatggtcaagtgaagttaataaataagttcaatgccagaaggcctggccattttcgggagggcataattacacaaaaatcgttttttgaaataaaaaatccgccttttacaataattttgagaacttgcgaaagaattccccatttgtccatggaatgacatggg

SEQ ID NO: 29925 - DNA, 815 bp, Oryza sativa
  unsure (1)..(815): unsure at all n locations
acgagaattgnnnnnnnnnnnnnnnnnnnnnnnnnnnnnnnnnnnnnnnnnnnnnnnnnnnnnnnnnnnnnnnnnnnnnnnnnntccctctcgcttcctttattgtcgctgccaagggtgatctcgacagctcctgttgtgacagagccttgaacacctctacgctgtcagtttccaagattcttggcatatgaatccattccatggctgcccttaatccttctagacatgccaatgcctcagcttggacagcagtagcacaggatttttttgcacagcaaacagcactaaacccctgcagtctctaatgatgattccagcagctgaaactcctgtgtcttctataaaaccagcatccacatttacctttgctgaaccttcgggaagggcgtgccatttatcaacctgattggttgtctgaacctgcagtaatttcaccattggttcattatacattaatccttttcctttgatgtcatcgctttgttgtcggatcggcaacagtaccttctcatagttgacgaggaaatttacagactctgcaattgtggccgtcccctttccatggatcatatcattcctgaggaaccatgctcttcacaacaagtacaaaacacgcgccttgtctgaactattcaagctatccaacaggacaaggagccagtcaggcccagtcatagcaaactttcttttccggcggtagcgcccagaactctctgatggcttttccgaacgatctcggcattggacattcaacagtcgcatggaaaccattttccttctttacaccacagattaggcagatgcctactggt

SEQ ID NO: 29926 - DNA, 2815 bp, Oryza sativa
  unsure (1)..(2815): unsure at all n locations
ctgcgatgcnnnnnnnnnnnnnnnnnnnnnnnnnnnnnnnnnnnnnnnnnnnnnnnnnnnnnnnnnnnnnnnnnnnnnnnnnaagaagtggtggcgcacacccctactccctccgggagtgacgatgctagcgggagccgcggcccccaccaccgtcgcaacaactctcccactcctgcccaccgcgacccccccacagagggaggaacctctccccgccgccgcgcggggagaaaccgcgcagtgtcggggcacggggccgcctgacatacggcaacggcggctcatcccgaggcgcactttaggcggcgggagcccttctacggcatccccccataaattcggagccggagacccctgtccagcgatggttggacaacatgaccaacctggtcaccactgcccagcggtagcaggctgcgggtggccgacccgccgcctctggtacctcgcgtaacccaccgctctttcctcgtcagcaagaaggagggcccgtcggtcggccctgacttcgaggtggtcgacggccccaacgtcatcgaggatctcgggaagccggggacgtcatggtggcctctacgaggagggacgctcgaatcaacattgagcaacacagggacgagcactgggcggcccgcatggggagggcgcctcctcatccggagtgccccgctcctccacgcgaggcggcccgcccctcacatttacccctggagggaccagttgcagggccttcaaggcgagtctccagagtccggtggcccccgaagtttcgccccaacctcacggagaaatatgatggcagcacgatcatcatgatgcggggggcgacgactaggtcatggcgaattacttccccatggctcttaaaggtcaggtgcgcggctggcttatgactcagccccccgactccatccactcctgggaggacctgtgccagcagttcattacgaactttcaaggcacgtatccccgcccaggagaggaggcagacctgcacgctatacaacggaaggacgacgagtccctccgctcatacatacagcgcttctgccaggtccgcaacactattccctgcataccggcccacgcggtcgtttatgtgttctagaacggcgtgcgacacaactgcatgctagagaagattgcctccaaggagcccaagaccatcgccgagcacttcgagctggcggacaaggtggctcgaaaggaggaagcgtgggcctggaactctcccggcaccggcgcggcggctgcagctgcccccgagcccgcttcccccccccccccaagggggaagaggaagccggcccactctgatgacgagggccacgtccttgcggccgatgggccctcttgggccccgtgcaaagaaagagccaccggcaacaagccgagctccactaccccccccccccggcgaaggtcggtctgcggataagtggtgctcgatgcacaacacctatcggcacagatcggcacagcctcaccgactgcagctcggtcaggtacttggccgagcggtacagaaagaccgatgaggagaagcggcagagtcaacgggagggcaaggcccccgcgacccccgctagcgaccggcggggggaggccaataaaaaggcccccgccgatgatgatgatgacagcgaggacctggaattccagatacctcagggaaccgtcgccactcgcgacggggggtttgcgctcacacctcccgccgcagtttcaaggccatgaggcatgagcttctggccgcgatcccaactcacgaggcaacatggaaggcgcgctggtcggaagtgaaactgaccttcgaccagagcgaccatccgacggtgctcgcttggggagggaagttggccctcgtgatctcccgaaccatccacaacatcaagatgaagtgtcctctagtcaacgggggggccggcctcagcatcatctccccggctgcctttgatgcccttaagtccccggggatgaagcttcagccgtacctgccgatcatcggcgtgaccccgggacacacgtagcttctgggtcacgttgagctcccggtaacctttcgtgactctaccaacctccgcaccgagcgggtcgacttcgatgtggcggatcttaatatgccctacagtgcggttttgggaggcccgcgttggtgaagttcatggccgccacccactacgcctacctccagataaagatgccaggccacagtggccccatcaccgtctttggcgatgtcaaagtcaccctggcttgtgcagagcagcgcgccgataacttggcggcagccaccaagccgcaggccccggagccctccacaccccgcgcctccaagaggcgcctcgcctcggccgacgagttgcccgtcaaggagattccccttggcgatgatccatccaagaccgccaagattggcagtaccttggacgccaaataggaaagtgtgctcgtctccttcttgcgggcgaactccgacgtcttcgcgtgaaagccatcggatatgcccggggtccccagggaggtgatcgagcaccgcctcgcagtgcggccagatgcgtgacccgtccagcagaaagtacggcaccaagccccggagcggcaagccttcatccgagaggaggtgatgcggctcctggaatccgagaagtcatccacccagagtggctggcaaacccggtggtcgtctcaaaggccaacggcaagctccggatgtgcatcgactacacggacctcaacaaggcatgccctaaggatgggtaccgagctcgaattcggcctgtttcaaacgatncgtcttactatgggacac

SEQ ID NO: 29927 - DNA, 1478 bp, Oryza sativa
  unsure (1)..(1478): unsure at all n locations
acgcgaatggnnnnnnnnnnnnnnnnnnnnnnnnnnnnnnnnnnnnnnnnnnnnnnnnnnnnnnnnnnnnnnnnnnnnnnnnnnaagtatcacaaaactattgatttagtaataaaattatcataaaaaacaaatttagcaccaatttaattgcaaaactataacgctcatagtttcaacataatagtagtacaagggatttaaactctaaaatatatagttttgtgctaattttatttttaaatctatacttttttatacttgctttaactatatagttttctgataaatttcatactaaatctatagtttttttatagaacatcttaattctacagttttgtaatatcttgatcaaaatatttgtagttttgctatttttatcatgaacggaccataagaagcattccatgcctgttacttcaagtatctgccatacctctctgcgtaaacaaaatcacgatattcacatgtggtcagatttatccctaatttgattttttacagaggaagtagctttaagagaatctcctgcttgacacctattcagtattcacacgttctcctgtttatgcattccatccctgtcaatcactactaaaaaatcatttttctagcgtaaccctttcgtttttcctgatgggttttatgcaaatacgcttgtgaaaataaatgatagggattccgggtaccaatcgtcagcaaaaatcaattttcgctaacgggtacttaaaagatccgcttgcaaaaatagaggtatttttaaaagcggacctcttaacttaccgctagcgaaaatcatatattttcgctcgtggctgctaatggccacctcccgcaaaacaaaaagaatgaaaaaaaaaaaaaaaaaaaaaacaaaaaaaaaaaaacttcactatattaaaatttcacccccacctttccccgctcccccatttttccatctcctaactccatctcctcgactccttctgctaaccccctttttcaccacgcctctcctcctcaccccggcccggccctctcccccctgtgcctttcctcctcctttcctcgacccccacgcacgcgcctttcctcctcctttcggcaaccaaggcagggacggcgacgacaacgggggacgtcctccttcctcgccaagccaccgccgtggagccgcatcgactggagcgggccagcggatccggcctgccggatggtcgcgggtggcggattcagtcacaggagaggcacatgtagagaagggaagcgtgcacacggtggattcggtagcggcaatggtcgggctcctccctctcagaccaaggggtggacacctccttttttgtggagcaccaacggggagccgtattgaccggtaccgaatggttggggagcttgcggacgacaaaagatctcaacccctgccttttctgtgatgaagggggtgaggcacctaatgaccgtgctcgtaggcaagacaacggaacacaggg

SEQ ID NO: 29928 - DNA, 6608 bp, Oryza sativa
  unsure (1)..(6608): unsure at all n locations
naaggaaagctcaaacgggtgattcgtaaccggcaatgtcggtctcatcttctccagtcaggtgttggccacctcgttcttggcgagcacccacgggaagcgcaatcgacggtcaccgaatgcctgcggaagctgtcggaacaacgaaagatcttccaaccccctgccctctcctgatgatgcagtgggtcgaggccacctagtgaccgtggctcggtaggcagcgacaacggcaaccacggcagccacggtgaagcctgtagcgagctccctccttcaccgacacagctcgatggcagcaatcgatgattggggattgggatttgtgattggaattacttttttgctccaaagaaaatgttttcactagcgggcattttaacattgccgccagtgaaattctattttcgctggtggtggtcttagcttggcggcagcgaaaatgattttcactagcagctgtcttagcgtggttgctagcgaaaattgattttcgttggcagtcaactgcccgccagcacaaatgtattattttcactggcctttgattgctagcggtacagcaacctccagcgaaaacccatttcggccgcaagtaaaaatggttttttagtagtgaatcaaataaacatgatgaggaagtgacgttgactctagatgagaaaaacgtttactatacaaaatatacacaaatcattcatacaaaagcaattacaatttacaaaaacaacactaatgaacatgattattctagatgtaggaattattctggaatactcctcgtcggaaacatgtggaacgcatttctctcaaaacgcaaaaaccgtgcccagacaccaatccgccgctggatgtgaagccaacggcccagatggaggccaacggtgccaaggcgcaggccacgcgtgtagggctggacgaaaagctcgtggctcgttagctcgctcggctcggctcgtctcgtttggatttgttaacgagccgagctagagttagctcgttagctataacgagccggctcgagctagctcacgagctgctcgcgagccaaacgagccaaggcccagtacaaacagcgtgctcaaccacacaccataagtccaacaaggcccacgagacaaggtcacagctcaagcccacaagtagagtcaacggtgccaggtcatgaaacagcaagcccaactaagcccaatagtctaaccctaaaatccctccctacctgtccgttccttttctcaacgattcccagaagcgccgcttatcctcaagccgagtggccgacagcgccgcccaggagtcgaggagtcgtagctcgtagcgccacccttccttgcgcgcgcggttgtgccctttctcgccgccggtctccccgcttcacctcgcatcctcaacgtcaacagctgccatccgctcctcacgctggctatcgggaaggtcagtaggtcacgccgtctccttccctacttgcctccggccaccctaagaccccaactcgcctcttcctcgcgcgaatcgcctagttacccggcgggcgacacccctactcccgtgtggccgcgcgtcctcgtcgtcttgcttgccctgctttctttggctcacgagccaaacgagcccactcgagctagacaactagccgagcctagcttggttttctagctcgttagggtaatgagccgagactagctagaccgagccgagctggctcgacatccacccctacacgcgtgcctttgcccaaatcttatctcccgggaggctcacttccctccccgagtggctgcgacgacctccacagctcgagacgaggtgccacttcttcttctctctctccatcccccattcctcccctctcttcccgtgtcccgtcgtccacagctccccgaccaaatccctagccctactattcccgcgcccgcccctccctcgcgtggtcacgcccgacagcgccgtgccgccaccgcttcttgccctactgccgcagttcttcaagaggcttttgtcctgatttgctgcagcccggtaggtattatatatttttgtggttggtaaattcggcagcaaaaaagaaaaaaaaataataccgaatgttataaacccgagcatctcatggtgtccatgtatcagcatatatgatatgttaggatcggtaaggatgcatagcacacgattacaaccaccaactccacctcgaagataatatagcgtagtgtttgccagcttcgcacgttatggccgaattcttatgtataacaaatttaccatggtatgtaagctcaaaaatgcaaaactaattatcctcgaacctaaaaaagtgtatacatgcaagagatgatcaatcccacatataaatacatgcaaataatacacgccctgctcgacagccactgctgcagctgtacctaagctactagctgtggccgcggtgtgcatccacaaccgtagcaatggctgctcagcaggcccatgatctctgaaaaagttcctgcaagcagtacatatgtatgtacagttgtacacaccctcgcccctattcatcctcttaaaggagtaaggagtaatgacagtcgatatgtgttggttgattaaaatttagaagagaacgtttttgaatagaattgtgaacttactcgaatatcgttcttttgtgtattgcttttgttatgcttcacctgactctatctctgtgaaatggcagctagtatattgaaggttgaagctttgtgggtatccagcaagtatttcaatggcgttgctacagtttggaggtaccttggcccccaaacttggggaaaaacctcagctgttgcccaggtcacctgcacttacaagagttatttatgctgatccaagatttctggtgtcgaaaagtgggtatgtgaatgtgttctgatcagtgagatgtactaggaatactaaaataaaggacacattgatattataaaaaggcaagatttctgagtaaactgaagatgatatatctctttttgtgcagtagtggaggcaggcttaaacaccttgtatcacctactgctagtttacaatcacggacatcttctcgactatttaaccatgcaccatcaccgagatttcgccatcgaaggagttcaaggttcattgtcagagctgatgctgtgagttacttcatttgcttttcttctttgctggtattattagaaaatccagtttcctgacatggatttgatattttaatttacaggatttctattccacacttggtgtttcaagaaatgctagtaaatctgaaatcaagagtggtaggtgtggttttatttgtcagtttagggcatgcagtgattggtgctccgtacaatcgtaggagtattacccagctttgcttcttctctagtttgagcctggttgtaggtttgtaggtaccctataatttaccaaacaaaccagactgctttcatgtggctattagtcgtagattactagttttaaatcatactgttcacgtgtgaaacaaaatatatgtacaacagaaactgttaagcttcccagggaagatatgaaatatataactagtctttttcaaacttggccatagtgagctttatggcccacttgtttgttctcgaaagctttactattcctactagtaactcaaatatttgctatttcatctaatttgaaggctatctcagcaaaaccccttgaactattctaagacaagcctatgctgtcttcagtatcattttctgcaactgatcatcttgcgttctagactcgatactgtttatatttctgaaaatctattgttggcaacttctcattgatgcattgtttgtatggccctcaatccctgccctccacgtgtgtgggcagaaattttgaacaaaaatcccaacccacacccgtagataatctaggatttgtcctatccaaataatgcctaaggggatattatgttagaaatccttcagagtcaattttgatcaaaatatgtgtagtagtttaatgttgctttctattgtagttctaaaatggtccttcttttccagcctataggaagcttgctaggagctaccatcctgatgtgaacaagtaagtactaaccattatatgggaattgtgtttcagctacactcgatatattgcttctttttctcctttcgatccattataaacctgagtactagttgttgcattacctttttcataactacataatcaaataagcaattgttatgcttgtgtatttttctttagagatcctggtgctgaacaaaagttcaaggatattagcaatgcttatgaggttagtccagctaaccataaccaaatcccattgtttcttatgactatgttgttgtagggttacaggtgcttgccagctaacataaataggattgcaggttttgtctgatgatgagaagcgatcaatctatgataaatatggagaagctggtttgaagggtgctggaatgggaacaggagtgagtgttcctagaatgttgtccaattctgaagtatgatcagcatgacctttatatgatattgattgtatgaaatttgtgaatctgcaggattactcaaacccattcgatctctttgaatcattattcgaaggctttggtggaatggggggaatgggaggccgtgctgctcggaacagaccaatgcagggtgatgatgaggcctacaatctggtactcaatttcaaggaagcggtgtttggtgtagagaaagaaattgagatcaccagactggaaggctgtaatacatgtgatggaactggtgccaagcctggaacgaaaccaaccacatgcaaaacatgtggaggacagggacaagtggtctcctcaacaagaacgccacttggaatattccagcaggtctccacctgcaatacttgcggaggcactggtgaattctctaccccgtgcaacacttgtgggggtgatggccgagtgcggaagacaaaaaggatcagtctaaaggttcctgctggtgttgattctggaagcagattgagggtccggtctgaggggaatgctgggcggagaggaggccctcctggagatctttatgtgtttattgatgttctctctgatcctgttcttaagcgagatgggacaaacattctatacacatgcaaagtttcatatattgacgcaattcttgggacaaccgtcaaggttcccactgttgatgggatggttgacctgaagatcccctccggtacccagccaggcacaacgttagtgatgtccaagaaaggtgtcccactcctcgggaagtcaaatgctcgtggagaccagctagtgcgtgtgcaggtcgagattccaaagcgtctgagcagcgacgagaggaagctgattgaagaacttgcaaacctaaacaaggctcaaacagcaaacagcaggagataattccatgaggcttcattggacaaaatgctttggcaatatgcaattttaacgcaaattgcagtgactaagtgagcatgaactggtaaatcacttcacaaactgtacgctcatgctgcgccgtaccatcggtgggaactgtgaattctcatgtctgtaacttcatttttaagccatagaaatctagttccatccaaaacaccaaaacggatggtgttttacagtagcttgtcatatgcttttaggcgagcttattagtctatttttcataatactttttcacaattttgaaaggcctagggagaaatatttaatggtgcaaaagggacgagttttgaaacatttgtttgtcgcagaagcaccagaccattctgattgttattgtaagctgtaacatcaaagttttggcagcaggttttcatgtgctcttaagcgttgggggtttgttccgtttggttttcaactgtatgctagctttctctattagccaatgtaatggcagttgcaaaatctgttgtagtgcaggcgtgcagctaaatgcagtatagctgactgttaactttaagctgattgttccatgcatgtgccagtaaaaggccagtcaggaatgagtctcatggatcaatatatggtgcagacatgtcagtaggatataggagtattacattatagttttttcagcttcaataacgttcatgttagcttgtacattgtatggcaacccttccatacttgcgttagccacaaaagttcaccatgttagcttggctttagatcagtttaaactgtcctttaatagcaaattaataatccataaatgaaattttacttccactgtttaccagtgctactactgttctacctccagcgttcaacagctgagaaacgtgaggagtccagcaccagcagtaccatttactgcaatgcgagagagatgttctccgtttcctccttcactgaggcttaggagtaggagtagtagtgattttttcgtgtcgacttgtttaacattatcgttaacaccatcaagtgtcaatgccagtagcctgctgcttctgatcatttcttccttccctcttctaacgccattatcgttttatctcaccttgcatttatgttcaagtgaccatggttnnnnnnnnnnnnnnnnnnnnnnnnnnnnnnnnnnnnnnnnnnnnnnnnnnnnnnnnnnnnnnnnnnnnggtgttacttgggccg

SEQ ID NO: 29929 - DNA, 3229 bp, Oryza sativa
  unsure (1)..(3229): unsure at all n locations
ccgcggacnttggaaatggacnnnnnnnnnnnnnnnnnnnnnnnnnnnnnnnnnnnnnnnnnnnnnnnnnnnnnnnnnnnnnnnnnnnnnnnnnnattatccacccgattatctaatggcaatacagtgcctaaaattcctgcttccggagtcttaaactttacccgaatccaatctggaaaccgaaaagacagctgcttggctgatggcaagtcactgggtacattgatttgtgttaattttcagtccaataaaacagcgcaaaaattgtaagggtgatccctctttagtaaagccatgcattctgcaaactctgttgcaatgcaagctgtatcctatatccagtgccgatgaaccaattctgtttgcagactgtaccctatctctactctacaagccaaccaaaggaaagtgtttgatctgcagtggaatactagcaggtattccaccatttcagggttgggagtgtgattgatatgcaggagattgacattgtgcagaacattggccgtcaggctgccgctgccgtcgccggtggtgtcggtgagaaagcccggtggtggtggttgtgccggcggcgaggagtggctgcaacaggatgggctgttgtgcatgggcggatcagcgggtggcttatggcggtggccacgctgttcgccggcgacggacccggcggcggcggccttcacgagggacggcgcatgatgatcctggataatttcgagacttcgggccggcgtgcgtgcaaagcccatacatattctacgcgcaactgtcacgcacaaaaacgaagtttttagtaccacatggaaaatctatgacgactgacaccggcataaaagacgacgcgctcgcatcgctcctggcgagctcggtggcgtgagcttgttaccccagctgcgggggggcgggagttggcatgtttcggctgctggagaaaatgaggtttctccctcgatcgaatatggatgcaaacatcctcccgactttggcccacgagggagggaaggtgtgagtcaccctgggctcttgacggctgcgtcatggagcgaagaggacgctgaatcgtggtagaggtgtgtggtggccggtgcccgacgacggcgcctggcgatgggtggggagaaggtgagcagttgtagttgggacccgtgccacacccccgcacgtgcgcaagtccatgacgtgagcgctcccggtcattaggagccacgtcagctggcggcctccgccgttgagcttttccctgccaaccgacacccttctccccacccattggcgaatgccctagaggtttgggttgagataggagtagaggggagtgaggtggaagaagattgctagttggcttgtgggttccacgtgggccctgcactgactcagccaccacgtcaacaaaaccggaaagcaatactaccttgggattaaaagtggaccgttttgcaagattaggggttcagggccgtttaaaactcaacgacaagataagggaccttagatgaacttttttgggagatgaggcgcctgtgcatatgacccataggcaggcgacaacgcggcagcagagcgctgcacgacctccgcctccccaatccgtcccgtctcctcgcccgccgccctcgactcccgtctcctcgcctgccgctggcgccgatctccatcctgctagcagaggtggcgccggcgtcctcctgctcccgccgcattcgcatcctaatccatcccatccggcctcggcctcgaatttcgtctcctcgcccgccgcttgcgccgatccccatcctgcgagcagaggtggcgcccggcgtcctccttcttccaccgcatcgtcgctcgccggtgagcatccctccctacccacacctcatcaggtattctgcgttatccctcaaaaagtttgggggttcaaccgaaacagggttagatctgcctctgcccagctccacctactttcaagttgttaattttgatttccgtttttagcagatgtaatttggttattgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactgtgacacttggcatgaatctaatttaacattctttctttatcaggttataaattgaaaccattgaacgtactttgtcttcccgtccctaaaacattgtgatatatctgtaatattttaatatttttaattttaaaaataatttagactaataatatagatatttaaattaggtaattagtaaattcaaatcaactatagtttggaataaaaaaacaaaatgatatatgccaagtacaatctaataacaatagaatgcacttttggttaatgtttactcctaatttcttaatttctagtttggctccccccaccgttatggtaaaaaatcgttatgttttaactatttatctgctagagcatatgtaatatttatgtaaactatgttctttattaccaatcaaaatagacaccttacctactttcatcaaaagaaataaaaaatgttgatgatgtagtaggtattattctggaatactcctcgtcggaaacatatggaacgcatttccctcaaaacgcaaaaaccggggccccgagccctcgacaccaaccccgtcggatgtgaagccgacggcccagatggaggccagcggtgccaatgcgtaggccacgcgtgcctctgcgcaaatcttatctcccgggaggctccgctccacttcccttcccgagtcactcaaaccatccaatccctccaccttcccttcccttgcccccatttcccaccgccgccgcgccttgcccccattccccaccgccgcggtgcggccgccgacgacctccacacctagagcacgcgtgccgccgacgaggtgcccttttttctctcactctcgtctcccccattcctcccctcttcccgtgtcccgtcgtccacagctccccgaccaaatccctagccctactattccccacccaccaggccttcctcgcgtggtaaagccgacgatcgggcccgacagtgccgccgcttcttgccctactgccgcggtcttttagaggttgtcctgattgctgaagccaataggaatgtatattctttcgc

SEQ ID NO: 29930 - DNA, 811 bp, Oryza sativa
  unsure (1)..(811): unsure at all n locations
acgcgcattgatnnnnnnnnnnnnnnnnnnnnnnnnnnnnnnnnnnnnnnnnnnnnnnnnnnnnnnnnnnnnnnnnnnnnnnnncagctcatggttaactaatcacgctataatggaccgccctggcttcctagcgcacttttggtgttgagaacaggtgatggcaaacacagccttgattcgttctggagatggaaaagaactaccacagatttagtaggggtcaagaacaaggctacttcgaggacatcatgcatgaaaacgtctagcgcttttgaaacatccggattattatacattttgtgtgcggtaaacatatctacttgctatgttagattaatcttctcatacaatcgagggagtcagcgagaacaacctcagcacggacgagcattccataagaaagacatttcataagcgctactttggaagaaatgtacgttctttgtagggcaatatttcgtgaatgattggactgaggaacatatctaactcttcgttctagttttcagccatccgtgctggtgttgcacttaatgctggtatactgaatgacgtacttataggctatgcttctgagataccaatcgagcgaggctgaactaacgaaagactagtacactacatcatgttatgattgatggacaacaagatggtttcgatttgaactcagatgtatataaaacaggcgttaatatatccatgcgccagactttacaatgtcagggctttgatgacacataactaatggtaattggctaaatttcgggagccaccaccagatatcgtgttctataatgaaacaacctat

SEQ ID NO: 29931 - DNA, 7469 bp, Oryza sativa
  unsure (1)..(7469): unsure at all n locations
cacgcgaatggnnnnnnnnnnnnnnnnnnnnnnnnnnnnnnnnnnnnnnnnnnnnnnnnnnnnnnnnnnnnnnnnnnnnnnnnaaccccaggaatatcgagcatctacaccgtttctacccataatgtcgcgcgttttttgctttcttggggctcgggccaacccccgcacactcctcagcctgtgcgggcttggccgagggctaccactgttaaatatgttgtatccaatccctccctcagcaataaatttttctgcttaatcaaaagctgttgcgcgccctttcttactccttcctatggctcgtcctggcttaaggacgattcgcgcttgctccggaccctaagtggcgttggataacctgaaaataaccgaaggggagcctgaacgcgggccgtgccccgggctgcagcgaaccctaggggctcggaagggcctacacatggccatccccgacccccgatcaccgtggcctcggtctggttagtcccgctgggcggctcccctggagcgacggccttgcccctcgccacctaagtgtcgcggaccaagtgcaaattccccctttttaccggaacgagccccgaggggcgggacaaagggagtaaaaatggcaacttgatcgtaaagaagtcaactaaatgcgttcgctttgtttttttccttgccgcaggcatttagaagagaaagcacggatgtaaaagtgcaaaggagaagctttattacaaccaggatggcacaatggcctagagtttcaagcgttcaccacgagcacataacataataaaggaggagaggcgggggcaatcacggagtgcctgggcctccaagtacagcgccgctgaccaccttgtcccaatccttgttgccatcatcgtcgccgccgtcatcactcccgctctcctcatctgagggaagcgcgagggtgaaccaaggggccgtcccctcaaagcttgagatgatcacgtcggacgcgtcccgaacttgctcctgagccctcgtctcaatccctgggggaaatcctcgagcacgtgccacggaaggatgttggggtcgcgagcttgatgactcgcgaggacaagctccaccgcagcccgtgccaaggaagccgatgacgacttcacgggctcgccgaccttctgctacagccttttaagatccgccgccattttgtccagccgaagcgcgagcgccggtcttgtgggcacgagcttcttgtcccggcgcacgaagatgcccacccggcgtcccacgcacttcagccgttcgatggcatcgtaaagttggccaggcccgatgtcgttggtgaggtggagggccgcgatctccccagcctggttctgtaccagacaccccaggttggcgagagtatcttggccgccggtgagctggctgaccaactcggcgtcgccggactnnnnnnnnnnnnnnnnnnnnnnnnnnnnnnnnnnnnagctcaagcgccctcgccaccatcgccgtgcgctcaacacgggcgctttccacatggcgggtctcatgcccagcaacggcctcctcacatttggtgagctgctcgcctagccggcgcgccgccacctcgcggcggttcacctcggcctcacgctcggcgagcgcggcatctcgttcccgccacgcctactctcggagccacagctcctctgtgcgacgggccactaaagcctcagtggcaatggtggtctggttgcgctcggtcgcggcctcctcgcggaggcgaagggaggattccgcctcggccgctgtcgcctcgtggacggccaaggtagtctcgtgctggtccaacgcgcgcgcccgctcctcaagcgctagggcccgctcctccagctcctgggcccgctgcgcctgtgcccgaccgcacccctcctgttcgcgttggttgcgatcgaagacctcgatccgccggcgaatcgtggcctcgaactcctgcgcgaagcgggtgcgctcgtccaaggccttgcgctcggcctcaagcgccaccgacggggccggcagcgaggcgtcgaccttcgatgcccgccgcacttgggccgcggccgcgtcgaggaccccgcgggcgtcctcaaccctcttcgcaaggacctcggcgtaggcctcatactgcaggcgaatgttgcccagcacctcgtctaaggcgcttgaggtgatgagcgccgcctgccgctcctcctccgtctcacgcatgaccgagtccagcgtctcctcgcgcgcctggatctcctccagctgggcttggtgcattttgcgccccgtctccctgcggggaccccaccctttcggcggcgggggcgggttcaattttttgacccacgggtgaggtggggtcggggccccacatttttgcggggaggggacgggggaggcatttcaccgcgggtgacccgcggggccccgtgggatgtaaattaaaccttaaaatgtagtccatggaagacccaaaagagcccaatccaacaatagtctaaaatataaaaataaaaccctagccttatcctctttcctctcccaatctcctctccccgtcaccctcacaccacacaggcggcggctacgtcgaccgccaggcatgggcggtggcgacggccagggcgcgggcggcgacgtcgatggcctggcgcaagcggcggcggtgaccagggcgtggccggcggcgtcgacggccaggcgcaggcggcggcggctcgcctcatcgtcttccaactcgctgtcctcgtcgccattgtctatcttccagtccaccggcccaaccgggtagtgcggggccctgctcacccccaaggtccctgtggggatcggggctggtgacgttttccacccaaccacctctgcggggtcaaggtcggggggagaagtcgggagcgggggcgggggcattccagctcaacccgccccgttgtcaaccctaatccgggccatgacatatgaaattcaaagactcagagagcaaaaaaagtttactggctaaaactcaaaagtactacagctccaacttgagacgtttctgaacatatttatacattccagcatatcaaaacactactggagaaaacatctttgcccggtcgagcaaaaaccacaatagtcccggttgcaataaaaaccgggactaactattatctttagtcccagttcaaaaggttcgagctacttttttatctttagtcccagttggaaacaccaatcgggactaaagatcatttttagtcccggctaaaagaataacaggcggtgccatacccctctaactaaagatatgtttctagtcctggttggtgtaaccaactgggaaaaaagatcggcatgtgcggcggagaggccaaggcgtgcgcgagatcgaggaggagaatacgggatcagttaataagttctatctcctccaccctcaccttatctcttcaccccatctcttcctcttcttcctcctctcctcattctcttcctcccttttctcaggtagcgacgggcagcggcggccgggcggaggcggaggcagcctcacgccgcggcggccgggtggcaacggatccgggaggggaggcggccggcgaggaggccggtgcggcggcaggcggtggaggccggcgctgctgctgtattttttttcttttttttatttttttcttaaagcgtgattcaatctgtgttgaatgtgtgattcgatctgtgttgtggttgtgaactatttggggatgaactattgtgtgaatgatttgggatgaactatattgctatgagtgatgaatgtttgatctgagatgatttgggcaaatagcaaaagaacagtaaaaaagaaaaagagaaaagaaaaaaaatgaaaaaaaaaccctatagtcgggaccacatctttagaacaccaaccgggactaaagtcccggattcgccgtcccggttgcataaccgggacaaatagatggttgccaaccggcggcaaaatcggttgtgcagcagtgaaaggcttcaacccaagcgatacaactccagcttcacaggacaactccatcttgacccaacagaactcagtcttgctgatgacagtgcagtgctgtagacgtcagttcttccgcacattgttccagtttgatttgatcctcctggctttgtaaacctgaccaatataagagggaaacaaacagatgaaacacaccatatcaggagacttgatcttctttatccttcaaaacatattacgggccggcttcctagagggcccaacacatggcggccaatcccgcaatgtgattttttttttccatttggtatataaactatgccctgatcaaaaattgctcgaaagagttgggacgacatttgagctccaaacacataagccattagccatgaggctccaaatatatttggccaactcacagtgaaaaaaaaaaacaggtcgttgacagtctccttttccttgcaaaaggcacaagtttcattaccattccagtttcgtcttacgagattatcttttattaatattgcattgtgtacggctaactaaatttttttttatctttaatggtagtttagctttcaatgcaatttatatgatgtggccatatacagctgtgttgtcacatcctgattttttttcaggatttataaattatttaataaattattattagaatttatattaaatgttctttaatttacaagtgaagttaaatgtgggaaataaaatttcctaaatataaagcatggatggatttaatttttattaaattctccatgattaattacactctctaaaattttctcggatttttcagagctcaattcctaaatgatacaaagaacagttcagtaattatttgatcattaatgatctaattataattgttaggagcttttcttgtttaaaaatccttaaattataaattgttgtttaaaaggaattattagaaatgatcttaaaagcctaaaagagaagatctaattttaattaataaattccaatataaaatagggccagataaaatttcattaaatactttacttgattctaaagttcctagatttttctgggatttatttgagccaaggaagtatttttaatcaatggaatatcatttcatgaataatttaaattgaaaaaggtttttaaaagtctcttttggctttgggccgaaagccggcctaaaacctctctctttctctctccctccccggcccagtcggcccaaaaccgctctctctctcctccccggcccaagccggcccgcatccgagccgctgctctcctctctctctcccgctgacaggtgggccccacctgtcaggcctgtcttcctcctcgcgccggccgccgctcgaaccctagcgccgcgccgccgtcgtctccttccaaatccgaccgtctttttcccaatccggtgaaatcaatagaggggaaatgatcttctcaatctcctctaccttttctcttttggaatcgtcggctaatttcgtttggaaatccgtggattcgagtttgattcggatcgacttctctcctccgaaccctagctttccttctcgccgccggtcgccgtgggcctccgtcgccgctcgctagcccctttataagcacccccgagctctcctctatccgccgccacctttgccttagcccgccgtcgcgtctagcgccgcctccgcgcagccctagccgtcgccgtcgttgccgtcggttcagccgcgccgcgtcgccgttgcagccgccgtcgtcggtcgtcgtcgccaccatcgggatcgtgaggtcgtcgtcgtccccgtccaccgcttcgccgccgccgaagaccgccggagcaccgccatcaccgtcgacccgaagaccgtcgccgcttcttcctcgtcgccggcgccgtctgttgctcttccgccgttgttttggtcaccggtgagttcgccgcgtcgccctctacccgttggtgtcctccgtttgcgtcgtcgcgccgtcgttcgccggtgagcatgcgccgcccgagccgtcgccggtgatgacgtcatcgctgacgtcatcgttgccgttcgccatagaccggtcgtagaccgtttagatctcggccgttcgttgtggatagggtagatctcggccgttcgtttccatgagccgccgccgtgcacccggtccaccgtgaacccgagcccgctgacgcaataatcctcttttccttttcaaaaataattcattattgcgtcataattcaattaaaatctatataagtgttttaatccgatttaatctttgaaaattcataactaattctttgtaactcagtttaatgtggttcaagttgcaaaagttgtgtaaaataaagatctacgtattaaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgagtactttatatgtactgtttatttggtttttattagtctttttcttcgttttgcgtgttagcttgtcgtttccgtcgttgcgaaggttcgcgagtgcgccggaagtattcaagaagactaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgattactttattccttgataccttgggatattataagtgtgtaacgttattattatgatggatttgtatattaaattgtcagtttgtgtacctcggctgattcctggacgaggattttatgcacaaataagttcggaaattaccagtgaatttccgggcgtgacaaaaatatgaaacctagcaaagttatcatcgctgaagtttggctagacccaagagctagcactaaccacatctccacatcctgtgccattttcaatttgtatccatgatccactaggaacccaatgatgcttcacctttggctcgtaaacatttgttgtgacccctattccatatatatatcatcccaatatattatccctgctttctacaaggaaaaaaaacatttatgaatcaaaataacgtaaatacatatacgaaattttgcagcatgttaattacatgaaggactgaatgtgcaacacttagaccctgtttggcaaaatggttatgggaggtggagttgggaaatgaaaaggagaggatgcctaggattaaatgagatgaaaagaatggatggctagaattgaatcttacctgatgggtggggcatatttttccaaacccattagctagtcannnnnnnnnnnnnnnnnnnnnnnnnnnnnnnnnnnnnnnnnnnnnnnnnnnnnnnnnnnnnnagcagggcgttctataagcgcgg

SEQ ID NO: 29932 - DNA, 1971 bp, Oryza sativa
  unsure (1)..(1971): unsure at all n locations
catgggnaattganatgacnnnnnnnnnnnnnnnnnnnnnnnnnnnnnnnnnnnnnnnnnnnnnnnnnnnnnnnnnnnnnnnnnnnnnnnnncgcgagtgcgccggaagtattcaagaagactaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgattactttattccttgataccttgggttattataacttgactatttgagctttatatattggttcagctagatattagatatgattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataaggggatgattatgatccaggaatggtgcactgtggtgagttgtgttgtacaaagggtattgtcacaacctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgctataactggtaataatttgtttagctcctggtttggagttagatctgtacggccgggtatggttgttcagaatggttgggcctgtgcagcatgggtgtgttgttcagtgttgattaaaatttctgattaattactccactgttttacttctcttaaatgttttgctaaatgctgcttttgcaaatgagcctatattatgccatcctttggtatctttgtgcacttgcatatttgctgtgtggcttgttgagtatgtcatatgctcattcttgcaataatcaatcaacctcagttgaagaaaaaggatccagaaggataagacgtttggcttataccccagttgagctgcctgtgggagtggagctgaagccatcgctagaccgttattccgctgctgttttcttttcttttgtaagtgtgtaacgttattattatgatggatttatatattaaattgtcagtttgtgtacctcggctgattcctggacgaggattttatgcacaaataagttcggaaattactagtgaatttccgggcgtgacatgtgtgaagatggttgtacgttgactttacagaaaactaaactggccactggggctcctgtcacgcccagaaatttgacttccgtcaaccagaagtcacacttgctgaacttggcgtatagctggtgctccttcaacttttcaagtaccagacggagatgttgctcatgttcttcctcggattttgagtagataagtatgtcgtcgatgaacaccacaacaaacttgtccagaaattccatgaacactttgttcatcagattcatgaagaatgcgggtgcgttggtaagtccgaaggacataaccgtgcactcatatagcccgtaccgagtggtgaaggccgtcttcggaatatnnnnnnnnnnnnnnnnnnnnnnnnnnnnnnnnnnnnnnnnnnnnnnnnnnnnnnnnnnnnnnnagactggagtggcaatttaaacctcgc

SEQ ID NO: 29933 - DNA, 2552 bp, Oryza sativa
  unsure (1)..(2552): unsure at all n locations
cccaaagttaaaggcttggtcgtatgtaccctttctgcagctgctcatcaacatgcttcttgacctctgataattcgttggccgccattctgtacggtctcttatagattggagcagttcccggtgccaagtcaatccggaattcaatctctctcttgggtggcatggtagtgaggtcttcggggaacacttctggatactcgcagactatgggtatatcttccaattttctcaagttcttctctacggtgtccactgggatttccgtctcaatctaattcaacgagacccctttctttggcgagactagagatttgtacaccacggtttctcccttctcgttggtcaaggtgactgtgcgactcgcacaatcgatgactcccttaaacttggtcagccaatccatcccaagaatgacatttaggtctttggattcgagaagaatgaggttggctagaaatggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcactagaatcaaaaagtactgttgcagggattgagttaacagggaacgtacccagtacgacctccggtgctgcttgtgcctcctctgcagatgcgtggttgacacgagcctggataaaccttggcccggcacgcctgggcttcgggcatttgtcagcgaagtggccaagctcgtcacagttgaagcaggaccctggttttgctcccgtctccttcttggcttgcgcgggctggcctgactgtgccggtgccactgatgggcgtggagctgcaccgcggttgggctgacctccatggtggttctgactgccactggtgccctggtggaagttgctagggttgaacgggcggtgctggcggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtccaagctgacgcgggaccctgaagctggtgtgtggcaaaagcgaccttctcctgatcattacactgcaggagattcagcttcttctctattgcatggagccagtcgttcgcctccatagggttggtggtgctggagaaggtgggtggcctcacgcgtagaaactctggcaacttggactgagggggagggggaccaaactgttgatgctgctgttcggcgtgctgcatcatcctctggtgcatctgctggtgctgctgctgcatctgctgcatcatggctgccatcatctgagtctgatgtgccataacttgggcaagcgtcggattctcgggaagtggtggcggaccattgccagaatcactgttggggtgcacaccatcagcgcgttcttcgccgttgctgccctcgcctgttgcgcggctaccagtcctggtgtagaccatctggagggaaaagcagacggggaaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagaccatcgataaactaattggaaaacgagactaatgctcggaccggctcctgcggtcggtggagtcgaaggcgtcctcctgctcgtcacccggtccctctgagcgactcctggagcctgacagatcagtctcgccgctgccactgggagtagcagacaaccaacctccggtgccactggctggacccctggcggctgatgctggagcgaaggagagagtgaacgcgggagctggaactggagctgcaggaactgcgggcggaactggaggtgctgcgggagctgttctataggctcgtaccgttgcatcctttaccaataaggaggcaagcactcaagtctcagtaaatcaagaaaaatgtgtagaatccattaaaaatggttttgttctctgtttcagtagtcttatagcctgtttgcaatgtttgctttgtatgccgctagattccgatccctccgacgctccggtgtacttcgagatagtcgccgaggttcccccagcagcagagcaaggcaagtcatgcttgtcacttgaannnnnnnnnnnnnnnnnnnnnnnnnnnnnnnnnnnnnnnnnnnnnnnnnnnnnaccngangtacagtcatcatnccgcg

SEQ ID NO: 29934 - DNA, 1467 bp, Oryza sativa
  unsure (1)..(1467): unsure at all n locations
taatttaatagctaattaatcaatagttatctataatattatataataaaattaatacctgattccacctatcatatacacacaaggtatcttggaatcaatactgcagctgtctataagtcaatagtccgctgcttttctctttattttttgtcttctcgaaatgtgtttatagctagcttataatatacaattgtacctactcctgatcactgtagctcatatagctcatagaatggcacacattaatctacaattaacaataatgccgttctccatacaaacccaaagagagaggatattaagttaatttgcatcgatctagaaccacatgaatttcacgtgaggtggtactttaatcgccggatgaatatacgtcaagacaaattcgatatgtatgttgcaaacaactgggagcgattatttgttcttccccatacaactactagtgcatgattgtggggcttcttgtcctgttccctgcttctggccccaacaacgtttctttcttctagaagggagtcttgtactgttgctccctttgtcacgtcattctcgaaaggtggcttatcataaagttcacgacatacttaaatacacgtgttttgctatggataaaaatgaattatacatatgcacattgtttagagcaagttggttgtaaagtttttggaacaacatatatcatccctgatttttttggatgtttttgcatggtaaacttaaattcttagagagaggataagatattaacaatacgtagaaatattgttttataaagaaaaaaatacgaattacctttcccaaacaatccggggtgatacgtaattagttattcaattcgccgccgcccctattccaccgccaccttttgccccgacggaaacgagggcgacggcgagcgcgacgtcgatggcgaacatggtggcgaccgtcgcggcgaggatccagactaccttcccataaaaggcggcgcggcacaggcgaagggtggtggcattggggtggagcttagcggcggcggcctcgacgagcgcggcgacgaggtgcttgaagcgggggctgagtccgcggcccccgcgcaggtcggcgagcgcgagactgatctggtcccaggaggggctcctcctcatcgaccatcgccgtagtctcggctacctgcacgatataatcacagctgtcaaattgtaaaatccaaattcgtagacgcactcgaatcgagcaaattttggaacagaaacataatcttcagttggaaccaagaagtggattcagaatcgaagcaaacttaacaaaaagggaaacaaaaatgaatctgaaatgattggggatcaaatcgaagttaaaaaaaaaaacacccgatgccataaacccaannnnnnnnnnnnnnnnnnnnnnnnnnnnnnnnnnnnnnnnnnnnnnnnnnnnnnnnnnnnnnnnnnnnnnngccatgcattccatgccgct

SEQ ID NO: 29935 - DNA, 1697 bp, Oryza sativa
  unsure (1)..(1697): unsure at all n locations
ccgcgtttgaacctcagcttcnnnnnnnnnnnnnnnnnnnnnnnnnnnnnnnnnnnnnnnnnnnnnnnnnnnnnnnnnnnttcagataatccactgggttgatttatcactggttttaccttgtgctttctcagtgtctctgctttttattgtaaaaaaaattcctttaaaggtttaggtgatctactttgttctacatacctttcctaccaaactttaataatctgctgataaggacaacagtaatggaatccattactgcagtgggccttaataataaaattatacctgatttctagtcaattaaagtatatatctaaagtactgattgctatatttttatttttatcaagatatttacatcatcattttttggccatgcggtgtctacatactataaggttttaagccaacaaatgagatatattctgattttctctttggcagagtttgtttggaaaattttgccaaatgtttatatggatgcatttcctttgtctttaggtgcacatgtgcacatgtgctgtttgcttgcttttgtccaaaatatgatttggacttactggagtttgaattatcaattatgttaattggccacatacctatccatgtgcatgagtgcatcgctgttcctagcttttctttttcctgagtggatgctgcttctagctaggtgaattgttcacattcacacatcggaccagggcatgtgttggcccaacttgagattaggctttgccacacccctaagcccaaccttcattggacctgtaccttgcttcaaaggcttgaaaagtagcctcatcctgctagaccaagcttatagggaacagatagacacatctacacacacaaactgaccctggtaatccattaattgactccacatctaccttcatggctacaacatctgtctttcctttcatctgcatgtgcattttgtttctcaattagtttacgaagacagacatttttttccacccatcacttgtgtatctgcaatatttgctttcacttttgaaacattgtaatcacgctactttgtttctgccaaatagttaatcatgctttattgtctgtattgcagtattgcaagttgccgtgaaaggccattctagggaatgcagaaagatgtgcttgcacgccagagatatctcctatgaagagaagggcatttctcccattgatttgacatcactaattcttgatgagcgaggatttcagttgctcacctggtgcattctgcaatcacaaagtaataatgatgctatcaatgtcagaaatactgctatgctagatcatgcaatttctgatgatggttgaagtttttgcttttacggttttcctctaaaattccaataaagaattgtccgctagcattgttttgaatgatggaacttgagaagaatggaaacattctactgcgaaggtatgagattggaaaattattggggcaaggaacttttgccaaggtttatcatggtaggaacatcgtgacttcacaaagtgtggctatcaaggtgatcgacaaggacaaaatttttaaggttggcctaatggatcagattaaacgagagatatctgtgatgaaattagtgaggcaccccaacattgnnnnnnnnnnnnnnnnnnnnnnnnnnnnnnnnnnnnnnnnnnnnnnnnnnnnnnnnnnnnnnnnnnagctctcaattggacat

SEQ ID NO: 29936 - DNA, 2715 bp, Oryza sativa
  unsure (1)..(2715): unsure at all n locations
gtgcgcnccgtgacatacaatcgactgtatacangccgaattctagctcggtaccctgatccaaacccaagaagtagaatgccaattacaaaaataatggaaacttactggttcaagaaaggacttgatagcaagctaatccttaagaacgtggagacaaatgaaccagttacagctcttgctgatgttaatgttgttttctcctccatgggtagcagtagtagcaaaaagactgaggagaaacaggatgcaggaaagctaaccaaccttaacgctttcgatattatttctctttcggaaggctttgatctttctggcttgtttgaggagactgataaaaagaaagaagcaaggtttacatcaagtcaatcagcttcagctattatctcaaaactagaggatgttgcctcatgttcgaagttgacagtgaaaaagaaagaaggtggtgtgctgaaaatggaaggtgcaagtgaaggaaggaaaggtgtattggcaatcgatgcagagatcttcgaggtgactccttcatttcatttggtagaaatcaagaagaacaatggagatacactagaataccaacatttgtggaaggaggacatgaaaccagctcttaaggacattgtttgggcttggcaaggtgaacgccaggatcagcaacctgaagatcatggccagccatagaattgtttcaatgtcgaaatgtttcgttgccttaggaaaggcactgcttatccttttgcttattattcgttctatcttctgtcttcccaaaatccatagctcaatgaaattcgcacaacaatgtaattggattctaaggaatctgaacttataatgcagtgtaatactagttattttttgttgttggcagttcagtgttcgtaattgaaatacatcaaaggataagctacctcacatcgtcgtctggatgaacatagcacctacttaatatttgagtactttcacatgtttttgtaatgtgattgctgattacaggatattaggcatacagtgtcaacagtggtacttacagagagttgcaggtgaatctttgaaagttgcaattgtgtttagaaaagccgaggatttcagaaatttaattgtgtttagaaaagcccaagatttcagaaatttgaagcactcagttaattctcatcattttgcctgttggacaaatgattagtcatttaggtgctcaactctacctccttttcttttcaggactgcactacttatcttttttttttttgaaggattgcatccttttcatccttgacagatcactagcactagttataaaaaatactaatgaaaaacatttctatcctgacactagtagttgtactccaaaagcaatggaaaaattggttgcttgtcggtagtagctgctatataaaaaaaaatcagtgtgactttgctgggtgcaatttccaattgctgtcacttgtctgtaaaagtcatcaatcaacaaaggcaaaggaacaacagctaataatgaactaaattaagtaacttcaaatgagggagcactgctatagtgctatgctacgagtccttttctttttattctccctttttgttggaggaaccagtagccaagccagtaggtaaagaaaagctgcttttatcatactcatccttgtggaacaaatagcaaagacatccttttattttggcttacaaaaaccttatctttgttatgtagtttgctttagactggaaccctgattcattcagagtatcaccctggcccctgaccctgatggagtgatgtgatgtaatgggatcatccagagagaagtgagtggaccaaagttatatatatgctcatggaatctataatgttatgctctagaggcagatatttgtgcacatcacactagtagcagagggaatgcttatcttcatgaaatgtggcaaggggacaaacaagagagccctacctgtccattcaatgtcaaattaacaggaatcctgtctcaggactaaaattgttggggtctttaaagccttgtctggggcatggaattatttcttttttttatgattcatataggaattgattttttttttgtgaaatcctcttgttctgaatggttctcatgagctaaaggccgtgagccttggagcaagctcacaactcacttcatgtttaattagagtacctttacggtagtctctattggtagtatatggctcaaatactctagatatccatgccttttgagaagctcaaacttgaattatagtatgtcagtgttgttcgaaactcggaactgaaatatgtgaagtgtatgaattaaatctcccaaggtgctacaaattaaattctaacgtcgacaatatatgccgttcactgtagagtttcatttaataagtgaaacttctgcttgagattgttcttgagcctctggtccaaaacccaccaatggtcaagaaaatggaggtcactttctccatcgtttgcaaaagctactttgattggcattgcattgatcatcaacataacatggttctgcaagggccacatcatcatcgtcatcgtcatcgtcatcgtcatcgtcatcgtcgtcgtcgtcgcagtagtatttgacggacaaaacagtgggaatcaaggcatcaccaactcaagcgtgctgagagctacctgcatattggtgcttggagtctcagtgagtgcttcacatcagttgcaacttgcaagtttgccaatac

SEQ ID NO: 29937 - DNA, 1248 bp, Oryza sativa
  unsure (1)..(1248): unsure at all n locations
natatgggctaatagctagtcttttttgctgcctcaagtaagtgctccaaagaatttcgtggaaaatagttcgacttgtgtaagtatccggggaatttcatgtggtcaaagcaattattgaaccgataaaagagattggcttcagtttttggcttctgacttgctttcgatcgagacatttctttcgtaggtaggctgccttttccatcaccttgcttatgcctccttaatacggagtattgcaagtccaacctactgtttcatatttgacaatataggctgaccatataagcttttgaggtaatgagaaaagacggacaattcatttatccttcaatagaaataagaggcacacaatcaaatttggatactcctttattgtcttgatctcaatactctaagtctcaatattttgaatagtcaaatggcagacgacggtaaaaatccatgtcctcttttataggttcgtgtagttcaaaagttggatttgtcggtacagtagttaaaggttaatccaaaggaattagtaacaagaaaatgttctcactttaccttttaacccctttaaataagctccaaatactttgtactgaaacttttgagatagtaccgcttgcactgtacatatagtttgtgccaccactacatagtggtgtaaccacgattgagtaatttaacttattgaagccacttaaaagatttacagcaaatcttgtgtccactttaaggcacccaagatcaattcaattattctcttgcctacttcatagagaatttctgggattatagtttaatttcttgtttgacttcacacaatggagtttatgttgcaataaaagtgttttcgcggcagaatgaaacctttgtaaaggcaatatcctgatcgacacatatattatagagaccccaggcaacgtaaatattcccatttgttactgcaaaggcatttccttttggatattaatgggtgaaattgttccttgttgcactagatctatgtaaaaactgttcgaaaacgcactactacgagaaagattttcgtgtgcggtcaaaaccggttttcgcgtgcgggtgagcagcccaccagcacccagggtctgcaaaaaatcaagattttggcgtgcgggtggcgcaccagcacgcgaaaatcagattttcgcgtgnnnnnnnnnnnnnnnnnnnnnnnnnnnnnnnnnnnnnnnnnnnnnnnnnnnnnnnnnngtgnctagcaggcggtcatcaatggcg

SEQ ID NO: 29938 - DNA, 1295 bp, Oryza sativa
  unsure (1)..(1295): unsure at all n locations
cgcgcaattggattgcttctctcnacgcnnnnnnnnnnnnnnnnnnnnnnnnnnnnnnnnnnnnnnnnnnnnnnnnnnnnnnntatcttatcactttatcaatatgtttgcataatatatctttgctagtggttttatttctttgcctaggaatcttcattgggatttttgtaggggataaacaatagttgtcgtctccaccctacacatgaaattcccattgtacgcttattgaggtagggaaaatgtttgtacttagcttatcgtcttatttcccatgttcaaccactattcccattgtatgtctatttcttatgtgtacaatgggaatttcattgtatgcttattgaggtaggaaaaatacttcattcaagaaatattaatttgttgtgtccaccctacacttgtggaaagttctaggcttgattcgatgaagacattggaagagcctaagttgatcgctgaggagggagaggtaatgcattgttgcttcttgctcttcctagcaccaacgaccgctgcataaccttgttaacttaaacgaatcaaacacaacatgcctgccaattagttatggaaggaaaaaagtaataatggtttaaccctacttacccatcctcaccgatcaggaaccaaacataacaagattaaggcagcaagaagagaataataagatcaggaggagaagaagcgttggcggctagcagggtttaacttaaaccacattcgaaaccatcaatttcttcttgcgcattccttcatgttgtgagggtaaagacacgactgtgttgtttcaatctcaaccattagtttgctgtaatttcctggccttccaggatgaagattagctgaggcggtgttggcatcgcttccctctatcgaatgaggcggttacactagcaatgaggcaaggaaagaacgattgatggagttatttgagtggaggaggccgggatgttttgtacgttgggcttacgaccggctgcgttactagtttgttgtggtagagttgcgcgcctggactgattttggcttggctggtggcggtaggtgcctagtctacagtgaccactgtctccatatcctaacaacacacacataacctctatcgctcgtttctatgccacacaatcgaatgaaaactctactcgagtactttaatgtgaaccgacaatgtatgacaccaaccatcagtaactattgcannnnnnnnnnnnnnnnnnnnnnnnnnnnnnnnnnnnnnnnnnnnnnnnnnnnnnnnnnnnnnnnnnnnnnnnnnnnncatacaatgcccg

SEQ ID NO: 29939 - DNA, 1541 bp, Oryza sativa
  unsure (1)..(1541): unsure at all n locations
ttaataaaaatatttctatgtgttgctcgtatttgaaggggcaattttttgatagaacacatcnctatacattgataattccgatgcacaaaaatggttgagaagacaaataataggatggataatatcctccacaataacatgagaatggaaattttagagtctgtgatttgtcatacttatctaaaggaaaactcccagtaggattaagacatcaatttaccatgattgatttgtaccaaacctaaatattatcaatttatcagtatgtttgcttaattatctttatgggtgtttttatttctttggcgagtagccttcatagcaattctcataggggatatgcaatatttgacgtctccaccctacacttcccattgtatgcctattgaggaagggtaaatgtccgtacatagattattgtattatttgtcatgttcaagaaatattcccattgtgtgcttattccccatgtttacaatgtgaatttcattgtatgcttatcgatgtagggaaaatgcttcattgaagcaatatttgtcgtctccaccctacacttctcaacagttccagggttgattcagacaagatattggaagagtctaacctaattggcatggagggagagttattatattgttgcctcatgttcttctgggcactgacaaccactacataacctagtaaataataacgaatcgaacacaacatgtttgccaattagattttatggaagtacaaaagtaataatggtttagccctacttacccatcctcaccggccgggaatctaacgtaacaagaaaaatataataagatcatggtggagtagaagtgttggcggttagcaatgtttaacctaaatcacatgcgaaaccaacagtttctccctgcgtattccttcccgttgtaaaggtaaagacacggccacaccgtttcagtctcaaccatcagtttgctgtaatttcccagcgttctagaatggatattagctaaggcggcaagattaaggcaacaaaaagaaaataataagatcaggaggagaagaagcgttggcagctagcaagttttaacctaaaccacatgtgaaaccatcagtttcttcccacgtattccttcccgttgtaagggtaaagacacggccgcactattttaatctcaaccatcagtttgctataattttcttacattctaggatggagattatatgaggcggcatcagcgtcgctctcctccctcaagtgttgtgcttatagtgccaatgaggtaaggaaataatgatcaatggagttttgtttagtggaggagcccgagatgttttgtacattgggctcatgatcagtagaggtactagtattttgcggtagttttgcgagtgcgtggactgccttttgctcagatggctgcggcaagtgcccagcccatgatgaccactatcttaagggtatatttgggagtgagggttgnnnnnnnnnnnnnnnnnnnnnnnnnnnnnnnnnnnnnncaatttaataggtccctgaaaatcaagagattcatgtc

SEQ ID NO: 29940 - DNA, 775 bp, Oryza sativa
  unsure (1)..(775): unsure at all n locations
agcgttnnnnnnnnnnnnnnnnnnnnnnnnnnnnnnnnnnnnnnnnnnnnnnnnnnnnnnnnnnnnnnnnnnnnnnnnnnnnnnnnnntcaccaatttttgatcttgccgatatttctatgacacaatggaggttaaatgatttatacatcagtactttataatacagttcagtatcctagtaatttaaatgttgatgttatgtgttttttttacctcgtccttctcttctagcgagatgacgctaaccacagattcaattccctgtggaggccttcctttagttgtttaggaagattaccgttaattatcttcttgaattgttgctgatggagataataaaagcagaacagagcctagttccgcctttctcatccattccaatttcctgataaagtgaacgtacatcagtaccatttgaaggatacgtgcatcagcaaaataatgaaattcttgaaccaataaatattcccaaatcgaaatttgaatcctaatcctcgtccaaaaaaaaagaaaaaagaatcccaacatccggttttgagcaaaaaagcaacagaattttgatctgtttccaatgaaaaccttgttgagcagaaatttggaaaccgatgaaaacgtgagaacaaagatggcaaaccagtttgagtggaaaaccaatcggtgcagttaaatcgacgaaatcaaacaaaaatccagaacatctataggctcaacaaacgtatattacanatcgacgaaaaaagaaagagacccagcgcatgtgcaagccccagaag

SEQ ID NO: 29941 - DNA, 762 bp, Oryza sativa
  unsure (1)..(762): unsure at all n locations
acggtttgaaaatcattcgcagtnnnnnnnnnnnnnnnnnnnnnnnnnnnnnnnnnnnnnnnnnnnnnnnnnnnnnnnnnnnnnnnnagccactcctcgccgccggcacaaccaccaccaccgggctttctcaccgacaccaccggcgacggcagcggcagcctgacggccaatgttctgcacaatgtcaatctcctgcatatcaatcacactcccaaccctgaaatggtggaatacctgctagtattccactgcagatcaaacactttcctttggttggcttgtagagtagagatagggtacagtctgcaaacagaattggttcatcggcactggatataggatacagcttgcattgcaacagagtttgcagaatgcatggctttactaaagagggatcacccttacaatttttgcgctgttttattggactgaaaattaacacaaatcaatgtacccagtgacttgccatcagccaagcagctgtcttttcggtttccagattggattcgggtaaagtttaagactccggaagcaggaattttaggcactgtattgccattagataatcgggtggataatatacatattggtttgccaaacacttggaacaggccacaaatttcgagttaacttttatttgattgaggatttcacaaccggtttatacaaggtctagtacccaagagaaaaatagcgtctgaaacaaacaaaggacaagaaagaacaanggcctgttcctgtcaagacccatgttcactt

SEQ ID NO: 29942 - DNA, 764 bp, Oryza sativa
  unsure (1)..(764): unsure at all n locations
agcgtttgacgatcattctccnnnnnnnnnnnnnnnnnnnnnnnnnnnnnnnnnnnnnnnnnnnnnnnnnnnnnnnnnnnnnnnnnnnatcaatatcatataaaggtcatgctgatcatacttcagaattggacaacattctaggaacactcactcctgttcccattccagcacccttcaaaccagcttctccatatttatcatagattgatcgcttctcatcatcagacaaaacctgcaatcctatttatgttagctggcaagcacctgtaaccctacaacaacatagtcataagaaacaatgggatttggttatggttagctggactaacctcataagcattgctaatatccttgaacttttgttcagcaccaggatctctaaagaaaaatacacaagcataacaattgcttatttgattatgtagttatgaaaaaggtaatgcaacaactagtactcaggtttataatggatcgaaaggagaaaaagaagcaatatatcgagtgtagctgaaacacaattcccatataatggttagtacttacttgttcacatcaggatggtagctcctagcaagcttcctataggctggaaaagaaggaccattttagaactacaattgaaagccacattaaactactacacatattttgatcaaaattgactctgaaggattctaacataatatccccttaggcattattggataggacacattctagattatctaccggtcgtgggntgggnatttttgttcaaatta

SEQ ID NO: 29943 - DNA, 1369 bp, Oryza sativa
  unsure (1)..(1369): unsure at all n locations
tgcgcnagtgagaactgatcacctttggcgaattcgagctcggtacccgttgcacgcatgatatttgacaaagcagtcggtatatcactcggatcatgttattcagggattcacaccgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatgtaaccgatcatgacttgggtattacgtttccttttatattatgaagcggcctaaagtcctgatttgataatattgtaaaatagatttaggaaaccgataccgtatgggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcatcgagagggcctgaacctgtctaaatcctttgtctctgcatccatccacttttaggtctcgtgcgctaccccttttattattgccgaattcatgtttcgacaataatcattaaaacagcatcaacaaaaagatctaattatcacgagatttcttcagtacgagctttgatcatttggaaaggcaaagcaaggggtccatggccacgaactcctgttcggaaaaggaaaagaccaggatgcatagcatagcagtgagagagtacaattaatgatcgatagcaaaaggacgatgcgacgctacatgaaaaccaaaaaaccacaccagcacacacatgcatcaatcggcattattgacgagtgaggaccccgggcatgtaatcgtcccgtcctctgtggagtgtggatccagcatattgattccagattcagattcagctatgcaccgaatcgaaacgacgttggttgtagcgtgctgcgtgcatcgtcactgtatggtggtggttggtccaggtacgctcgctcgagattggagaaccaaccgggcgggccagacgacggtgggaccgcgcgcgcgggggccatctnnnnnnnnnnnnnnnnnnnnnnnnnnnnnnnnnnnnnnnnnnnnnnnnnnnnnnnnnnnnnnnnnactagncagtcatcaaagccgcgcg

SEQ ID NO: 29944 - DNA, 1110 bp, Oryza sativa
  unsure (1)..(1110): unsure at all n locations
atgggcnagtgagnagctgatgaccnnnnnnnnnnnnnnnnnnnnnnnnnnnnnnnnnnnacaaccaagaacacctcatttggtgcacccaatctccaggaacgcgacctttttaactcggaacaccgtagcgctctggacgccgcagcttcacctttgcctgtcgcccggcttcaacagttcgtaacaagctgagccacttcgccacgagcttcatcaacaccttcagatcaagaatcccgaagtaatcgacgcgaggtggaccacgatgggagatcctcttcttcttccccaattccggccggcgacgccattcctttctttctccttctctgggcagcttcggcgcaatctttttcgcctagagctaccttgtgctgatctaaaccgaagcacgtaccctttctatgcagtacaagcccgggggtacaccgtagcagccgcgccgtcgccgaaccagtacaccatcgccaagacttcgccgagccgcgttcgcttcttggtgagtccctagagtccttaccatacgcatgcacgattagatcgagcctcaaaacccacatgcatgtgcaagccgagcttagccactgcctctaacaccctaacagccgctatagagcaccaaagcttgcaataaagccaccaatgggtttgtatggttgttctctacacttttcgttttgggagcttgagctgaatcgccgccgttcgccgccggtgatgctgtgaagctcgcggctgtgctgctactctgctctgtccagagcaagggcatggcttttaaaatttaaagactcccagggatgtattaacaactcgagcagtcacttacaagtgggaccaatactaatctgtaaataaaataaaacgcaagtgtcgttttgcataaaaacctaaaccacgtgctaggggctgcgggacctattttcccaagaacccaggggcttatgcgaaaaagcttagtcgctgactggtggacctgagagagtaaatgatttgagaagattggagaaaatgcaaaacttgtttcttattaactgaaaaatgacagaactttagaaatttgtagaaaattcatcctaactataaaaattgaactaaattttgtga

SEQ ID NO: 29945 - DNA, 2140 bp, Oryza sativa
  unsure (1)..(2140): unsure at all n locations
acgcgccattggtggagcaactnnnnnnnnnnnnnnnnnnnnnnnnnnnnnnnnnnnacctgagagagtaaatgatttgagaagattggagaaaatgcaaaacttgtttcttattaactgaaaaatgacagaactttagaaatttgtagaaaattcatcctaactataaaaattgaaaactaaattttgttggaatcatattttcatgctctgcatataaaaatgtttaacttaacagaatcataaagatttatgtctcaaaaatccgaaatgcacttaggaccatatttaacatgtaaacactttaaaaatctgtaactttgaatgtaaattgttagattgaagtttctttcattaaaaatcaaattaacacagagcacaccaactccataaaaagcattcattttagagcatgttggatttttatgtatgttttaattttaatttttgcatatgtatgtttagacgattcgccgccgagtctcgaggagatctactttggagctgaacaaggagtggaagagcaaggcaagccacctcccctctttgatcacattgaacctatgatttggtggtttttgaaaagtttgcaaaatatgcatgtctattgtacactaatccattaaaatcttgtaaaatttgttagatcaactcctttacttgcattatcacctaaactccacaaaagaccttaaccattatttcaaaccttaggaacaattgattgtgtcacattaagaacgatgtttgaagtcacaagtctatagaaatgcttagccatgcttagtgatgagtttacttaccatttgggctcaattacatatatgaaatgatttattttgtgatctgaattaaaatgataaaatgtgatatttgttaaataaaatgttggaaaatgtggattttaagtttgggcctcatgtggtacacatatggtgtttagttgtgtgtcgatagggggagaatgtgcccagaccgacctaaggacttcactcaatgtcagttcattttgtatacagtacaaccacatgtgctagtatgggatagcccaagcttagtaaattatttatggtttagccttacattctggtaggccggtgtgtatgagttcgtataattcagaggagctttctatttaccccgaagtggtagtttaggtgactaagtgtgtccaatacaatgctattgtgccacgtggtgtgttcccgttgtgtctgccaccacggcgttaagtttaaggcgtggacctgccacttaacggttctaggtcatatatcgagtatggcttaggatggagtaacacgtatcgtgctggtgtaagtgctggtgtaaggctaaatcatgaatcttggaagggctttgttgtgagtaataaatcgggtgcttatgtatcgcgtgccatgctttttgcatgattattatttcgcatcatgtgggtaaagtgtacgtactctgcagagttaaaactaatcgattagccgtgctcgctgtcatgagcggcgtgtgaatatgtcatgagtatagacatgtgttttattcttctaaagctgaatttgaacttcaaaatgtgatgtgatttatggattatatccttgctgccatggaaggcaataaggagctatgttatatgtgtttaacatctattttgatgcccatttgctaagtgtatgcttgctgaaatttaattgaaaataaatctgaatttgaaatgttctttgcaaactaaatttgctttatgctaaaattatcccatgtaagctttactttgaatacgccatgcatgtagagtattaggcttgcttggtgcttgccagtacaatttatgtactgactcttgcgtgtattgttgtattgttgcatgtttagaattggttgcaggtgagatcactctatttcgatggggatgtttctttcttccaggatggttcttactagggtctaccctagtcggttgcaggaaagatcttttgggtagaagatgcttccgcgaacctaactattcggccaatcggccatacttatctaagttataagttgtataaacttaactnnnnnnnnnnnnnnnnnnnnnnnnnnnnnnnnnnnnnnnnnnnnnnnnnnnnnnnnnnnnnnnnnnngagtagtcaattcaatgncgcgg

SEQ ID NO: 29946 - DNA, 2690 bp, Oryza sativa
  unsure (1)..(2690): unsure at all n locations
tgggattgattgcatttcnnnnnnnnnnnnnnnnnnnnnnnnnnnnnnnnnnnnnnnnnnnnnnnnnnnnnnnnnnnnnnnnnnnnnnnnngaagatgcttccgcgaacctaactattcggccaatcggccatacttatctaagttataagttgtataaacttaactaaaacttagaacttagaattccctatgttgagatatcatgtgcttgaatgaaagtgtttagtgtgttccttttgttagggacatattaaacatgagtatgagttaaagatatttgagatgttgtagatctttagccatttttgttaagtcttctgaatgtgtaacacatctggttgccgtcttcgagtggtttgacaggcacatctcaagctgaagttgactggcaggctaaaggcctagcaatgtctcacatatctttctctcggagcgtcgaatgtcttaatatgtttgatggaagaattgtgtatagctattcatccttcaaatatactaatgggttcggagtgcttccgacactaaatcgggcgaaccatatattcggttcgactgtctcaacgagagattcaatatggtggactcaaatatatatttggcctcatgttgttggtggttatggtgcgcttttttataactcaatcggaaactctccaaaatgttcagaaatgaacttatttatgaccttaccttgcaaaacatgttgaaccaataaaactcatggaattctgttgatttaaaaaagaatggcaaggtaacatgttatcttcttttattttactaaaatgttggtggttgtattatgtttaatgacaaccaacacctacagtattacaaacacgctattgattagcccatagagattagagtcttttcctacccacaaaacatataaatttgaaggtaggagtatttccctttgtttttcatgtcctctatgtaatcttcaagtgatggtatcttacacaattattaatacaacatgtgctttaaatattttgaaaactcattcaaacataaaaacaatgaaattactgtcatactgataccatccaacgtatcaaatcttgtgcattcaatactgcatttatatatgccttgcctacattgtttttattccctcaaagcattaaaaagaatatcaccaaatctgtttccaccctataaatagtatctcttcttcatgtatcaataccaatcttggaatcttccaagataatcacaatgagggaaagtcgagtgattacagtaactcttcttctatcgcatatgttgttctaatcataggggggaagaaattcagtatataagccaaaggggaaatactagtcaaggtctcacaaattatggggttaataaaaccatcgaggtaagtgcaaaattagatctttttgtacatacatagcatcttgttttgtacctaacaagcaaaaagaacatcgtatcaggctgaagatggtgatgtctatgattgcatcaatatgaatagacaaccaggctttaaccatccattgttgaaagatcatacaattcaggtaaagcacatatttcaccctaacatttgatatcatgtctaatatgttgctaaaaaattctgaatacatatatagagagataataattaagtatgttattatagtcataaatcaaaatacaagagttttgggggactatagtattttttttttgttgggggggggagactagaatattcactaattcagcttgttttggataaaatagtaaatttatttgtttgttacacttcgacctggcactaaagccaaaaaaatttgcgtatctttgcttcatcatgaaagaatgtaaagtacaaaccaaatcatacttaggattttttttttcatagtgcgatgtaaactcatcgtttgtaaaatggtcatgttttcgtttgtcaattagttgaaaccaagctctttactaatggagatggatgttgaaaatccatttatatcttccatatcagaagcacaactacctagctactgcagaatgccctataggaaccatcccagtactacgcaacaagaaacaagactatctcaattcagaataccaatgcagtcagcaccagtcaacaaaaaaaggtaagatttttgtatcgagttgttcatatgtctagcttcataatagactcacaaaaccgctatattactattggtctatgaaaaagctatacaaaagtattggatgttttcatatttaagtgctaataaatgaactcaatcaattttgttaaatgaaatatgtgttgctctgtataactcaaacaaatacacaaaacctagatattccctcgaccttgcattgttttagtttggctgcttgtattttctattttatagataaatttataagtactaaaaattacgcggtgctaacgtagtatgttacatggtaaatataaacatatgaattccatttatcataatcgaacaatttaaaatatatcagtggtcaaagtagagcaagcaccagtcaagattataaaatattaagaaattgatggggtattatataatggccccttaatttgaagtgcgatttgttagtaagattatggtttttcactttgacatnnnnnnnnnnnnnnnnnnnnnnnnnnnnnnnnnnnnnnnnnnnnnnnnnnnnnnnnnnnnnnnnnnnattggagtgtcattcaatggccgt

SEQ ID NO: 29947 - DNA, 3206 bp, Oryza sativa
  unsure (1)..(3206): unsure at all n locations
cgtcccattgaacgcttnnnnnnnnnnnnnnnnnnnnnnnnnnnnnnnnnnnnnnnnnnnnnnnnnnnnnnnnnnnnnnnnntaaagcccatttaaaaagaattaaataaatttaattctatttatggataattttaatatgtagatctttattttatataacttttgcaacttgaaccacattaaactgagttacaatgaattagttatgaattttcaaagattaaatcggattaaatcctttatatagattttaattgaattatgacgtaataatgaattatttttgaaaaggaatagaggattattgcgtcagcgggtcgggttcatggtggaccgggtgcacggcggcggctcacggaaacgaacggccgagatctatcagtccacggccggaccacgggagacgacgacgatgacgtcagcggtgacgtcatcaccagcgacgacttgggcacgcatgcccgccggcgaacgacggcgcggcggcgcgaaaggagagcaccaaaacgatgcgggtgacgcagcgaactcaccggtgaccaaaacaacggcggaagatcaacggacggcaacggttacgagcaagaagcggcgacgaccttcggcttgacgacggcgatggtgttccagcggtcgacagcgacggcggaggggcggacgagatcggcgacggcttggtgatcccgacggcggctttcccgagcgacgacgacgaccggagcgacggcggcgcacggctggacaaacgacggcgcaaaagctcacggggctagggcgctacagacggcggcgggcgaaggcgagagtggctgcgggtagaggggagctcgggggtccttttataggggcaaggaggcggcggcgaaggcccacggcgaccggcgacgcgaaggaaaggttagggttcggagagagagacgaatccgattcgagatcgaatccacgagtttccaaaccgaattaggcgatgattccaaaagagaaaaggtagaggacatcgagaagatcatttcccctctattgatttcaccggatcgggaaaggggcgagcgaatttggaaaggcggcggcggtgcggctcggctagggttcggccgggcgacggctggaggaggaagacagccctgataggtgggccccacctgtcagcgggcgaacgcgcgcgcgggcggctgctgccggactgggccgagggagagagagagaggttttgggccggctttcggcccaaagccaaaagagacttttaaaaaccttttttaatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatattctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagctccgaaaaatccgagaaaatttcagagagtatacttaatcatggagaatttaataaaagttaaatccatccatgctttaaatttaggaaattttatttcccacatttaacttcacttgtaaattaatgaacatttaatataaattctaataataatttattaaataatttagaaatcctgaaacaaaaatcaggatgtgacaattttctgggtaatcaatatacattttgctacgaatacattggattatacagtacatatttttcctactaatttataccgctttgagatggtatagagctatattttccatttttaggtattgactttggaataaatttcgctacagaatgatgaagcgcaaaacaaatcttgcactgaccacagccgtcctggtttcgttcaagttagcagcagtgttgttcttggatgaagattaaaccatgcttccgtctataatggaacacaatatagaattcaagttcttatatttaaggtactctctattttacatgaaattcaatatggttaaaattacgtggttcactattatattaattaagttactcaagatatataagaaaacaccaattttgcataatatgttatatctacatactatattcagaagtacatctgatgcatcaagagcaatgcttagattatcttgcatgttagcacaacattactgttggcggatggcatgaggcctttcgaccaaatctgccgaaacccgtggcaaaggctatggagcaagaatggcgagaggcgaggggtcgtgcgagtaagccagaggcgtcccaggcgaagggtgcaaggcgaaaagtatctgccgaaggaagacgacttcgccatggcaagttcgctcccgcgagggccgaaaaagtctttccgacccatcaggcctaggggctatagggccggcgatcgcccgacggcccatcaggggcccatgagcctccataacattatgtacccctgtaaatgtccctttcgtaagggcaaccatgtaaatttccctgtataacctaaaccctagtagtaagaacctgtaatggggctataaatagtcccctagggccatgtaatggggggatccggagtaaaaaattctaaaattaatacacttcgtttctttccaaccactgttgagtaaccacgtctttcgacgtatgcagttgtcgtttcgacaacaattacaataaaagaagcttactacaaatcttagatcataatagacatttccctagggtcttccaacaataccatttcactttgaatagagaaaagacgttatattatactaactttgttcccaaatacttgttagtattgaccatcactattctaactttaattgttaataacattaaggggcaattgtgtttctgcccttgctttacatgtcaattgtgattttacccctactttttaaggtttgtgattttgcccctgcttttttgaaacgaagcagccgtctgcccctggtttggacggtagtttggtgggcccaggatttccaaattaaacgaagaaagaaaatgctattataatttgtgaatgactattctannnnnnnnnnnnnnnnnnnnnnnnnnnnnnnnnnnatactagttgcgcgn

SEQ ID NO: 29948 - DNA, 4082 bp, Oryza sativa
  unsure (1)..(4082): unsure at all n locations
aggcatgtgccccgtgcacactttgaacacaaattaaattattttaggacccgaagactaaaaaactgacggttggtatatggtgagaagaatacggcaataggatattggccaagttctcaattcagttacatgaaggtaatgggcagttatacaaagtggggtggatatgttcagggtccaaccgtctaagaaaattctccacaaatgggtaatagacattttgcttcagaagcttatggcacagtggcttttattagggacatcctgatcgtgaatgagaacaagaagcttgttaatccaaaccccgttaaagcctatgcaggatcctgtaatccaagtaaatatacctggactacctatacatttgtcgacaaatttttcctcaaaaattgacagatgtaattatagttcaatcgtagtgtaattacactgtaacttatatgtaattacactgtaacttgcatgtaactacactgtaatttatatgtaagtttcacataattttgaatcgttagatctattataagatttattttgatgagaaaaaaaaacaaatcatagcacacacatatgtgaaagaatttgttcccatgacctctattttaccaaaataacatgttatggagagatttttaaaagttacatacaagttagttacagtgtaattacatgcaagttacaatataattacactacgattgtactgtaattacatctgtcaaaggaaaaatttgtcgacaaatatatagcaaaatcgaccttcgatagttatggaattaatgcttactgtatgcatgtatactacggtggaccaggtaactacagctaatggtgtactctgcaagctataataacatatgtaattgtatgcaaaataacgggattcaagggctcaagccaccaccatggatacaccttctagctataatttcttcaattatttgcaaccactttcccactagatttttttttttgtaagtagtaaagatctccttttgtaatgaacaagtgggctatgcaaattaacagaccaagataacacacatagacaacaggtagagaatctgattcaaggaaaatttgcacaatggctaactagagaacaaaaaatagggtacagacctgaacagcccacagtaagaaccaaaagatcaatcaatggtccacgtgtaaaagaattacaacagataaagctgtgacagtgtgaaactttgttcctctcgccgtcctaattaccttccctgtgtgacttacaacctagtcttagctctgaatcaagttccttccctggagcgtctcatgctctcatcaatcaacttgaatgtcttctttacaagtttctggtctagggccgtagttctgtagattttgaagacgcggtccacacggtcaggcttgctgctctggaagtagagctcttcaaacttcttcttgacaaacctgtaaaacgtcactccagaccataagccacagtaatgatgaacgtttgatactatataacattagaatggaaaaacttatcaaggcatataagtgcaccatgcagcaacattacaaatggccaaatgcccatgttcatctgagagggcgagtagtgcactcactcatatgcatgttcaacctcctgtttcccaggtgcaataggctggtagtctttaaaccactcgcacacacttaaaggaacctacgtaaccagcgtaaacataaatgttggtaacatttagtactaaactatgcattggtacaaagagcaggccttaccttttgtattttcttctcgaatatatcaaatttgttgagaaacagaatgaatgatgttttctgatggtcaatatagcaccgtaattagtttcaaaatgagaaaaaaagcatgagcacaaaagttgcagagatggatgcatgcagacctcaaaacatctttgctttaaaacccagtcaaagagttccttgggctccatcattctgttttttgtctcatcttcaaatagcatctgatcatatctgaaatgaacaagaagcctatgagaagaacttagcagattatgataagttcaacaatcaaaaaaattgtacttactcgctaatggcagcacaaaagattaccgcattaacaccttcaaaaagatgaatccactttctcctctcattcctctggcctcctacatcatacaacctatatacctctccacctcttttgttttctccaacaggactgcagaaagaaacccagttaactagatgattcaactcatcttaaaacagctacattcagaacctctcaggtcatatcttagaagtgaaaggggagaaaaaaaggacttcaacttgtcgttctgtacatagtagagcaaccagcaaaaaaatgtgcaaaaaatagtgtcagcagattacctaaattgtatttgtacaacaccatttgtccgtactcttgcataaagcacatcctcctgcaaaatgactcataatattgacaactataatactgcaagcattcttaagtatggaagatcaactaccagcctttcaaacgaaccattagacaaggtacaatcacaaattatccatcagactgctaaatgcagaaatatggagtcatatcttcacttagcacacacaatgttaattggaattttgatgcagtgtggacttaaacaagtgacaaacaattttctatgcttaagaaatgacgggaaatggttgcaaaagtggatggtacagtgatcatatttgtggtttgcaacttattgaaggaactggacaaaaaaaatatatgctagtgtcataagattaatatgtgggaactcaaaagctcaaggtgcttagataagtagagttttattcacagcagttttgcaccctatgtttcacagggacattttttaccttcgttatgtagactgcgtaataacggtagaataatagtttctcctccctaatattgaattttaaaggatagcctccaatattatttaaaagataaggataaacatatgcccatcttttaaaactatttggcaacctctgactcagtacacatagttaaccatttgacaacctctgactaagtagactaaaaatcaacatgaaatggtgtcagcacaaatatctgagaatatgtaaataattgtctatgaacatggacagcacacctttgttggcacataacctgcttcagctaatcgatccaaattttccatgaagtattgtgcacaatcaggaagttgcagaatacttccacgtaagtaagtttcctacagtatagagcattgcttcagcacacctggccaggaaaactatataacttcaaaagatttgaatggctatttgttttcacctgaatggctgggtcttgccataacctttttacatcgagtacaagttctttgttcagcagtggataatccaacctgccatcaatatctgatagtttttctccaatttcctgatgatatgacaaagtaaatgacatctaagaaacaaaattggttggtaaggtgtacagtgtgaaactggtgatatttgtctttcaatgcctaagaaaagtcagttttcctttaaagttccaaagcaacggaacaaggtaaatgcacaaaggtatactttttttaacctggttgagaaaaaaattgaatcttataacacccacatttgataccaagttatttttagcatatcaacaattgtctgaagcaatcaaataaacaaggaagaataaatgttacaaaatctcattgttcttttctactttgttcagtacattgtacggttcaatagatatctttttcaagttttcattatagaatgaccgtgtaaaatataagactacaatagagccgagcacagtctacaaggtcttaacaggttaaaacatagagccgagcagcttgactacaacagaaatgttgcaaatcaaaatgtttgtattcccagatttaacaagacatgttcatatgcacagatttagctttaactgttgagtaaagagtaagcacaaannnnnnnnnnnnnnnnnnnnnnnnnnnnnnnnnnnnnnnnnnnnnnnnnnnnnnnnnnnnnnnnnnnnnnnnncaataatcgcg

SEQ ID NO: 29949 - DNA, 2664 bp, Oryza sativa
  unsure (1)..(2664): unsure at all n locations
cgcgcttgttgacgccttnnnnnnnnnnnnnnnnnnnnnnnnnnnnnnnnnnnnnnnnnnnnnnnnnnnnnnnnnnnnnnnnntaacctttttacatcgagtacaagttctttgttcagcagtggataatccaacctgccatcaatatctgatagtttttctccaatttcctgatgatatgacaaagtaaatgacatctaagaaacaaaattggttggtaaggtgtacagtgtgaaactggtgatatttgtctttcaatgcctaagaaaagtcagttttcctttaaagttccaaagcaacggaacaaggtaaatgcacaaaggtatactttttttaacctggttgagaaaaaaattgaatcttataacacccacatttgataccaagttatttttagcatatcaacaattgtctgaagcaatcaaataaacaaggaagaataaatgttacaaaatctcattgttcttttctactttgttcagtacattgtacggttcaatagatatctttttcaagttttcattatagaatgaccgtgtaaaatataagactacaatagagccgagcacagtctacaaggtcttaacaggttaaaacatagagccgagcagcttgactacaacagaaatgttgcaaatcaaaatgtttgtattcccagatttaacaagacatgttcatatgcacagatttagctttaactgttgagtaaagagtaagcacaaacctggttatctggggatataacatactttgaggaatctgattccacttgtgagagttcttttgctccttcatatagtatctgttaacatttaacacattactcgacaaaaaggaaaagtatgaacgcatttccttatgaacagaatacaaatccctagtcgaatctcctacataatccccactttgcaataagaaaaaaaagacacaccctttccagtattgcatactttaattgtctgatagacgtttgcatggataactgatgtgtagctcctaagttctgcctcatcaaagccagtttggaaaaggagcttaatctgcaggtgaacagtaagaatacatcagactaactagcggcgtacggattatgattctccatggaatataacattcatcacctgtttaaatatcgtagacttccctgattctcccgcaccttaaaacagaagcaattgagagagagaaagaaggatggatccacattgagaacaagttcaaactaaaaatttctaggatacatttatttatcttctttttttttggaaataacatgagaaaggtttttttatagaggtaaataggaacaacataaacaattaattttctgaaccaatagatactaaaggtagcacagataattgtgacaaggaaaatgaccacttaaatttgggaaagttagcaataccaagaagtaagagcttgtggatgtgttgctctgcttttgtctcttgcaaaattcgcctgtcaatgtctgcagactgttaccagctgaattagaagaaaccaaatgtggcaactctcaaatcaagaattgagttagcatttacttgttcaataagtccgagtgctaacttacttttgcatttttggttgtttcagcctcacttaaagaatgagatctgctacaggatgagcccatgttatcaagcacacaggtaagcacggacattattttagaggtatgctctcatgcctgagcctctctctttccaggaagcacgttgacgtctagatctcaggatccatgagctgcatacatgagcagtaagctcgagcgaaatgtggccagcatttgaaaagaaaagattgtacagagtaatggtttgcatagttcaatattgctgacccacattgttatacatatccagaaatattatatgaaggaaaaacattagtaaccattttccgaccaggattcatttccgaccaggatccatttcaatcactgacacttaataaataatacgtgaaaatatttagaaatacatcaatatcattgtttaataataatacatcaacatcattgtttattaataatatttttccttgcgacggtggggaatgggggcaaggaaagggaaggtggggggattggatggtttgagtgactcggggagggaagtggagcgaagcctcccgggagataagatttgcgcagaggcacgcgtggcctacgcattggcaccgctggcctccatttgggccgtcggcttcacatctgacggggttggtgtcgagggctcggggccccggtttttgcgttttgagggaaatgcgttccatatgtttccgacgaagagtattccagaataatacctactacattttttatttcttttgatgaaagtaggtaaggtgtctattttgattggtaataaagaacatagtttacataaatattacatatgctctagcagataaatagttaaaacataacgattttttaccataacngtggggggagccaaactagaaattaagaaattaggaagtaacatttaaccaaagtgcattctattgtaatagattgtcctggcatatatcattttgttttttaattcaaactatagttgatttgatttactaatacctanattaaatatctatatattagtctaaatatttttaaaataaaaatataaaatttttcagattttcact

SEQ ID NO: 29950 - DNA, 1173 bp, Oryza sativa
  unsure (1)..(1173): unsure at all n locations
aaaatggtgaaaaagaccataatttccaaaaaaaaaatgaaaaccccataatcctccggcagcggtgcggcctcctcctcctccttgtcattgccgtcgtcgctcaagaacaccgctcatgccctcgttggcagcggctccgccgctgcgctcggcggattctgtgctccctctgggttgcaccaccactaacgcccctccccttcgccgatcttgggaggaaagaaagggagggaagggaagncggatccccaagggggggggcgaggcggccctgccgccggatccatgcgggggttggcccccgcccgccggatcccacgcctccaccgccgcagtgccgccgccgtcacttacgcctgccgctgccatcggaaggagagaagagggcacagatgagtgaggccactattgttgactgatagaagaaaaagagatagagaggagaggagagatagaggggaaaatttaaagtgggtaagagggaaaagagggagtgggtatttttgcatgcggcactcttaataggtccacacgcaaaaatgcatattttcgcgtgcggtccatttaagaggactgcacagaaaaatcgattttttcttgcggtcctcttaaatggaccacacgtgaaaatgagcttattttcctagacgcgaccagttatggtccatctacaatctaaatgggtcgctgtacagaaaaatcgtttttcagtagtgacgagaagggaaaagagtagcaagtgataagtctagattaggtatctttatcaaaatgtgtagaaagaggggaaacgcatggagatttggtatataatcaacttttttacttttacaaatttcatatatgtccaatttttacccttacgagatttatctccatattaaagtgatacattatcagccttagagtatgatgtctctaaaaatgatgtctcaacctcaaggttccaaaaaccgtcctaaacttctgaagaaattaaatgataacttcatgaggaatacaattcagatccctagtttcgatcggttcatccagtacttgatcctcccattcatccatttgaattcaacttctatatcaannnnnnnnnnnnnnnnnnnnnnnnnnnnnnnnnnnnnnnnnnnnnnnnnnnnnnnnnngtgtatagcaaacgtgtcattcaagggccgg

SEQ ID NO: 29951 - DNA, 746 bp, Oryza sativa
  unsure (1)..(746): unsure at all n locations
acgcccagataagaacccgctgcactataggccgaattcgagctcggtacccggacaacaagatggctttcaattgaaattaatatgcatatatgaaagtcattaatataccaatgtttaaaactttggaatcatatcttgatgtcgcttgaaacaacatatttgcatgaagtgacacgtttggtcgacaagggcatgtcatattcacaatgatcatgcatatgcggcctttcatatgcgcttattttagtagtggatgaagaatcaatgtggattgctacatctttacgtgctttgtatgttcttcgattttgttggagtggatttagtatttgccatatgtgcttcgtgtttgttcttattggaattaaaggatggacatcctttatacgctccatttatatcttaaagacaaagtagcttcggatcgaatataagcacacagtaaaattgtagagtaccaacgatggtaattagttacgacgatgtactaggatatatcaccccgagtttcacatgtcaaatatgatgatatctgagcctattttaacttccaaccactatattgtaaaactcagtacaataaccgccaagggtggtaatgctactaggtgcactatagtacctaaggtagataccatatctagatggcagttcaaagcccacagagcttgggctggagcttgagccagattccgatcaaagtagagatcatcaaacttgctgagtngtagctgctgcgctat

SEQ ID NO: 29952 - DNA, 1406 bp, Oryza sativa
  unsure (1)..(1406): unsure at all n locations
cgcgattgatgaccgnccgtnnnnnnnnnnnnnnnnnnnnnnnnnnnnnnnnnnnnnnnnnnnnnnnnnnnnnnnnnnnnnnntgtgaaaacaaaggctaagatgatgtttttatttagagcagtcaaccattagatgagaaataattaattgagatctcttccatccccttctcctgtcgtgcacgtgcatacttagaaagtaaccatcggattcaatgtattaggccccgtttggtaggactctaaactctagctcccagctactaactccaactccaactgaagtgggtacgaaagtgtttggctagagtagttagctccactccaccacgtctcttgtaggcatttcgtcgaacacctggttggcgtcgcactgccgccgccatcgccatcgctcagcccgcgcgtcaccgttggtggcagcccacgggccaccgctgctcgcccctgcgcccccgcccgcacgcctcccatgcaccgcctaccgccgctggagggccgccagcgaaccgccacagcctgtgcgccaccacggcacgcgcgcctgccgctgccgctgccgtccgcggctctcacgcatcgtgccacgccaccactgctcaccacaccgtgccaccactgcccaccgccgccagtcgccgccgacgccgacgccgacgccaccgcccgtcgctgctgtagggaggaagatggggaggagagagaattggaggagatgaggtgtgaaggggtactttagaggcatttttgtgtaaatacattaaaaaattaaagggtagagggtcttttggggtggagtagagctgtggagcagcaaaagcccacctccacccccgtagtacaaatttgtggagtagctctgccaactccactccaaaaaatagaaaatttataccgtttggcacagttccagctctagataagttggcgttaggagctagagctgtgctaggccttattcttaatcaacattctaatctatccttaccatatgagcatgacccgttataatgtaggggtatattacttatctattaaatggtaaattattaaagtcatctatactcgagcaaaaaaaagatcgtgtgctggtagcacagtgcacgttatgtgcacagcgccatagacctagcttgaagaatttcccaaaaagaaaaaaaaattcaagtgattgagtgctctaaataagcatacaacggaagaaacaagggaatttaaagaaaacaatgtgtaattcaagtgtagaaggatgatatgtcccgtacaatgggaatttcattggtatgtgggaaatttcatttacagcattgtatgcttatttctnnnnnnnnnnnnnnnnnnnnnnnnnnnnnnnnnnnnnnnnnnnnnnnnnnnnnnnnnnatagagagntgtcatcaattcgc

SEQ ID NO: 29953 - DNA, 3221 bp, Oryza sativa
  unsure (1)..(3221): unsure at all n locations
cgcgcattgatgactgacactcggagtacaccnnnnnnnnnnnnnnnnnnnnnnnnnnnnnnnnnnnnnnnnnnnnnnnnctaaattggttgtgcagagaaaggaaatttagatctgaacagcaaattctatttaacagatcgattcattcagtttcaccagaagacacactgacacacaggtaataccagctgggttaattaagaacgtcaatactagaaatggtttcacagttgatagtctctctacctctcttaatcctgctacagcctatgaccacacaagaattcctgttctgttgtttatgctacttaaaaaaggtaaaactctttacgaaagagagctcagttgcataattagcgcaaacaaactaccctatatcatcggcaacaccgacaatccaaaggggaaacctgtcgattatcgatctagcattctagccaccgctgaaggctagatggaaactcatcagtagctgttggccacggaagacaattttctcgttggccttctcccccgtgtttgtcagattcacggccaaaatgttatatgatatttcctatcagctctgtcaggtcttgacaacacatcgaggggcttcatccggcaccccaatttcaatcgaaccccaaatcctccgacggctaaatggcagactcgtgctcaacccaagaaacagcctaaaatcaactgggtagaaagcaaagaagcgcacatacacgacacaattcgcagcgcaaaaagaagacggatacctttgaaggcaccacggatgattgcagccggctgccaagaaacccgaatccgactcccaagacccaagaatgacccgggggcagcaatgcaggtttgcagggtgggacggggggctgctccgatcgcttcgttcgttccttccttctccactgctgttcttggtggaggggaggttggggcanggaaggaagaagtgcggggaggaaggcatgaaaattgggaggagaggagagggatggcggatttatggtgagacggacgcgaggtcatgtatgtggtccggcccttcgctggccaccaaacctttcactgcaacgggtggcctcaattatgccttttggccctttgcactgcattattgcttgcttgcttgtttgatttcgagggttttctctaagggccttttgagttcgtgaacaccaaattttttaacatgtaaaatcgaatatacggatacatatttaaatattaaatatagattaataacaaaaaaattatagatttcgcctaaaaactgcgaggccaatttattaagcctaattaatccgtcattagtaaatatttactgtagcattacattgtcaaatcatggcaatctacacacaatttatgtaattaatattttttatatttaatactctatgcatatgtctaaacattcgatatgacatggtgaaaaatttttatttaaaaactaatcaagacctgaattgcctttgcaaagtgtcagatggtatgtctgggaaaatctaagattctaagaatcaactgctccttccattttatataatatagacataactacatttatttaaagttgttcataatagaaggtgtgtataaatgcatgttattaactagcacatctttttcattaaaatattattatttaaatcatctaccatcaagatctctaattttattaggcgcatgtaatatatttattaaggtaatccaaactatgatggtttgggtggtcgtgtggaattgagggagtacttgataattaagatataataatacgggggagctgtgaaacccagcttcttagaagttagctcgttcatgtttcagattatgtatgtagagcgtctcagaatctcaatgaaagtacatattattttggagaagcctttttatttcgagagaagctgcagttgtcaaaaatttttctaaacaggcccagtgactctgactcgtagttaagggtgcattgtccactttttaaaattgtactccttcatatttcacgtgcacgctttcaaaattgttaaatgatgtgtttttgtaaatgttttctatagaagaattgcttgaaacaaatcatattaatttttttttcaagttttattgttgacataaaaattatgggtacttccactttaatatttgtttaatttgcctctaattattggtaaaattacttattttaaatacatatttttgttaatcacataaattttcttccatcgcctcttgcacgaaagcgaccgaggcattcacttgttgctcccatgatacgatcattacactaacacgatcattacactaacgcgtcaggtacatcattcatatcatacatgtgcatagtggaataattatccaaaaaaaaacatttgtgattattattggtcatactaggttgcttaaaaaaaatttcagttaaactttatccactgggtatattaccggtacaacgcacgggtattttactagttttttttcatataaaacagaaaagtctgaaaacgcgtggaccaattttggtaactggccgaactcccattagactttacgggcaaccggcccatcacgcttttttgcgtggccgtaatcgaaaagaattcgtccccctagttgtgtccccggggagaataaatttcctaatctaaattattccgccaaaaatccgccgcgattggccaccgctggctccatggcaagcggaagcggcgagggcaagggccgccgccaccaggacaatatcccaagcgtcgtcctgctcgagctctggggccacgtcgccgacgatgaccaccggcctgacgccaccaccgccactttcacgacgagcaccggcctgccaatctcggtgaccttgtgcgccgccaccccgccaagcctctcgcacctttccgtcgactgccctggtctggtggatctggatcccaatcccttagataagtttgtggcgcccacggtgatcagcacggatgccgacctcgtcctccttcgtgtccctgtcgatcgctttgccagatttgatcactgtttcagcgactaacttagtctacaaggtgcactctcactctgaaagcgcaaagctgcaccgtctcccgagcccacgtggccgtggctttgcagacgacaacattgccatactgagnnnnnnnnnnnnnnnnnnnnnnnnnnnnnnnnnnnnnnnnnnnnnnnnnnnnnnnnnattcaaactgcgttcattcgcg

SEQ ID NO: 29954 - DNA, 3090 bp, Oryza sativa
  unsure (1)..(3090): unsure at all n locations
cttcgtctacaggtgcactctcctttgaaaggcaaagttgcaccgtctccgaagccacgttgncctggctttgcagacgacaacattgccatattaagttgcggcacggacgacgacgactcntacgctgtggcgctcttcacccctgcatcatgtcaactcaggcttcacntgtgtcgctctaccccgatggaaagccaggnagttgaacctcccatcagttgacagtgaagaagcgctgaaggggaacggtgtgccccgtccntgactcagcactgagaaggatcttccatgccacacccaaggtgattacgcttggaggtgctaaaggtacagttggctgggttgatctctggcgaggcatctttctctgtgatgtgctcgacgagattgagagccccaagctccgcgatttgccgctgcccttgccctctacgggcaactggcctttgttcctcaatcgctgcccctactattgtcgtgacatcgtcgtcaaccagagcagagacactatcaagtacgtcgagatggaattcaccatcttgaactcatctcaagatccacgctcctcgtatcacgaatgggtggccagccaagaatttcgaagttcgcatctagacatcttggtcgatgatggtagcttgaagatcaacacatggaacatgcctatcccggtcactcatgggatgactggaagcctggatgctccgtcacttccaaccacttggacactgccctgcatagttacatgaggaaaatagactacaagaggaaaaatgccgccatatccgtggagagtcttcacacggcttaccctaccctgagcatcgctgatgatgatgatgttgtttacttgctatccaagcgcaccacaagtggaaactattctaatccctcgaggagatgtttcctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcaggctgcaggccgtgcatggttggaaaacaaagctcaggtgaattttgttgcaccgcactgtaacatttggagtagatgttggtttaccgaagcttgcttttgccaatatattggcagcaaatccacatccaataaatggtgagctcattcctagcaaaatgtagcacaatatgggtgtgaaaacacaatataaggatctaaggtcggatcataataatattccttggtttaggaattaggatggtctgtgtgaccaaactactgagattatattacaacttaccaaggtagtgtacttaatttaggagaatatgattgataatgaggatacaatgcaatggtagagtagtactcaaggatcactatgcactgttgtgagttagttgatgacaagccttggggcttcttgctgtagttgggaagcaaaatggagttgggagctgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaacagaagaaactggagctaatccttgactaaactgcagcgggaacaccactccacaggcattctcgacggcacggacgaagcctactcctcagagaaaccttcatctgacccgaactcgaactctggggttgggaaaaatagagcaagactgagtactacccactgtactcagcaagtcataccggaatagaggtatgatgcaaggaatcatcaaagaagagctaaagtggttcatttgcataaagcgagcatttataaacagagattgaaagatttaaacagttgtaaaaattaagcagtattaatcatccactgtccaacgctacaccacgttgcaacaggcccaaccaaccacctataccatccaaattcattagactaaactaatgtgattctaatcacggtgaatctggttgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattaccattagaactaacagtctaaacattaatatgannnnnnnnnnnnnnnnnnnnnnnnnnnnnnnnnnnnnnnnnnnnnnnnnnnnnnnnnnnnnnnntcaatccatcaatgcgcg

SEQ ID NO: 29955 - DNA, 1715 bp, Oryza sativa
  unsure (1)..(1715): unsure at all n locations
gcgcgaatgatactccnnnnnnnnnnnnnnnnnnnnnnnnnnnnnnnnnnnnnnnnnnnnnnnnnnnnnnnnnnnnnnnnnnntctttggcgatgtcaaagtcaccctggcttgtgcagagcagcgcgccgataacttggcggcagccaccaagccgcaggccccggagccctccacaccccgcgcctccaagaggcgcctcgcctcggccgacgagttgcccgtcaaggagattccccttggcgatgatccatccaagaccgccaagattggcagtaccttggacgccaaataggaaagtgtgctcgtctccttcttgcgggcgaactccgacgtcttcgcgtgaaagccatcggatatgcccggggtccccagggaggtgatcgagcaccgcctcgcagtgcggccagatgcgtgacccgtccagcagaaagtacggcaccaagccccggagcggcaagccttcatccgagaggaggtgatgcggctcctggaatccgagaagtcatccacccagagtggctggcaaacccggtggtcgtctcaaaggccaacggcaagctccggatgtgcatcgactacacggacctcaacaaggcatgccctaaggatcccttccctttaccacgcatagatcagatagtcgactccactgcggggtgcgaccttttgtgttgtttagatgcctactccgggtatcactagatccgcatgactaggaaagataaggaaaaaactgctttcattattcctgtaggcaccttttgttatacaactatgctttttggtctcaagaacacaggccctacattttagcgcatgactcgtattactttgagtgatcaaataggcgtaatgtagaggtgtatgtcgatgacttggtggtaaagacgcgccaccaggacacgttgttgcaagacctagctgagactttcgacagcctcaggtccacgtgcatgaaactgaaccccgagaagtgtgtgtttggtgtgccggcgggcaaactcctcggtttttttagtttcctcatgaggcatagaagctaatcccgagaaaatacgcgcgatagagaggatgcgccccccagcaaacttagggatgtgcagtgcgtcacgggatgcatgcccgccctgagtcgattaatatcgaggctgggaaagagggcgttgcccctattcaagctcctcaaacgctctgggccgtttgtatggtcggaggaagcggagcaagctctcagccagctgaaagcttacctcacctcccccctatcctagtggccccgggaccagaggaaccgttgctgctctacttggctgtgaccccccattcggtgagtgccgcccttgtagtagagcgtgacgaaggtgacctgcgtcgcgagcccggctatgggaagggaccaggggtccccttaactagtgatggcccctcgtcccccaacagcccgatgcccgaagcccccaacccccgggaaggccctgaggtccccgtgggagagagagaggccccggcggacggccccgaggcctgtcgcactgacgtggctcgagaccccctcggggcccccgagcacgggcgccccgagctaggttgccctaacgacaaaggtcgaccccaccgaaagnnnnnnnnnnnnnnnnnnnnnnnnnnnnnnnnnnnnnnnnnnnnnnnnnnnnnnnnnnnnnnnnnnnnnnacgagtcatttcaatgnccac

SEQ ID NO: 29956 - DNA, 2057 bp, Oryza sativa
  unsure (1)..(2057): unsure at all n locations
tgggccctttgnnggtgtggattccgattcactatgggcgaattcgagctcggtaccccgtctatttcatcagctaggcactccgagatgcgaaaacctgataccctcaggcccagaagatgctttacgcagtcttgatggcctcaaggaaattgcgccattacttccaagcgcatcgggtttccgttgtaacgtcttaccctctcggccagatcctgcacaaccgagagggcactggtcggatcgtgaattgggccatcgagctcgctgagttcgatctgcactttgaaccacagcacacgatcaaaagccaggttttggctgacttcaacgctgagtggaccccggcggacgactctattccgtcccatattccctccctccccggagatggagaagacccgaacgccgatattcgcaccggacattgggttatgcactttgacggctctctcaaccttcaaggtgcagggaccggagtcacgctgacttcgccaagcggggatgtcctcaagtacgtcgttcgacttgatttccgagccacgaacaatatggcagaatacaaaggactcatagcgggactgagagcggcagccggaatgggcatccgctgcctcctagttctaagcgattcccaactggtcatgaaccaggtcttttggcccaacccgctcttttggcccttcgcggtctggggtctagacatcctagggcccttcaaagcggccgaggcgggtaccagcacctatacgtcgccatcgacaagtttaccaagtggcccgaggcttacccggtcgtcaagatcaactggcattatgccctcaagttcatcaggggcatcacatcccgattcggagtacccaaccgtatcatcacagacaacggcacccagttcaccagtgagctattcagcgactactacgacgacatgggcatcaagctgtgcttcgcctcgctcgcccaccccaagagcaacggccaagttgagcgggccaatgccgaaatcctcaaaggcctcaagaccaagacgtacaacatcctaaagaagcacgggtattcttggctcgaggagcaacccgcggtgctgtgcgcgaatcggaccaccccgagccacgccacgggggaaacgcctttttccctggtgtacggccctgaggcggtcctatgctcggagctttccctacgtttgcctcacgtcgcgctgtacgatgaggccaaccaagatgatcttcacagcgatgacctcgattatttggaagaacggagaaggcgcgccgccctatgtgcggcgcgctaccagcaaagcttgcggcgctaccatcagcgccacgtccgagcccgatcactacaagtcagcgacctcgtcctacgccgcatacagtcgtgtttagggctgagcaagctctcaccaatgtaggaagggccatacaaagtgatcggtgtcccccggccgggctcggttcgactaaccatggaggacggcacggagttgcctaaccccaggaatatcgagcatctccaccgtttctacccataatgtcgcgcgttttttgctttcttggggctcgggccaacccccgcacactcctcagcctgtgcgggcttggccgagggctaccactgttaaatatgttgtatccaatccctccctcagcaataaatttttctgcttaatcaaaagctgttgcgcgccctttcttactccttcctatggctcgtcctggcttaaggacgattcgcgcttgctccggaccctaagtggcgttggataacctgaaaataaccgaaggggagcctgaacgcgggccgtgccccgggctgcagcgaaccctaggggctcggaagggcctacacatggccatccccgacccccgatcaccgtggcctcggtctggttagtcccgctgggcggctcccctggagcgacggccttgcccctcgccacctaagtgtcgcggaccaagtgcaaattccccctttttaccggaaccaaaccgaggggcgggacaaagggagtaaaaaggcaacttgatcgtaaagaagtcaactaaatgcgt

SEQ ID NO: 29957 - DNA, 1070 bp, Oryza sativa
  unsure (1)..(1070): unsure at all n locations
ccgcgaatgatatgccagttcnnnnnnnnnnnnnnnnnnnnnnnnnnnnnnnnnnnnnnnnnnnnnnnnnnnnnnnnnnnnnnattgggacccttaagactgatgttattagagtgtgttaacagtgaaatttggtaagcctggagtagtcaacggcttagagtcagcatcggctttgaagtctgagattagccgatgagagttgtcaagtcgtcagttgtcggattcttgctatattcggttaaggaaattgatctactaaatgaagtttatccagaagagaccgagttcaaagagaatgcggcatggcaagttatctattaattaggaatagtttgtaagtttccttttatctttaggaaagtttctttcttgtcctacaaggactagtatctacccataggtataaatatgtacacccggggtcattgtaaactatcttcacgatcaatacaattcggcgcatcgccacccttttacttctacttttgtttttacgttccggcggaacttggcacccgacatggggctgcatcgtcttcgatctccggcgaagggatcagtccaatgttccgtcggcccaggcaattgtatcgtctacgtcggcatcgttcaaggctgcatcagtacattcgacctcttggattactctggtttggataatatatttgcctggctatttatcatatgtctatgttaatctagtcctagcatctcaatttagctctatcggatgtctctcactttagggtttctgccggtatcggctaaatcgccttgctagattagattagtttagacatctaccaccctgaaaactcagtcatcggcttgattgtctagatattatttttctttttatgcttagtgctgcatcagttaagtttgatctactaagtcgtgcttagaaccataatttctagcctgcttcttgattgccaataagggtttcatcggggttacaggcaatgagttatctggacgtttcattcggttacaaggatttgatgtacatataagttggatttagccgatcccaaaaaaggtttactggtttatctaatctcggg

SEQ ID NO: 29958 - DNA, 1688 bp, Oryza sativa
  unsure (1)..(1688): unsure at all n locations
ccgcgcaatgaattccacttcagttgtgccannnnnnnnnnnnnnnnnnnnnnnnnnnnnnnnnnnnnnnnnnnnnnnnnnnnnnnnnacgagatttcttttgcatggcattcagaatacagcagtccctaatggtcgccctttatgatttacaggtacaggcaccttggccagtttgctccactgggtggagagcaaacagccgctcaattgccgggtgattggatacatgttggtcacagcacccaatggctatggtattctgtctatgccaggtattaataatgccaccctactgaacatgcttgtcttcctttctgcacttcatcttccctcgcatgtatggacgtgtcgtgtagagtttttaatggcgttttgctcttatggaatgcagtaagcaattcagctggcgcaccaggatgctggtagtatctgattggggcaggcggttcatctatggaagggactcaagcagcctataaattgaactaggatggtgttgttcaccgccctgcattttgccaactgaagctctattagacttggataatacaatttttgcataccttcggaaacaactatttttgcatacagcatcattttttttagagagagagagcatcgttatatttgttcggctattttcacaagctcaggtttctgtagcgtagcaaggttttgtcaccaatttttgatcttgccgatatttctatgacacaatggaggttaaatgatttatacatcagtactttataatacagttcagtatcctagtaatttaaatgttgatgttatgtgttttttttacctcgtccttctcttctagcgagatgacgctaaccacagattcaattccctgtggaggccttcctttagttgtttaggaagattaccgttaattatcttcttgaattgttgctgatggagataataaaagcagaacagagcctagttccgcctttctcatccattccaatttcctgataaagtgaacgtacatcagtaccatttgaaggatacgtgcatcagcaaaataatgaaattcttgaaccaataaatattcccaaatcgaaatttgaatcctaatcctcgtccaaaaaaaaagaaaaaagaatcccaacatccggttttgagcaaaaaagcaacagaattttgatctgtttccaatgaaaacctgtttgagcagaaatttggaaaccgatgaaaacgtgagaacaaagatggcaaaccagtttgagtggaaaaccaatcggtgcagtaaaatcgacgaaatcaaacaatatcccagaacatctataggctcaacaaacgtatattacaaatcgacgaaaaaagaaagaaaccaagcgcatgtgcaagccccagaagctacaagctgtgagataccccgaactcaaagaataattaacccaaagaataattaaattatttaccactggacccatatatcatagacaacgaatgacagataattaattgccacgtaacccaaaggtacaagtgcggtgtaacgttggtgtgcaagccccagaacaagcagcgagacaccgcacggtgctacccgtggaccggatctggatcgatcgttgcaggaaggaggaaacggccatcagtagacgcatgcacaattagcgcgccattgggattatctgtgggcgcgcttctgggcacggagaacttcattgcct

SEQ ID NO: 29959 - DNA, 2377 bp, Oryza sativa
  unsure (1)..(2377): unsure at all n locations
acgagccttttttgnnnnnnnnnnnnnnnnnnnnnnnnnnnnnnnnnnnnnnnnnnnnnnnnnnnnnnnnnnnnnnnnnnnnnnnnnnnnnnttgccaacaatagattttcagaaatataaacagtatcgagtctagaacgcaagatgatcagttgcagaaaatgatactgaagacagcataggcttgtcttagaatagttcaaggggttttgctgagatagccttcaaattagatgaaatagcaaatatttgagttactagtaggaatagtaactcaaatatttgctatcttccctgggaagcttaacagtttctgttgtacatatattttagaccttcacagtcggaaagataatcttctctcgaactagattactccaaagccgagtgcttcaatcatcctcgccatgatctcccgagtacttttaccaaatatgaagactgtggagggctgaaaaataaagtcaggtgcatcgagtagatgtacctaatagatgcaccaactgagtggttttgataatcgtagtcaaacaagtgacttaatattaatatatagcatatgcggtgtgaatccctgaataacatgatccgagtgatataccgactgctttgtaaaatatgatgcgtgcaacctaaagctgactacatcattgaaaattcacatagcaaaatagctataaagaagcttgtatgttgtgaaataaagaaatttccaaagtattgggcatacgccatgcgcacactgctttaacagatgtgcttaagtccctagaagacacatggtcccaccacacctgaaaatatatggcatatgtggtataaaatccgagtaaataaactcataaagaattcaccaaccgcttgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgattacgcgcactttggcctaagcgaaaagtgcctaagtccctaaaagaacgtgacaggccacacctgaaaatatgggctgcagacatattaggcctaggccaaaaaatatgccttcgacaccatttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaaagagcataaccatggaggagaagaaaccaggcggtaacagtcacggccagtagaagagaagaagtatgcgcccaacaacaaccaaagaacaagcggcggtgacaaaagcaaaccaacgatgaagacgtagacgcgcatcaacggtgatggcgaaatcccccattatgaagatgaagaaaatagtcggcaatggcaaacgcatccgacggtaatgatgattagcggcaacagagatagccggctatgatgacgaagttgttttataacgtcgagcatagtagactatgttgtgagcctagtcagtatctttgatgaacatacccatgtcgttggtgaggtaatagtaggaggcagtcncagatagccatcagatcagttgcgacgcgtgaatgagtagtggcgcctgatacggtatattctcattcggcatttgtagggtgttacgcccagagtatggtgcgctcagagtgcagtcacctcttagcccggatagttaagccaggcccgataaagtaaaagagccggtgataagaccactgtccgccagcattgaatacaatttggaataatgtatgctagcatgcgttatgatcgattagatnnnnnnnnnnnnnnnnnnnnnnnnnnnnnnnnnnnnnnnnnnnngtnagtcgactcatcaatggctcgg

SEQ ID NO: 29960 - DNA, 751 bp, Oryza sativa
  unsure (1)..(751): unsure at all n locations
cgcgattgattgcaagctgnnnnnnnnnnnnnnnnnnnnnnnnnnnnnnnnnnnnnnnnnnnnnnnnnnnnnnnnnnnnncagactaattagatcagcatcaaattttttcatttgatatagttcactccataaagaagtccactagggcgagaagatataatttgcagtagtttatcccttgatccggtttgatcactccgtaaaaaagaaaaatacctgtagcctttaaatgcgatgaaacaatgtaattttctggtgtcatagaattaataactgatatacttgaccaaacaagttccaattctgttatttcatctacatggtttagaaacaaacttaataaaactctcaaaaaaaagctactaatcactgataccccccaagctagtagctgaactactaataaaacactttataatcgttaacaacttgttgacccgaaaaacacacaattgccctgggagacttgttagctccagtgcaggtccaaagtttggtgagaggtgtgcgtcccaacaatttgatccttgcacttgccagatttccaattagaaattcaatgggccgatcagttgacaggccattggggtatttcaggccgtgccgaaccccaccgttgcaataggggttcgggcaattcggctttttgcccaaggatattaaggtattgaaggcaatcacttggcgtattttattttggcatttaatcccattgaacccatcggttggaagtccaaatttggtcaaac

SEQ ID NO: 29961 - DNA, 1266 bp, Oryza sativa
  unsure (1)..(1266): unsure at all n locations
gtgcccattgttggtacgaccnnnnnnnnnnnnnnnnnnnnnnnnnnnnnnnnnnnnnnnnnnnnnnnnnnnnnnnnnnnnnnnnnnaaagtttaagactccggaagcaggaattttaggcactgtattgccattagataatcgggtggataatatacatattggtttgccaaacacttggaacaggccacaaatttcgagttaacttttatttgattgaggatttcacaaccggtttatacaaggtctagtacccaagagaataatagcgtactgaacaaacaaagggacaggaaagaacaagggctgcttctgtcaagaaccatggtcacttgaacataaatgcaaggtgagataaaacgataatggcgttagaagagggaaggaagaaatgatcagaagcagcaggctactggcattgacacttgatggtgttaacgataatgttaaacaagtcgacacgaaaaaatcactactactcctactcctaagcctcagtgaaggaggaaacggagaacatctctctcgcattgcagtaaatggtactgctggtgctggactcctcacgtttctcagctgttgaacgctggaggtagaacagtagtagcactggtaaacagtggaagtaaaatttcatttatggattattaatttgctattaaaggacagtttaaactgatctaaagccaagctaacatggtgaacttttgtggctaacgcaagtatggaagggttgccatacaatgtacaagctaacatgaacgttattgaagctgaaaaaactataatgtaatactcctatatcctactgacatgtctgcaccatatattgatccatgagactcattcctgactggccttttactggcacatgcatggaacaatcagcttaaagttaacagtcagctatactgcatttagctgcacgcctgcactacaacagattttgcaactgccattacattggctaatagagaaagctagcatacagttgaaaaccaaacggaacaaacccccaacgcttaagagcacatgaaaacctgctgccaaaactttgatgttacagcttacaataacaatcagaatggtctggtgcttctgcgacaaacaaatgtttcaaaactcgtcccttttgcaccattaaatatttctccctaggcctttcannnnnnnnnnnnnnnnnnnnnnnnnnnnnnnnnnnnnnnnnnnnnnnnnnnnnnnnnnnnnnnnnnnnnnnnnttccagnnngtcaaatccatgcctcgt

SEQ ID NO: 29962 - DNA, 1003 bp, Oryza sativa
  unsure (1)..(1003): unsure at all n locations
cgcgcccaagttagaccnnnnnnnnnnnnnnnnnnnnnnnnnnnnnnnnnnnnnnnnnnnnnnnnnnnnnnnnnnnnnnnnnnntgaaggacttccatgacctactcaaagattcagacgggaatgctattaaggagtcaaaagagctgaacatagaggaattcaagaaagcccttgctcgagtggactcgcaagttaagatgctcccagcaacagctcaggtaattattcatgtctaccattagagagtttgcactttgcacatagggaaagaaatctgttgcaatatatgtcaaattgatgtgtccttaaatatctacaaaccattatatgttttccaaatgagattgggtatatttgtagtctttatgtgccaaattaaattgttgacccaaacacaaagaaccatcttactaattggttgtatggatgtatatagttccttggttttgtcacatatggtggatgaggtaatttcttgatcttagtgacaaaaaaagtgccttagacttctgaatggagggagtaaatttttgtggttttgtcacatggtggatgaggtaatttcttgatcttagtgacaaaaaaagtggcttagatttttgaatggagggagtaaatttttgtttggcattttatatgtcaaattgatgtgtctttgaatatctacaaaccgtttcatgtattctgaattttcgtttggcacttcaggttgcttcacaaaagggagcctatctggcaaactgcttcaacaagatgaaatactgtgaagagaaccctaaaggtccgttgaggatcagaggcacagggcgtcatcggttcaaacctttcaggtttgttttcccttgctctcttagcatacatacattaggcacttaaacactgctgaccatgttgatatggatttacggatgaannnnnnnnnnnnnnnnnnnnnnnnnnnnnnnnnnnnnnnnnnnnnnnnnnnnnnnnnnnnnnnnnnngaaagtncattcaatgccag

SEQ ID NO: 29963 - DNA, 1566 bp, Oryza sativa
  unsure (1)..(1566): unsure at all n locations
ctgggccatgaatgacagtcttnttnnnnnnnnnnnnnnnnnnnnnnnnnnnnnnnnnnnnnnnnnnnnnnnnnnnnnnnnncaatcaaaatagacaccttacctacttttttcaaaagaaataaaaaacaacactaataaataatgaacatgattttagatgtagtaggtattattctggaatactcctcgtcggaaacatatggaacgcatttccctcaaaacgcaaaaaccggggccccgagccctcgacaccaaccccgtcggatgtgaagccgacggcccagatggaggccagcggtgccaatgcgtaggccacgcgtgcctctgcgcaaatcttatctcccgggaggctccgctccacttcccttcccgagtcactcaaaccatccaatccctccaccttcccttcccttgcccccattttccaccgccgccgcgccttgcccccattccccaccgccgcggtgcggccgccgacgacctccacacctcgagcacgcgtgccgccgacgaggtgcccttctctctctcactctcgtctcccccattcctcccctcttcccgtgtcccgtcgtccacagctccccgaccaaatccctagccctactattccccacccaccaggcctccctcgcgtggtcacgccgcacgatcgggcccgacagtgccgccgcttcttgccctactgccgcggttctttaagaggttgtcctgatttgctgcagcccagtaggtattgtatatttttctcgttggtaaatttggcagcaaaaaaaaaagtgtttaataccgaatgttataaacccgagcatctcatggtgtctatatatcagcatatatgatatgttaggattggtaaggatgcatatcacacgattacaattaccaactccacctcgaagataataagcccaatagtctaaccctaaaatccctccctacctgtccgttccttttctcaacgattcccagaagcgccgcttatcctcgagccgagtggccgacagcgccgcccaggagtcgaggagtcgtagctcgtagcgccacccttccttgtgcgcgcggttgtgccctttctcgccgccggtctccccgcttcacctcgcatcctcaacgtcaacagctgccatccgctcctcacgctggctatcgggaaggtcagtaggtcacgccgtctcctttcctacttgcctccggccaccctaagaccccaactcgcctgtttctcgcgcgaatcgtctagttacccggcgggcgacacccctactcccgggtggacgctcgtactcgtcgtcatgcttgccctgctttctttggctcacgagccaaacgagcccgctcgagctagacaactagccgagcctagcttgggtttctagctcgttaggataataggccgagcctagctagaccgagccgagctggatcgacatccaccccctacacgcgtgcctttgcccaaatcttatctcccgggaggctcacttctctcccgagtggctgcgacgaccttcgcagctcgagacgagtgccactttctcttctctctcttcatcccccatg

SEQ ID NO: 29964 - DNA, 814 bp, Oryza sativa
  unsure (1)..(814): unsure at all n locations
cgcgtgnaatanacgcctnnnnnnnnnnnnnnnnnnnnnnnnnnnnnnnnnnnnnnnnnnnnnnnnnnnnnnnnnnnnnnnnnnnnnnngacgctcatacacaaaacattagtttgtaaacctaattcattttcagtttttcatatattctataacacgttaccctttgagcactcgctcgggggatatttttatctaatgttcttttctgagtgttgatttcaggaaaattctattcaacattgtcgaagacttcatgtctctgtggttctacaccaagatcgactaaggcgagtacgacaaatgttgacaaggctccgtcgtagactctgcgccttctcgatcactcaagaatggttggtggatctcaacaaggaatacggaatgaagagatggtgtacccgccaagataaaatttcatgacttcaatccaaattctcgattacagcaagacgggagacttagtcgtatgctctgtactttcttggttgacgttggagattgactcagacaaaccctttaggtgcctgcacgaggctgataaaggaaatctaacgttatctctgaactcaccgaaaacggtcacatgagctcgataacagttccttcaaggtctgctgtggagaataggaactcggtcatttgcattgaagtcgggggctactgtcagggttatggataccacatacctaatagtaggtgactaaatcttagcaggacccaccacataccatgttctatacggaaacaacctgcggatattggaggagttatgggataaggaaagacacccggaggtctatantggatacct

SEQ ID NO: 29965 - DNA, 2380 bp, Oryza sativa
  unsure (1)..(2380): unsure at all n locations
nccacctctatcaccttcaaccccattcaacttacggggaacaatataagccgcatcataccaaactacattctccaagacaagacgccggatatcgactttaggaataagcacggctagtcccttacggtgtctttggatactgtcaggagagacgaaagtgctatctctgtcctcaccggtcttgacctcgaggagaaagcctaccctgttgtagactacgagtcagacctacagaccgccatgtcgacaacagttagataggctaccccaaatattgtactggtgtgattatggtgaataagagcaatacgggcttcggccaacaggatgtagggttattacctgacaattcaggggcccgaccctgtataaaaatcctcgcctctgtctcttttacctcaatctcacgtatgtcctagtaccgacgatccccatactatgcaaataccggaatcgcgacttcaaacgtcgactgaaatcatatcttgatgtcgcttgaaacaacatatttgcatgaagtgacacgtttgctcgacaagggcatgtcatattcacaatgatcatgcatatgtggcctttcatatgcgcttattttagtagtggatgaagaatccatgtggattgctacatctttacgtgctttgtatggtctatgattttgttgtagtggatttagtatttgccatatgtgcttcatgtttgttcttattggaattaaaggatggacatcctttatacgctccatttatatcttaaagacaaagtagcttcggatcgaatgtaagcacacagtaaaattgtagagtaccaatgatggtaattagttacgatgatgtacaaggatatatcaccccgagtttcacatgtcaaatatgatgatatctgagcttatttttaacttccgaaccactataatgttaaaactcagtacaatacaccgccaagggtggtaatgctactaggtgcactatagtacctagggtagataccatatctagatggcaagttcaaagccaacagagcttgagcttgagcttgacccagattccgatcaaagtagagatcatcaaactgctggagttgtagctgctgcgctatggcctgaacaatgttaatatcttgatagtgagactgttgcgccaccagcctgagctgttgccaaacttggttgtttttcagctgaaacgcagctgattgcaataaggggcttgctgctatgccatactgctgccttacgaactcattatatgggctaagcacatgttgctgtagcaggagaggtgactgcagctgatattgcctataactttgacctaaaacatcaaactgcgcagaggcgctgtttgcagcaatagcaagaagagcaaagacgaaaatgatcttcattgctacgggacactagatctttctttttttgttgtataatgcttgaactgtgtgaacgatggggagggttttcattgcgcttgtctatttatagatgcaatggcactgattttctttcaattcctcatcggttgctttggagtgttagttttgctttcatgtcctattaggatccaagtgagtcatgtcattcggacacatgttctattaggtgccccaacaaatcccctttgatttcatcacgaaagtaacttttgtgtccatcacatatactccctccgtccagtaaggagaaacccacttctagggatgaacctggacaatcatttgtccagattcatccctaaaccctaaacattgtccaggttcatccctagaagttgtcatattttgggatcggaaggtgtacgtgatggttagcaggctagaaagataatgatatgactcatcgctcgctttatacgttagtttggtaaggattgcaaccgttatctagctatatttgttatgttttgtaagctattatttcactaatgcatgacacgttgaacattaaggtcgtgtggcctcatgcattttatgttacaaaatttcaacaagaatgacaaaattatggtatgccaagtgctttttattgttccgttgatacggtaccgaacatttgattttatagcaagaattaggtttgcactgaattcttaaatcaccattcgagagatttacaagaaatcaccattttgctctacttgtagtgcaggattgacgtaattcgtattcttgtaaactaacttgttacgtgttttcttgtctaaactttttggatagacttggactgtgttcggaatccagggtacccaacccatctccattatattccacgcgcacgcttttcaaactgnnnnnnnnnnnnnnnnnnnnnnnnnnnnnnnnnnnnnnnnnnnnnnnnnnnnnnnnnnnnnnnnacaagcggaaaatgcattccatgtcgcgc

SEQ ID NO: 29966 - DNA, 757 bp, Oryza sativa
  unsure (1)..(757): unsure at all n locations
cgccccttgaattgatcgtccnnnnnnnnnnnnnnnnnnnnnnnnnnnnnnnnnnnnnnnnnnnnnnnnnnnnnnnnnnnnnnnnnnntgacggttgaagctttgtggaagtccatacagtttctcaatggcgaggctacagggtggaggtaccttggcccccacacttggggaacaacctaaactgttgcccaggtgacctgcacttacaagagatatttatgctggtccacaatgtgtggtggcgaaaagtggggatgtgaatgtgatgaacacacgtgaatgaactaaggaatcctaaaaactggacacattggtaagataaaaagtgaattactttgagctaaccgaagattatataccgacttttcgcgcagactggaggcacgattaaacacctgtgagcacctgctgctcagtgacaatctacgacatcttccagaatattaaccatgcagcatcaccgacatttcgacataggaacgagctcacgggacattgccagaactgatgccgtgagttaccccattgcgtgtcttgtaagccgcatgagaaaaaatacagtgcccgacaaggattgctaatttaattacaggatccccaacccaacctgggtgcgacaagaaagctagcaaactgacatcaaaagcggaaccgtgttatatttgtcattcagggcatgcactgaatagctttctaacaataaaacaagacagccaacttggatatccataatttgaacccggcagaagccggg

SEQ ID NO: 29967 - DNA, 1045 bp, Oryza sativa
  unsure (1)..(1045): unsure at all n locations
gccgggcattgtttgctcgtcnnnnnnnnnnnnnnnnnnnnnnnnnnnnnnnnnnnnnnnnnnnnnnnnnnnnnnnnnnnnnnnnnnnttattgagtatccttgcaaggggaatgttggaacatagtatttcatccgtttcatattataagactttttagtattacccacatatgtgtgtctagattcattaacatctatattaatgtgggtaatgttagaaagtattataatatgaaacggagggagtagtaagtaaactacccatctttacctatctacttaaacttttataatgaactagtctattagtgttgtactccttctgctcaaaatataagggattttaggtggatgggatatatcctagtactacgaatctagacatgatcctctccagattcatagtactaggatacatcacatccaactaaaatcacttatatttagggatggagggagtagctacgtatttcctctccaacttcacgaggctagagatgccaccggccggcgacgacaagtcgccggcggccaacggcgccggcgacggctattcaaaggtactgcagggccggtacgagctcggccgcgtgctcggccggggcgcctcctccaaggtgtactgcgcgcgcgacgcccgcacgggcgcccatgtcgccgtacgtcaaggccatccgaaagcagccgcagccgcactaccacccatgtcgctcgcccgaggcggccgccgcggcgcggaggtgcgtggagcgggaggtcgccgcgctccgccacgtgcgcggacacccgcacgtggtggggctccttgacgtcctcaccacccgctccaccgtctttacctcgttctcgagctcgcccgcggcggcagcgtcctgtccgcgctcgacggtcgcggcgtggggcactacaaccagccccgggggcgccgtctctttgtgcagatgggcttccccgtggcccacgcgcactctctcgactgttccaccgngaagtcaagtaaaaaaacctcttctgacgagcgtgccgacctccggtttacgact

SEQ ID NO: 29968 - DNA, 797 bp, Oryza sativa
  unsure (1)..(797): unsure at all n locations
cgcgcctttgaatagcagctctccnnnnnnnnnnnnnnnnnnnnnnnnnnnnnnnnnnnnnnnnnnnnnnnnnnnnnnnnnnnttactgtgggctgttcaagtctgtaccctattttttgttctctagttagccattgtgcaaattttccttgaatcagattctctacctgttgtctatgtgtgttatcttggtctgttaatttgcatagcccacttgttcattacaaaaggagatctttactacttacaaaaaaaaaaatctagtgggaaagtggttgcaaataattgaagaaattatagctagaaggtgtatccatggtggtggcttgagcccttgaatcccgttattttgcatacaattacatatgttattatagcttgcagagtacaccattagctgtagttacctggtccaccgtagtatacatgcatacagtaagcattaattccataactatcggaggtacgattttgctatatatttgtcgacaaatttttcctttgacagatgtaattacagtacaatcgtagtgtaattatattgtaacttgcatgtaattacactgtaactaacttgtatgtaaccttttaaaaatctctccataacatgttattttggtaaaatagaggtcatgggaacaaaatctttcacatatgtgtgtgctatgatttgttttttttttctcatcaaaataaatcttataatagatctaacgattcacaattatgtgaaacttacatataaattacagtgtagttacatgccagttacagtgtaattacatattagctaccg

SEQ ID NO: 29969 - DNA, 1050 bp, Oryza sativa
  unsure (1)..(1050): unsure at all n locations
cgcgccattgatttcttatttccacgcnnnnnnnnnnnnnnnnnnnnnnnnnnnnnnnnnnnnnnnnnnnnnnnnnnnnnnnttattaataaaaatttaaattttcaactttaaatttgaagttgatttagaggtttttcatcgaagtttattttttagcctttgtttttagatcgctaaaaacacgtaatatttttattaataaattatttttcatttgcaaatatgtcccaactgatattgctgttaatatgttaatatggtatcagagatagaggttattgattaatccgcgcaaggggaatgttgttggaatataagtaaactgctcatctttacctatctacttaaacttttagatcgaactgtatcaatgttgtagctacaaatgcatacaacacaataaatatgtgtgcttattattgttaccaataaaataagtcatgtgaacaatttgatgttatgctgtgtttgtaagtgcctgtatatataattgcactttttaattctgccttttttaacatggtgcacatagcaatactttgtgtccaggtacacagcccagctaaccactgtacaaaggccttttagcacagagactccacgagaccacgagcagagaatcaaccgacacaaactactctccatcaaatcatcaaaccaaacaccactactttcctcttcaacttcacgacgccggagatgccaccggccggcgacgacgagtcggcggcggacaccggcgacggctactcgaagaaggtcctgcagggccggtacgagctcggacgcgtgctcggacagggcgcctactccaaagtgtaccgggcgcgcgacgaccgcacaggcgcccacgtagccgacaaagccatccgcaagcagcagcaagcggaccaccacccgtngtgccgcttcgccgaggcggacaccccggctccggaagtgcttggaggtggaaacgggagannccaattctccaaaaccctcccaaggggggggggggccaaaacaactcccccgctttctcccggcgggggggttttttttaat

SEQ ID NO: 29970 - DNA, 1604 bp, Oryza sativa
  unsure (1)..(1604): unsure at all n locations
cacttgagtaacacactcnnnnnnnnnnnnnnnnnnnnnnnnnnnnnnnnnacaacatctgtctttcctttcatctgcatgtgcattttgtttctcaattagtttacgaagacagacatttttttccacccatcacttgtgtatctgcaatatttgctttcacttttgaaacattgtaatcacgctactttgttctgccaaatagttaatcatgctttattgtctgtattgcagtattgcaagttgccgtgaaaggccattctagggaatgcagaaagatgtgcttgcacgccagagatatctcctatgaagagaagggcatttctcccattgatttgacatcactaattcttgatgagcgaggatttcagttgctcacctggtgcattctgcaatcacaaagtaataatgatgctatcaatgtcagaaatactgctatgctagatcatgcaatttctgatgatggttgaagtttttgcttttacggttttcctctaaaattccaataaagaattgtccgctagcattgttttgaatgatggaacttgagaagaatggaaacattctactgcgaaagtatgagattggaaaattattggggcaaggaacttttgccaaggtttatcatggtagaaacatcgtgacttcacaaagtgtggctatcaaggtgatcgacaaggacaaaatttttaagggttgccttatggatcagattaaacgagagatatctgtgatgaaattagtgaggcaccccaacattgtacagctgtatgaggtcatggcttcccaaatcgaaatataccttgtgctaaaatattgcaagggcggtgagttgtttaaccaaattcttaaggtaggttgaagaaaaatctgcaaggaatcttcccccattagaaagggctgtggattttgcccacgaaagcgttattattccaattgtaacccagaacccactgttgataaaatggaacctgaaaatccccgttttgattggccctcttgcttaatagacccaagaggccttttcccccacttgggaaatccccatttggggcctcggggatcccccaaaggtgttacggtcaaagcttccctcgtcttcgcggtactttttctgttatggcggntttccgctttaagagttaacttgatgggaagccccaaaacgcgaaaccaaattcaaatcccctctgtgttctctttcttcccaaattatcttgaatcttttgtcaccacccaaatgcacccccttcaaactattgggactcctgtttcaaaagggctgtctcctccattctttacactcgggcaaataacccttcccgccttgcgtggttaagtggttcctcctcctgcggagccnctctcataaacctgcggacaccgctccttcatctnccnccgctgcgttcttatattttttttggcgggttgcctncttgctttgggcgccctgcaaanataaagggtnttctcacatcccgcnccttnttccatacgggtgntccctcctccctaccgacaaaacaagagcgtctaaacatcccggtaatgagaaggcttccatncaaccatatgggctctttttttgacaaaaagccacg

SEQ ID NO: 29971 - DNA, 1265 bp, Oryza sativa
  unsure (1)..(1265): unsure at all n locations
ggcccttgattgcattgcnnnnnnnnnnnnnnnnnnnnnnnnnnnnnnnnnnnnnnnnnnnnnnnatcttccagtatatatagcaaatcctaatcaccttctaaatcttttaaaaaggaaattatgcaaaaaaaaaagctaattaagccatttccaagttcttcctctgttccccattgtctccggcggcggcgctcctcgtctcggcgcgcgcccctctccggcgccgggagcggagcaccgcgacggcgtggcaggcccagtcccatgagttgagcagcatgtaggaggcgatgccgccgatgaggccgtaggcgatggagtaggtgagcggcatgagcgccagggtgaggaacgccggcacggcctgcctcatgtcggcccagtccacctccgccaccgcgcgcatcatcatcacgccgacgagcaccagcggcgggccaactgcccacgacgggatcgacgccagcagcggcgtgacgaacagcgccgccgcgaagtaggccgccgcggtgagcgccgtcagccccgtcctcccgccctccctgatccccgtcgacgactcgatgaacgccgtcaccggcgacgtccccagcagcgacccgaacacgatggccgtcgcgtcggacatgaaggcgaagtactgcccctcgaagtcccccgtcgcgtcgtccacgaagccggcgaacctcgccatggagtagagcccccccgtggtgtcgaggatgtccacgtacaggaacgtgaagagcgcctcccaaaagtacccgggcggcttccccgaaagtcagccccccggcggggaattgatgcgggcacctcaacaccttcttgaagacccgagcttttttccccgggggcgtgtccggaacacctgacngcgggtttcccgccaggaatgaagggacaaaaagaatgccaaacaatgccccttgaccttttataagcgaaaggcatattagaaccccaacggtaaccacaaggtgggaagtatcccccgaacagaaatttcccccgaacgggcccccgttgagcccccctgccttggggacttaaaccggcccagaccccgttgaaccggacccccagggaagaggttaaataacccaaggccccctctttttttcccctaaaccaaaaaccctccccgcaaatttccggcttggaaacacgcactttcccccccaggaaaaagaaataaccctaaaaacccccgccttgggatcccccctacacccctctgaataatttctcccggggcgcgg

SEQ ID NO: 29972 - DNA, 1224 bp, Oryza sativa
  unsure (1)..(1224): unsure at all n locations
cagtttgagtgccacatgactatagggcgaattcgagctcggtacccagcatttcttgaaacaccaagtgtggaatagaaatcctgtaaattaaaatatcaaatccatgtcaggaaactggattttctaataataccagcaaagaagaaaagcaaatgaagtaactcacagcatcagctctgacaatgaaccttgaactccttcgatggcgaaatctcggtgatggtgcatggttaaatagtcgagaagatgtccgtgattgtaaactagcagtaggtgatacaaggtgtttaagcctgcctccactactgcacaaaaagagatatatcatcttcagtttactcagaaatcttgcctttttataatatcaatgtgtcctttattttagtattcctagtacatctcactgatcagaacacattcacatacccacttttcgacaccagaaatcttggatcagcataaataactcttgtaagtgcaggtgacctgngcaacagctgaggtttttccccaagtttgggggccaaggtacctccaaactgtagcaacgccattgaaatacttgctggatacccacaaagcttcaaccttcaatatactagctgccatttcacagagatagagtcaggtgaagcataacaaaagcaatacacaaaagaacgatattcgagtaagttcacaattctattcaaaaaacgttctcttctaaatttaaataaccaacacatatcgactgtcatttactccttactnncttaagaagatgaataggggcgagggtgtgtacaactgacatacatatgtactgcttgcaagaaccttttcaagagacattggcctgctgagcaagccattgctaccgtggtggatgcacaccggggcccacagctagtaacttaagtacagctgcaacaatggcttttcaaccaggccgggataatttgcatggattaatatgggggattgacaattcttgcagtatacaccttttaaggtcaaggaaaataagtttgcattttggccttcataccaagggaattgtgatactaagaaattggcatacagggcaaatgggacacattccctttttttcttgggggggggagggggtggaaaggggtttgcttctctcgcggcccaaaatttaatttgccaacacggcccccggagagaccgggttaaaaacagggtatttttttttttttgggccaaatacaaaca

SEQ ID NO: 29973 - DNA, 1905 bp, Oryza sativa
  unsure (1)..(1905): unsure at all n locations
ggaggaggaagagttaaaacaaaaagaacccgggaaaaatataattgcggagagatggaccggtgtgaaaatagaaatgttttcagtgtacaaccgggcgggccgtttattacccggttaaaaaccgacccttgggggggtaacccttatatgaagcactcttaacaagaacgccaaaatcctggcgataccctataaccttttgcaataaaacaggtaaaaatgaggttcaagccgcttagtgatccacttaattttcagcctaggcattaaagaaaaaaatttctgccatcagaccaatcttagtttcagggggtagttgtctaactaatctattctacaaggcgttttacccaaccggcagaaccctaaagtagaaccacncattaaagttaattgaaagctaggctaggttacaatggcatttgtaaataccaggccaatatatatccaacccagagtattcaaggagttcgaatgttctgatcaagcttggaacgatgccaagtaagacgatacaattgcctgggcgacggaacattggactgatccccttcgccggagatcaaagccgatgcagccccatgtcggggtgccaagttccgccggaacgtaaaaacaaaagtagaagtaaaagggtggcgatgcgcggaattgtattgatcgtgaagatagtttacaatgaccccgggtgtacatatttatacctatgggtagatactagtccttgtaggacaagaaagaaactttcctaaagataaaaggaaacttacaaactattcctaattaatagataacttgccatgccgcattctctttgaactcggtctcttctggataaacttcatttagtagatcaatttccttaaccgaatatagcaagaatccgacaactgacgacttgacaactctcatcggctaatctcagacttcaaagccgatgctgactctaagccgttgactactccaggcttaccaaatttcactgttaacacactctaataacatcagtcttaagggtcccaatttctttggaagaaatgcgccgggaaaccatcggaccctggcgctttcaaatgccctatctggaacaagacgtctcctatctcctcctcagagaagggtttcatcaaagactcattcatttccgctgttatttttgtctggaacaaattgaaaagttcagtagggtcaagattttcatctttcatatatagattctggaagaaatcacgggcaacctctcccatctccttttcatttgacaccaggctgccattaggcctgcgcaatttcttcactttattcttccgagctcgccaggacgctttcaggtggaaatactttgtatttttgtcaccctccttcagccaagtgatttgagatcgctgtctccaccatatctcctcacggcgaagcatttcctgaagctgctctttgatctttttcacctctggttcagagtcaagcatccctgccattctgagttcacctaatttcttcctgcgactttcaatacctttctttatgttgccaatctttgatttgctccacttgacaagttcgtccattgtgtatgccatcttggttttgaagtccccaaggttgcgcacaacttctccttctccccatgcctgctggacaaccgagtcaaaggattcttctctttcccaaatagcttcataacgacttatcttcacactgttatgaacaagttcttcttctaatctctccagtagcaacggtacatggtcggaactaggtgtaacaaggtgtgtgatgcttgcctgtctaaatctgcccagccatgcntgcgangctactgctcgatccagtcgtactcttaccattgttgcacctctttgattgtatcatacgtccatgggcactcatgaaaaccangan

SEQ ID NO: 29974 - DNA, 1534 bp, Oryza sativa
  unsure (1)..(1534): unsure at all n locations
gaggcaanttgagtagcacctcagtnnnnnnnnnnnnnnnnnnnnnnnnnnnnnnnnnnntcctcatcgtcgcccccatcatacgcagccatatcagagtcaggtcgataagaacgaccactccatccccttcctcttccttggcctcggccttttcttccgccaccattaaaccagttacccgatcttctaaactcaggtgctaccaaagtatcaggatactgtatcgcttctggaagatgcacgccatcaccatgctcctttgtgacatgacccaccagaccacaaatcccacagaagaccagcatcttctcatacatcagccggaaaaaccacttcttcttattcaaagtggtgctcctactcgcaggagaggcttacgaacatcaactttcacccttactcgaacaccatcaccactcccttttactgacgcctcatctaatttgatgacagttcctgctttacggactaactgagttgcaatactccctgttctgatcttctctttcagatcatgaatctggacccaagtgggataggtttcaagaaccacagattcaatctctgaccaaccatcatattcagcaagcagcacaggacaaccacggaaaatccatggtccttcctccataactcgctcccaatcagcaagacaattcaattggattgaaaacaaattatctttcatggacctgaaatctacttccttcgcacaattccatgcagatcgcatgctggcaaacaaagcaccatggctaaaggatttctctgtatgaaccctagctagggctaaccatcgggcatccgcttccagctctttgagatcttcctccaattcaacatcctcttcctcgtccttcctgagatccaaaccctccaaaagcatctcaatatcatcctttgcctcatcttcttggcttgccggggatcctttagggttcgccgacttctgactctccgttgcagaggctgcgctcgccatgagatccagtaaaatcgctcttcgtcttcacgtcgacttgcagagcagccatagattgaatttctaaccgactccgggacaaaatcaacccagatcggagaggtagggtgaaactccaaggcgtcgcgttagaggagagaaaccctaattttaggcgtgagttagtgagatacaatgtcaatcaaattttaatggatagtcgatgcgacagtgatcttgatcgtttgattagaaaccaacggctagagaaaaaagatgacgtggaatcaccaggatgcagagaattcctagtagtggggatgatttgtataggtatataggataatagctcacaaaacataacaaatatagctagataatggttgcaatccttaccaaactaacgtataaagtgagcgatgagtcatatcattatctttctagcctgctaaccatcatgtacaccatccgatcccaaaaatgacaacttctaggggatgaacctggacaaggtttagggtttagggatgaatctggacaaatgattgtccaggttcatgcctagaaggg

SEQ ID NO: 29975 - DNA, 846 bp, Oryza sativa
  unsure (1)..(846): unsure at all n locations
ccggttgattgcctttcaagtacacgatcactatgggcgaattcgagctcggtaccctgaaacaacatatttgcatgaagtgacacgtttggtcgacaagggcatgtcatattcacaatgatcatgcatatgcggcctttcatatgcgcttattttagtagtggatgaagaatcaatgtggattgctacatctttacgtgctttgtatgttcttcgattttgttgtagtggatttagtatttgccatatgtgcttcgtgtttgttcttattggaattaaaggatggacatcctttatacgctccatttatatcttaaagacaaagtagcttcggatcgaatataagcacacagtaaaattgtagagtaccaacgatggtaattagttacgacgatgtactaggatatatcaccccgagtttcacatgtcaaatatgatgatatctgagcctatttttaacttccaaaccactatattgttaaaactcagtacaataaaccgccaagggtggtaatgctactaggtgcactatagtacctagggtagataccatatctagatggcaagttcaaagccaacagagcttgggctggagcttgagccagattccgatcaaagtagagatcatcaaactgctggagttgtagctgctgcgctatgacctgaaaaatggtaatatcctcatagtgagactgttgcgccaccagccaaagctgttgccagactttgttgtttttcagttgaaacgcaactgattgcaataaggggcttgccgttatgnnnnnnnnnnnnnnnnnnnnnnnnnnnnnnnnnnnnnnnnnnngatatacaaantctacaagcact

SEQ ID NO: 29976 - DNA, 1825 bp, Oryza sativa
  unsure (1)..(1825): unsure at all n locations
ccgctttgatgactgactcatctagtgcgaattcgagctcgtacccgcattcgccaatgggtggggagaagggtgtccgttggcaaggaaaaagctaacggcgggagccgtcttctgacgtggctcctaaatgaccgggagcgctcacgtcatgaacttgcgcacgtgcgggggtgtggcacgggtcccaactacaacttgttcgctttctccccacccatcgccaggcgccgtcgtcgggcaccggccaccacacacctctcccacgattcagcgtcctcttcacatacaactgctcgccttctccccacgcatcgccaggcgccgtcgtcgggcaccggccaccacacacctctcccacgattcagcgtcctcttcgctccatgacgcagccgtcaagagcccagggtgactcacaccttccctccctcgtgggccaaagtcgggaggatgtttgcatccatattcgatcgagggagaaacctcattttctccagcagccgaaacatgccaactcccgcccccccgcagctggggtaacaagctcacgccaccgagctcgccaggagcgatgcgagcgcgtcgtcttttatgccggtgtcagtcgtcatagattttccatgtggtactaaaaacttcgtttttgtgcgtgacagttgcgcgtagaatatgtatgggctttgcacgcacgccggcccgaagtctcgaaattatccaggatcatcatgcgccgtccctcgtgaaggccgccgccgccgggtccgtcgccggcgaacagcgtggccaccgccataagccacccgctgatccgcccatgcacaacagcccatcctgttgcagccactcctcgccgccggcacaaccaccaccaccgggctttctcaccgacaccaccggcgacggcagcggcagcctgacggccaatgttctgcacaatgtcaatctcctgcatatcaatcacactcccaaccctgaaatggtggaatacctgctagtattccactgcagatcaaacactttcctttggttggcttgtagagtagagatagggtacagtctgcaaacagaattggttcatcggcactggatataggatacagcttgcattgcaacagagtttgcagaatgcatggctttactaaagagggatcacccttacaatttttgcgctgttttattggactgaaaattaacacaaatcaatgtacccagtgacttgccatcagccaagcagctgtcttttcggttttcagaatggattcggtaaagtttaagactcccgagcaggaattttaggcactgtattgccattagataaatcggtggataatatacatattggtttgccaaacacttggaacaagccacaaaattcgagttaacttttatttgattgaggaattcacaaaccgtttatacaaggtctagtacccaagaaaataatagcgtcctgaacaaacaaaaggacaaggaaagaacaaggctggttcttgtcaagaaacaatgtaacttgaaattaaatgcaaggtagattaaaacgatattgcgttatgagaagggagggagaaatgttccaagcccgnggcctctgggctttgacactgtagggggttaccgatattggttaacaagttggacccaaaaaatacttcattttctacttcctaaactcaggtaagagggagaacgggaaaatatttttctcattgagaaaaagagcccgtgggggtggggatctcaaacttttaacctgtgaaacctcgggggtaaaaaattttccttgggaacacgggaagaaaaattctcttgggttttaattctttag

SEQ ID NO: 29977 - DNA, 1219 bp, Oryza sativa
  unsure (1)..(1219): unsure at all n locations
nttggttttaagggagaaatttttttcaaaatttggctcccctaacacttgaaaattcggcttattgaaaaacttggaaacctagccatttncggaagctttagagaagtttaatttaagaaagattagtaagaatttgggagtagatggcctacaattaatgagaccaaagcaggggctttccaataaaagagctccttttataaccactttggcaagatgaaaaaaatattcaatggttgctcgaatggaaggtccatttttttgaaagaccacatccctataacatgataattcgaaggcacaaaatggttgagaagccaaataatagattggataattcctcccacaatactatgagaatggaaattttagagtctgtgatttgtcatacttatctaaagnaaacttccagttaggattaagacatcaattacccatgattgatttgtacaaaacctaaatattatcaattatcaagtatgtttgcttaataatcttaatgggtgtttttatttctttggcgagtagccttcatagcaattctcataggggatatgcaatatttgacgtctccaccctacacttcccattgtatgcctattgaggaagggtaaatgtccgtacatagattattgtattatttgtcatgttcaagaaatattcccattgtgtgcttattccccatgtttacaatgtgaatttcattgtatgcttatcgatgtagggaaaatgcttcattgaagcaatatttgtcgtctccaccctacacttctcaacagttccagggttgattcagacaagatattggaagagtctaacctaattggcatggagggagagttattatattgttgcctcatgttcttctgggcactgacaaccactacataacctagtaaataataacgaatcgaacacaacatgtttgccaattagattttatggaagtacaaaagtaataatggtttagccctacttacccatcctcaccggccgggaatctaacgtaacaagaaaaatataataagatcatggtggagtagaagtgttggcggttagcaatgtttaacctaaatcacatgcgaaaccaacagtttctccctgcgtattccttcccgttgtaaaggtaaagacacggccacaccgtttcagtctcaaccatcagtttgctggaatttcccagcgttctagaatggaatatagctaaagccgcaag

SEQ ID NO: 29978 - DNA, 1582 bp, Oryza sativa
cgcttgatgactgcctcatcactatggccgaattcgagctcggtaccccgttggcagtcaactgcccgccagcacaaatgtattattttcactggcctttgattgctagcgttacagcaacctccagcgaaaacccatttcggccgcaagtaaaaatggttttttagtagtgaatcaaataaacatgatgaggaagtgacgttgactctagatgagaaaaacgtttactatacaaaatatacacaaatcattcatacaaaagcaattacaatttacaaaaacaacactaatgaacatgattattctagatgtaggaattattctggaatactcctcgtcggaaacatgtggaacgcatttctctcaaaacgcaaaaaccgtgcccagacaccaatccgccgctggatgtgaagccaacggcccagatggaggccaacggtgccaaggcgcaggccacgcgtgtagggctggacgaaaagctcgtggctcgttagctcgctcggctcggctcgtctcgtttggatttgttaacgagccgagctagagttagctcgttagctataacgagccggctcgagctagctcacgagctgctcgcgagccaaacgagccaaggcccagtacaaacagcgtgctcaaccacacaccataagtccaacaaggcccacgagacaaggtcacagctcaagcccacaagtagagtcaacggtgccaggtcatgaaacagcaagcccaactaagcccaatagtctaaccctaaaatccctccctacctgtccgttccttttctcaacgattcccagaagcgccgcttatcctcaagccgagtggccgacagcgccgcccaggagtcgaggagtcgtagctcgtagcgccacccttccttgcgcgcgcggttgtgccctttctcgccgccggtcttcccgcttcacctcgcatccctaacgttaacagcttgcatccgcttcttacgcttgctatcgggaaggtcagtaggtcacgccgtcttctttcctacttgccttccggcaccctaagaccccaaacttggctttttctctcgcgaattggctaaattcccgggcgggcgacacccctactcccctgtggcccggccgtcctccgcggttggcttggcctgctttttggcttacgaagccaaccagcccactgagcttacaacttagccagcctagcttgtttttaacttgtagggggatgagccagacttacttaacgggcccactgggttaattcaccctaacgccggtttttgccaatttatttccggagggtattcccttcccgatgttggaaacctccaacttggacagggcccttttttttttttttaatcccattctccctttttcggggccgggccaaattccaccaatccttaccttttttccgcccccctctcttttgtaaccccaaacaaggccccgctttttctctttccgttttaaaggttttttttttttccccccggtttttatttgggggggagccgcccaaaaaaaaaaaaacttttataccccccctgggcgcttccatataattgggcggggggcgcccaccc

SEQ ID NO: 29979 - DNA, 2170 bp, Oryza sativa
  unsure (1)..(2170): unsure at all n locations
aaaccccctttaattttttaaagggggccgggaaacacgagaaggggttggacccttgttttttaaacacaccatttttttcaaatatttaacaaaaaaccgtgaaagtgttgtttaacagatatttaattggtcatccggccaaaatttaaacccaaaaggtatttccgggaatcctcggaaagggtgatttaagattcagggccaacctaatttcgtgttgaaaaacaaattgtgggtgncacaccacggaacaaataaaagcccttgggtgcccaatatttttgcccctcgtgtaaaatttgatattanaaagcaataggccacncgacttaaatgtccacgtgtcatgcattagtgaatataatagctcacaaacatacggaaatatagctagataccggttgcaatccnttcccaactacggtaatagagtgancgatgtgtcatatcataattttttaagccgtgctaccaacattgtacacctttcggatccaanaaatgacactttccaaggaatgaacntaacaaaggtttagggttttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaatgaagatcattttcgtctttgctcttcttgctattgctgcatgcagcgcctctgcgcagtttgatgttttaggtcaaagttataggcaatattagctgcagtcgcctctcctgctacagcaacaggtgcttagcccatataatgagttcgtaaggcagcagtatggcatagcggcaagccccttattgcaatcagctgcgtttcaactgagaaacaaccaagtctggcaacagctcagggtggtggcgcagcagtctcactatcaaggtattaacattgttcaggccatagcgcagcagctacaactccagcagtttgatgatctctactttgatcggaatctggctcaagctcaagctcaagctctgttggctttgaacttgccatctagatatggtatctaccctaggtactatagtgcacctagtagcattaccacccttggcggtgtattgtactgagttttaacaatatagtgggtcggaagttaaaaataagctcatatatcatcatatatttcacctgagaaacctcgggtgatatatcctcgtacatcgtcataactaattaccatcattggtactctacaatattactatgtgcttacattccatccaaagctactttgtctttaagaataaatggagcgttaaaggatgtccattcttttaatctagtaagaacaacaccaagcacatatgtcaaatactaaattcactacacaaaatattttgaccttacaaagcacgttaagatgtatcaattcacatttgattcttcattcactactaaaaaaaagcgcatgttgaaaggccgcatatgcatgatcatttgtgatattaacatgcccttattcagccaacatgttacttcattcaaatattgttgttgtttcaagcgacattaagatatgtattcaaagtttaaacactgggtattaatgactctaatactgccatttaattcaaatgaaagccattgttgccacatcttcctacaatattatggtccaaggacttttaattgaggtccctcctttgtgtaccagaagtttacctgacgtaacctattcgtttaaaccaaaaaggctctccccctataagggggaacaccaaaaagattttttgttctctttttatctgcccgaaaataactaaaaaaggcctctcttcaaaggaaagaagaagtttcttttatgctctcaccgcgggggttttcgccccccctttatagaagatttccacaaagggttttacacacaacagtaatactcttcg

SEQ ID NO: 29980 - DNA, 2562 bp, Oryza sativa
  unsure (1)..(2562): unsure at all n locations
aatctaatttggcggtttaatgttcccagaagaaaacatttaaatatttttaaggggggcgagaattgtgtgttcnataaaccaagcacatacacaagattttttcaaaaaaaaagatgggcgttgaaacacaccgcgtccttttccaatttttaatccgtgtaaaagcccacattaatatagtgcccaaatcttttctatttagtataaaggccacttatattaatcacggttccacagttccaagtgtgcttccatccctaatccaagtgacaantgggcattccaatcaccaatccacnggcttcacttgcttcacagaaatccaaagaaaaccaggcctgagcacttgttcttaatcattttttatcgaaanggaaaatgnacccacncncnatcattttcgtgacatatattatatatgttggagagtattttgtttactagaataaagcctnacacttgaggtgagattgagaagaananaatcaagctgaatattaattgtgaataaatatttttatatatttagagctgatatgtgaaattcttaggatgaatgaaaaccatacnacatgtttctcttaaaaaatacngacatggttatcctagtggctatgtatcttcttatccaacgactgctatctttactctaatatgcaatctaatggttagaaagtgtttgctttatatgagttaatgttccttagtggatatcaattatatagaaccaaagatatcattgcaacggatgatcattttaggtaaactttttgcatttttagcatttcaaaaaccacaactgagtgactaaatcgaccaaaacaactttaaagtaactctgaaatcaaaattggctgctacttataactaaggcaaagacaagcaagctcaagtagttattaataagtattgcttgaaaggtaccaagaaaaaaaaaacactagtaatatatttttgcaccatcgtgtagcatcattacccttcttgattatagggcagcaatgcttaattactgtttgtcggaatatatatcagtacataacctgtattttcggatcggtattaagcttttgaattgaaatgataagtaacctcatctttttttttatgcttatacttattaataaaaatttaaattttcaactttaaatttgaagttgatttagaggtttttcatcgaagtttattttttagcctttgtttttagatcgctaaaaacacgtaatatttttattaataaattatttttcatttgcaaatatgtcccaactgatattgctgttaatatgttaatatggtatcagagatagaggttattgattaatccgcgcaaggggaatgttgttggaatataagtaaactgctcatctttacctatctacttaaacttttagatcgaactgtatcaatgttgtagctacaaatgcatacaacacaataaatatgtgtgcttattattgttaccaataaaataagtcatgtgaacaatttgatgttatgctgtgtttgtaagtgcctgtatatataattgcactttttaattctgccttttttaacatggtgcacatagcaatactttgtgtccaggtacacagcccagctaaccactgtacaaaggccttttagcacagagacttcacgagaccacgagcagagaatcaaccgacacaaactactctccatcaaatcatcaaaccaaacaccactacttttctctccaacttcacgacgccggagatgccaccggcccgcgacgacgagtcgccggcggccaccggcgacggctactcgaagaaagttctgcagggcccgtacgagctcgggcgcgtgctcggccagggcgccttcttcaaggtgtaccgcgcgcgcgacgcccgcacgggcgcncacgtngccgtcaaggccattcgcaagcagcagcagncgcaccaccacccgtcgtgccgttcgcccaagcngnncgcccgcgccgaagtgcnttgaagtttgaccgagnctnncnnnncccccntcctttctgcccccctccctccttgtcgtttttctcctttcttttatctcttcttctcntttttctttctcaatatctatancatggcaaacattgccttcctggaaagacctttattcgtaatatttggttcgggtaaaaattcttttttaacccttttattctggatggggcactaccttcctttgcgagttttttattcttctaaggggtttatcgggctacatacattttataaaccttggaaaaaacaattttctgcccgatttaaaagagggattccatcttcaaccgctaatcctgggtggttaatctttcgagaccatctttaaatgtctgtactcactctgatgggccacctttctcacgttctaattgtgaaatctggtagttgttgtcttacccggtgtataacgcactccatattctcgttcgtgaacactttataacgtctctctttttccaccacgtctttttctcaacacctcttctcctgtatagatatgtggcgattaaataacgacaacatttcgattgtctctctgtcg

SEQ ID NO: 29981 - DNA, 18020 bp, Oryza sativa
  unsure (1)..(18020): unsure at all n locations
cttagaccgaaaaatgtaagctcacataatttgtactcatccaaactcacataaatttcttaagaagaatctagaccacaaactagccatagtcacacaaaatatctttttatcaaaggtatattcttataagtaatttttattccacaaaattttctaaaggacatactgtgacacttggcatgaatctaatttaacattctttctttatcaggttataaattgaaaccattgaacgtactttgtcttcccgtccctaaaacattgtgatatatctgtaatattttaatatttttaattttaaaaataatttagactaataatatagatatttaaattaggtaattagtaaattcaaatcaactatagtttggaataaaaaaacaaaatgatatatgccaagtacaatctaataacaatagaatgcacttttggttaatgtttactcctaatttcttaatttctagtttggctccctccaccgttatggtaaaaaatcgttatgttttaactatttatctgctagagcatatgtaatatttatgtaaactatgttctttattaccaatcaaaatagacaccttacctactttcatcaaaagaaataaaaaacaacactaataaataatgaacatgattttagatgtagtaggtattattctggaatactcctcgtcggaaacatatggaacgcatttccctcaaaacgcaaaaaccggggccccgagccctcgacaccaaccccgtcggatgtgaagccgacggcccagatggaggccagcggtgccaatgcgtaggccacgcgtgcctctgcgcaaatcttatctcccgggaggctccgctccacttcccttcccgagtcactcaaaccatccaatccctccaccttcccttcccttgcccccatttcccaccgccgccgcgccttgcccccattccccaccgccgcggtgcggccgccgacgacctccacacctcgagcacgcgtgccgccgacgaggtgcccttctctctctcactctcgtctcccccattcctcccctcttcccgtgtcccgtcgtccacagctccccgaccaaatccctagccctactattccccacccaccaggcctccctcgcgtggtcacgccgcacgatcgggcccgacagtgccgccgcttcttgccctactgccgcggttctttaagagggttgtcctgatttgctgcagcccagtaggtattgtatatttttctcgttggtaaatttggcagcaaaaaaaaaagtgtttaataccgaatgttataaacccgagcatctcatggtgtctatatatcagcatatatgatatgttaggattggtaaggatgcatatcacacgattacaattaccaactccacctcgaagataataagcccaatagtctaaccctaaaatccctccctacctgtccggtccttttctcaacgattcccagaagcgccgcttatctcgagccgagtggccgacagcgccgcccaggagtcgaggagtcgtagctcgtagcgccacccttccttgtgcgcgcggttgtgccctttctcgccgccggtctccccgcttcacctcgcatcctcaacgtcaacagctgccatccgctcctcacgctggctatcgggaaggtcagtaggtcacgccgtctccttccctacttgcctccggccaccctaagaccccaactcgcctcttcctcgcgcgaatcgcctagttacccggcgggcgacacccctactcccgtgtggccgcgcgtcctcgtcgtcttgcttgccctgctttctttggctcacgagccaaacgagcccgctcgagctagacaactagccgagcctagcttggttttctagctcgttaggataataagccgagcctagctagaccgagccgagctggctcgacatccaccccctacacgcgtgcctttgcccaaatcttatctcccgggaggctcacttccctccccgagtggctgcgacgacctccgcagctcgagacgaggtgccacttcttcttctctctctccatcccccattcctcccctctcttcccgtgtcccgtcgtccacagctccccgaccaaatccctagccctactattcccgcgcccgcccctccctcgcgtggtcacgcccgacagcgccgtgccgccaccgcttcttgccctattgccgcagttcttcaagaggcttttgtcctgatttgctgcagcccggtaggtattatatatttttgtggttggtaaattcggcagcaaaaaagaaaaaaaaataataccgaatgttataaacccgagcatctcatggtgtccatgtatctgcatatatgatatgttaggatcggtaaggatgcatagcacacgattacaaccaccaactccacctcgaagataatatagcgtagtgtttgccagcttcgcacgttatggccgaattcttatgtataacaaatttaccatggtatgtaagctcaaaaatgcaaaactaattatcctcgaacctaaaaaagtgtatacatgcaagagatgatcaatcccacatataaatacatgcaaataatacacgccctgctcgacagccactgctgcagctgtacctaagctactagctgtggccgcggtgtgcatccacaaccgtagcaatggctgctcagcaggcccatgatctctgaaaaagttcctgcaagcagtacatatgtatgtacagttgtacacaccctcgcccctattcatcctcttaaaggagtaaggagtaatgacagtcgatatgtgttggttgattaaaatttagaagagaacgtttttgaatagaattgtgaacttactcgaatatcgttcttttgtgtattgcttttgttatgcttcacctgactctatctctgtgaaatggcagctagtatattgaaggttgaagctttgtgggtatccagcaagtatttcaatggcgttgctacagtttggaggtaccttggcccccaaacttggggaaaaacctcagctgttgcccaggtcacctgcacttacaagagttatttatgctgatccaagatttctggtgtcgaaaagtgggtatgtgaatgtgttctgatcagtgagatgtactaggaatactaaaataaaggacacattgatattataaaaaggcaagatttctgagtaaactgaagatgatatatctctttttgtgcagtagtggaggcaggcttaaacaccttgtatcacctactgctagtttacaatcacggacatcttctcgactatttaaccatgcaccatcaccgagatttcgccatcgaaggagttcaaggttcattgtcagagctgatgctgtgagttacttcatttgcttttcttctttgctggtattattagaaaatccagtttcctgacatggatttgatattttaatttacaggatttctattccacacttggtgtttcaagaaatgctagtaaatctgaaatcaagagtggtaggtgtggttttatttgtcagtttagggcatgcagtgattggtgctccgtacaatcgtaggagtattacccagctttgcttcttctctagtttgagcctggttgtaggtttgtaggtaccctataatttaccaaacaaaccagactgctttcatgtggctattagtcgtagattactagttttaaatcatactgttcacgtgtgaaacaaaatatatgtacaacagaaactgttaagcttcccagggaagatatgaaatatataactagtctttttcaaacttggccatagtgagctttatggcccacttgtttgttctcgaaagctttactattcctactagtaactcaaatatttgctatttcatctaatttgaaggctatctcagcaaaaccccttgaactattctaagacaagcctatgctgtcttcagtatcattttctgcaactgatcatcttgcgttctagactcgatactgtttatatttctgaaaatctattgttggcaacttctcattgatgcattgtttgtatggccctcaatccctgccctccacgtgtgtgggcagaaattttgaacaaaaatcccaacccacacccgtagataatctaggatttgtcctatccaaataatgcctaaggggatattatgttagaaatccttcagagtcaattttgatcaaaatatgtgtagtagtttaatgttgctttctattgtagttctaaaatggtccttcttttccagcctataggaagcttgctaggagctaccatcctgatgtgaacaagtaagtactaaccattatatgggaattgtgtttcagctacactcgatatattgcttctttttctcctttcgatccattataaacctgagtactagttgttgcattacctttttcataactacataatcaaataagcaattgttatgcttgtgtatttttctttagagatcctggtgctgaacaaaagttcaaggatattagcaatgcttatgaggttagtccagctaaccataaccaaatcccattgtttcttatgactatgttgttgtagggttacaggtgcttgccagctaacataaataggattgcaggttttgtctgatgatgagaagcgatcaatctatgataaatatggagaagctggtttgaagggtgctggaatgggaacaggagtgagtgttcctagaatgttgtccaattctgaagtatgatcagcatgacctttatatgatattgattgtatgaaatttgtgaatctgcaggattactcaaacccattcgatctctttgaatcattattcgaaggctttggtggaatggggggaatgggaggccgtgctgctcggaacagaccaatgcagggtgatgatgaggcctacaatctggtactcaatttcaaggaagcggtgtttggtgtagagaaagaaattgagatcaccagactggaaggctgtaatacatgtgatggaactggtgccaagcctggaacgaaaccaaccacatgcaaaacatgtggaggacagggacaagtggtctcctcaacaagaacgccacttggaatattccagcaggtctccacctgcaatacttgcggaggcactggtgaattctctaccccgtgcaacacttgtgggggtgatggccgagtgcggaagacaaaaaggatcagtctaaaggttcctgctggtgttgattctggaagcagattgagggtccggtctgaggggaatgctgggcggagaggaggccctcctggagatctttatgtgtttattgatgttctctctgatcctgttcttaagcgagatgggacaaacattctatacacatgcaaagtttcatatattgacgcaattcttgggacaaccgtcaaggttcccactgttgatgggatggttgacctgaagatcccctccggtacccagccaggcacaacgttagtgatgtccaagaaaggtgtcccactcctcgggaagtcaaatgctcgtggagaccagctagtgcgtgtgcaggtcgagattccaaagcgtctgagcagcgacgagaggaagctgattgaagaacttgcaaacctaaacaaggctcaaacagcaaacagcaggagataattccatgaggcttcattggacaaaatgctttggcaatatgcaattttaacgcaaattgcagtgactaagtgagcatgaactggtaaatcacttcacaaactgtacgctcatgctgcgccgtaccatcggtgggaactgtgaattctcatgtctgtaacttcatttttaagccatagaaatctagttccatccaaaacaccaaaacggatggtgttttacagtagcttgtcatatgcttttaggcgagcttattagtctatttttcataatactttttcacaattttgaaaggcctagggagaaatatttaatggtgcaaaagggacgagttttgaaacatttgtttgtcgcagaagcaccagaccattctgattgttattgtaagctgtaacatcaaagttttggcagcaggttttcatgtgctcttaagcgttgggggtttgttccgtttggttttcaactgtatgctagctttctctattagccaatgtaatggcagttgcaaaatctgttgtagtgcaggcgtgcagctaaatgcagtatagctgactgttaactttaagctgattgttccatgcatgtgccagtaaaaggccagtcaggaatgagtctcatggatcaatatatggtgcagacatgtcagtaggatataggagtattacattatagttttttcagcttcaataacgttcatgttagcttgtacattgtatggcaacccttccatacttgcgttagccacaaaagttcaccatgttagcttggctttagatcagtttaaactgtcctttaatagcaaattaataatccataaatgaaattttacttccactgtttaccagtgctactactgttctacctccagcgttcaacagctgagaaacgtgaggagtccagcaccagcagtaccatttactgcaatgcgagagagatgttctccgtttcctccttcactgaggcttaggagtaggagtagtagtgattttttcgtgtcgacttgtttaacattatcgttaacaccatcaagtgtcaatgccagtagcctgctgcttctgatcatttcttccttccctcttctaacgccattatcgttttatctcaccttgcatttatgttcaagtgaccatggttcttgacagaagcagcccttgttctttcctgtccctttgtttgttcagtacgctattattctcttgggtactagaccttgtataaaccggttgtgaaatcctcaatcaaataaaagttaactcgaaatttgtggcctgttccaagtgtttggcaaaccaatatgtatattatccacccgattatctaatggcaatacagtgcctaaaattcctgcttccggagtcttaaactttacccgaatccaatctggaaaccgaaaagacagctgcttggctgatggcaagtcactgggtacattgatttgtgttaattttcagtccaataaaacagcgcaaaaattgtaagggtgatccctctttagtaaagccatgcattctgcaaactctgttgcaatgcaagctgtatcctatatccagtgccgatgaaccaattctgtttgcagactgtaccctatctctactctacaagccaaccaaaggaaagtgtttgatctgcagtggaatactagcaggtattccaccatttcagggttgggagtgtgattgatatgcaggagattgacattgtgcagaacattggccgtcaggctgccgctgccgtcgccggtggtgtcggtgagaaagcccggtggtggtggttgtgccggcggcgaggagtggctgcaacaggatgggctgttgtgcatgggcggatcagcgggtggcttatggcggtggccacgctgttcgccggcgacggacccggcggcggcggccttcacgagggacggcgcatgatgatcctggataatttcgagacttcgggccggcgtgcgtgcaaagcccatacatattctacgcgcaactgtcacgcacaaaaacgaagtttttagtaccacatggaaaatctatgacgactgacaccggcataaaagacgacgcgctcgcatcgctcctggcgagctcggtggcgtgagcttgttaccccagctgcggggggggggggggggggggcgggagttggcatgtttcggctgctggagaaaatgaggtttctccctcgatcgaatatggatgcaaacatcctcccgactttggcccacgaggaagggaaggtgtgagtcaccctgggctcttgacggctgcgtcatggagcgaaaaggacgctgaatcgtgggaaaggtgtgtggtggccggtgcccgacgacggcgcctggcgatgggtggggagaaggtgagcagttgtagttgggacccgtgccacacccccgcacgtgcgcaagtccatgacgtgagcgctcccggtcattaggagccacgtcagctggcggcctccgccgttgagcttttccctgccaaccgacacccttctccccacccattggcgaatgccctagaggtttgggttgagataggagtagaggggagtgaggtggaagaagattgctagttggcttgtgggttccacgtgggccctgcactgactcagccaccacgtcaacaaaaaccggaaagcaatactaccttgggattaaaagtggaccgttttgcaagattaggggttcagggccgtttaaaactcaacgacaagataagggaccttagatgaacttttttgggagatgaggcgcctgtgcatatgacccataggcaggcgacaacgcggcagcagagcgctgcacgacctccgcctccccaatccgtcccgtctccttcgcccgccgccctcgactcccgtctcctcgcctgccgctggcgccgatctccatcctgctagcagaggtggcgccggcgtcctcctgctcccgccgcattcgcatcctaatccatcccatccggcctcggcctcgaatttcgtctcctcgcccgccgcttgcgccgatccccatcctgcgagcagaggtggcgcccggcgtcctccttcttccaccgcatcgtcgctcgccggtgagcatccctccctacccacacctcatcaggtattctgcgttatccctcaaaaagtttgggggttcaaccgaaacagggttagatctgcctctgcccagctccacctactttcaagttgttaattttgatttccgtttttagcagatgtaatttggttattgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactgtgacacttggcatgaatctaatttaacattctttctttatcaggttataaattgaaaccattgaacgtactttgtcttcccgtccctaaaacattgtgatatatctgtaatattttaatatttttaattttaaaaataatttagactaataatatagatatttaaattaggtaattagtaaattcaaatcaactatagtttggaataaaaaaacaaaatgatatatgccaagtacaatctaataacaatagaatgcacttttggttaatgtttactcctaatttcttaatttctagtttggctccccccaccgttatggtaaaaaatcgttatgttttaactatttatctgctagagcatatgtaatatttatgtaaactatgttctttattaccaatcaaaatagacaccttacctactttcatcaaaagaaataaaaaatgtagtaggtattattctggaatactcctcgtcggaaacatatggaacgcatttccctcaaaacgcaaaaaccggggccccgagccctcgacaccaaccccgtcagatgtgaagccgacggcccaaatggaggccagcggtgccaatgcgtaggccacgcgtgcctctgcgcaaatcttatctcccgggaggcttcgctccacttccctccccgagtcactcaaaccatccaatccccccaccttccctttccttgcccccattccccaccgtcgcaaggaaaaatattattaataaacaatgatgttgatgtattattattaaacaatgatattgatgtatttctaaatattttcacgtattatttattaagtgtcagtgattgaaatggatcctggtcggaaatgaatcctggtcggaaaatggttactaatgtttttccttcatataatatttctggatatgtataacaatgtgggtcagcaatattgaactatgcaaaccattactctgtacaatcttttcttttcaaatgctggccacatttcgctcgagcttactgctcatgtatgcagctcatggatcctgagatctagacgtcaacgtgcttcctggaaagagagaggctcaggcatgagagcatacctctaaaataatgtccgtgcttacctgtgtgcttgataacatgggctcatcctgtagcagatctcattctttaagtgaggctgaaacaaccaaaaatgcaaaagtaagttagcactcggacttattgaacaagtaaatgctaactcaattcttgatttgagagttgccacatttggtttcttctaattcagctggtaacagtctgcagacattgacaggcgaattttgcaagagacaaaagcagagcaacacatccacaagctcttacttcttggtattgctaactttcccaaatttaagtggtcattttccttgtcacaattatctgtgctacctttagtatctattggttcagaaaattaattgtttatgttgttcctatttacctctataaaaaaacctttctcatgttatttccaaaaaaaaagaagataaataaatgtatcctagaaatttttagtttgaacttgttctcaatgtggatccatccttctttctctctctcaattgcttctgttttaaggtgcgggagaatcagggaagtctacgatatttaaacaggtgatgaatgttatattccatggagaatcataatccgtacgccgctagttagtctgatgtattcttactgttcacctgcagattaagctccttttccaaactggctttgatgaggcagaacttaggagctacacatcagttatccatgcaaacgtctatcagacaattaaagtatgcaatactggaaagggtgtgtcttttttttcttattgcaaagtggggattatgtaggagattcgactagggatttgtattctgttcataaggaaatgcgttcatacttttcctttttgtcgagtaatgtgttaaatgttaacagatactatatgaaggagcaaaagaactctcacaagtggaatcagattcctcaaagtatgttatatccccagataaccaggtttgtgcttactctttactcaacagttaaagctaaatctgtgcatatgaacatgtcttgttaaatctgggaatacaaacattttgatttgcaacatttctgttgtagtcaagctgctcggctctatgttttaacctgttaagaccttgtagactgtgctcggctctattgtagtcttatattttacacggtcattctataatgaaaacttgaaaaagatatctattgaaccgtacaatgtactgaacaaagtagaaaagaacaatgagattttgtaacatttattcttccttgtttatttgattgcttcagacaattgttgatatgctaaaaataacttggtatcaaatgtgggtgttataagattcaatttttttctcaaccaggttaaaaaaagtatacctttgtgcatttaccttgttccgttgctttggaactttaaaggaaaactgacttttcttaggcattgaaagacaaatatcaccagtttcacactgtacaccttaccaaccaattttgtttcttagatgtcatttactttgtcatatcatcaggaaattggagaaaaactatcagatattgatggcaggttggattatccactgctgaacaaagaacttgtactcgatgtaaaaaggttatggcaagacccagccattcaggtgaaaacaaatagccattcaaatcttttgaagttatatagttttcctggccaggtgtgctgaagcaatgctctatactgtaggaaacttacttacgtggaagtattctgcaacttcctgattgtgcacaatacttcatggaaaatttggatcgattagctgaagcaggttatgtgccaacaaaggtgtgctgtccatgttcatagacaattatttacatattctcagatatttgtgctgacaccatttcatgttgatttttagtctacttagtcagaggttgtcaaatggttaactatgtgtactgagtcagaggttgccaaatagttttaaaagatgggcatatgtttatccttatcttttaaataatattggaggctatcctttaaaattcaatattagggaggagaaactattattctaccgttattacgcagtctacataacgaaggtaaaaaatgtccctgtgaaacatagggtgcaaaactgctgtgaataaaactctacttatctaagccccttgagcttttgagttcccacatattaatcttatgacactagcatatattttttttgttcagttccttcaataagttgcaacccacaaatatgatcactgtaccatccacttttgcaaccatttcccgtcattttttaagcatagaaaattgtttgtcacttgtttaagtccacactgcatcaaaattccaattaacattgtgtgtgctaagtgaagatatgactccatatttctgcatttagcagtctgatggataatttgtgattgtaccttgtctaatggttcgtttgaaaggctggtagttgatcttccatacttaagaatgcttgcagtattatagttgtcaatattatgagtcattttgcaggaggatgtgctttatgcaagagtacggacaaatggtgttgtacaaatacaatttaggtaatctgctgacactattttttgcacatttttttgctggttgctctactatgtacagaacgacaagttgaagtcctttttttctcccctttcacttctaagatatgacctgagaggttctgaatgtagctgttttaagatgagttgaatcatctagttaactgggtttctttctgcagtcctgttggagaaaacaaaagaggtggagaggtatataggttgtatgatgtaggaggccagaggaatgagaggagaaagtggattcatctttttgaaggtgttaatgcggtaatcttttgtgctgccattagcgagtaagtacaatttttttgattgttgaacttatcctaatctgctaagttcttctcataggcttcttgttcatttcagatatgatcagatgctatttgaagatgagacaaaaaacagaatgatggagaccaaggaactctttgactgggttttaaagcaaagatgttttgaggtctgcatgcatccatctctgcaacctttgtgctcatgctttttttctcattttgaaactaattacggtgctatattgaccatcagaaaacatcattcattctgtttctcaacaaatttgatatattcgagaagaaaatacaaaaggtaaggcctgctctttgtaccaatgcatagtttagtactaaatgttaccaacatttatgtttacgctggttacgtaggttcctttaagtgtgtgcgagtggtttaaagactaccagcctattgcacctgggaaacaggaggttgaacatgcatatgagtgagtgcactactcgccctctcagatgaacatgggcatttggccatttgtaatgttgctgcatggtgcacttatatgccttgataagtttttccattctaatgttatatagtatcaaacgttcatcattactgtggcttatggtctggagtgacgttttacaggtttgtcaagaagaagtttgaagagctctacttccagagcagcaagcctgaccgtgtggaccgcgtcttcaaaatctacagaactacggccctagaccagaaacttgtaaagaagacattcaagttgattgatgagagcatgagacgctccagggaaggaacttgattcagagctaagactaggttgtaagtcacacagggaaggtaattaggacggcgagaggaacaaagtttcacactgtcacagctttatctgttgtaattcttttacacgtggaccattgattgatcttttggttcttactgtgggctgttcaggtctgtaccctattttttgttctctagttagccattgtgcaaattttccttgaatcagattctctacctgttgtctatgtgtgttatcttggtctgttaatttgcatagcccacttgttcattacaaaaggagatctttactacttacaaaaaaaaaaatctagtgggaaagtggttgcaaataattgaagaaattatagctagaaggtgtatccatggtggtggcttgagcccttgaatcccgttattttgcatacaattacatatgttattatagcttgcagagtacaccattagctgtagttacctggtccaccgtagtatacatgcatacagtaagcattaattccataactatcggaggtcgattttgctatatatttgtcgacaaatttttcctttgacagatgtaattacagtacaatcgtagtgtaattatattgtaacttgcatgtaattacactgtaactaacttgtatgtaacttttaaaaatctctccataacatgttattttggtaaaatagaggtcatgggaacaaattctttcacatatgtgtgtgctatgatttgtttttttttctcatcaaaataaatcttataatagatctaacgattcaaaattatgtgaaacttacatataaattacagtgtagttacatgcaagttacagtgtaattacatataagttacagtgtaattacactacgattgaactataattacatctgtcaatttttgaggaaaaatttgtcgacaaatgtataggtagtccaggtatatttacttggattacaggatcctgcataggctttaacggggtttggattaacaagcttcttgttctcattcacgatcaggatgtccctaataaaagccactgtgccataagcttctgaagcaaaatgtctattacccatttgtggagaattttcttagacggttggaccctgaacatatccaccccactttgtataactgcccattaccttcatgtaactgaattgagaacttggccaatatcctattgccgtattcttctcaccatataccaaccgtcagttttttagtcttcgggtcctaaaattaatttaatttgtgttcaaaagtgtgcaaggggcaacatgccattgaatgcacatgacacggtattgttctttttttatattctaggtgttttaacaagagtttctttgtactccctacgtttctaaatacacttgccattagttactatctaaattttaacttttaccactcatctttttcaaaaaaagaaaaaatcttagaatgataaagtattatcaaagtgtgttgtgtcctaaacataagcattaatcatttgtcaaagtcttagttatttaaaattaggggcaattgtgtttctgcccctgctttacatgtcaattgtgattttaccctgctttttagagtttgtgattttgccctacttttttgaaacgaagcagccgcatgtccctactctgttaactaatggtaacagtcttaaatgtgtggtgaatggacaaatatacccctggacatgttttggcttgtgcaacaccacgaggccgcgccgacggagccgccgctcctttctgccactcctccgccgaggggccgccgtgccaacggagccgccgctcctcggggccgccgcgccgtgccgcgcctgcccacgcccgactccaccgcgtgctggcccgagccgccgctcctccctgctgcgcgccgccgcttgtcgcgtaagccaccgccgccgctgcttgcaacctagcaagctagggttttcgattggatcggggacaacaaggtttggggatttggttgtttcattgaagcaagggtagaatagtcattcacaaattataatagcattttctttcttcgtttaatttggaaatcccgggcccaccaaactaccgtccaaaccaggggcagacggctgcttcgtttcaaaaaagcaggggcaaaatcacaaaccttaaaaagtaggggtaaaatcacaattgacatgtaaagcaagggcagaaacccaattgccccttaatgttattaacaattaaagttagaatagtgatggtcaatactaacaagtatttgggaacaaagttagtataatataacgtcttttctctattcaaagtgaaatggtattgttggaagaccctagggaaatgtctattatgatctaagatttgtagtaagcttcttttattgtaattgttgtcgaaacgacaactgcatacgtcgaaagacgtggttactcaacagtggttggaaagaaacgaagtgtattaattttagaattttttactccggatccccccattacatggccctaggggactatttatagccccattacaggttcttactactagggtttaggttatacagggaaatttacatggttgcccttacgaaagggacatttacaggggtacataatgttatggaggctcatgggcccctgatgggccgtcgggcgatcgccggccctatagcccctaggcctgatgggtcggaaagactttttcggccctcgcgggagcgaacttgccatggcgaagtcgtcttccttcggcagatactcttcgccttgcacccttcgcctgggacgcctctggcttactcgcacgacccctcgcctctcgccattcttgctccatagcctttgccacgggtttcggcagatttggtcgaaaggcctcatgccatccgccaacagtaatgttgtgctaacatgcaagataatctaagcattgctcttgatgcatcagatgtacttctgaatatagtatgtagatataacatattatgcaaaattggtgttttcttatatatcttgagtaacttaattaatataatagtgaaccacgtaattttaaccatattgaatttcatgtaaaatagagagtaccttaaatataagaacttgaattctatattgtgttccattatagacggaagcatggtttaatcttcatccaagaacaacactgctgctaacttgaacgaaaccaggacggctgtggtcagtgcaagatttgttttgcgcttcatcattctgtagcgaaatttattccaaagtcaatacctaaaaatggaaaatatagctctataccatctcaaagcggtataaattagtaggaaaaatatgtactgtataatccaatgtattcgtagcaaaatgtatattgattacccagaaaattgtcacatcctgatttttgtttcaggatttctaaattatttaataaattattattagaatttatattaaatgttcattaatttacaagtgaagttaaatgtgggaaataaaatttcctaaatttaaagcatggatggatttaacttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaatatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaattaaaaaaggtttttaaaagtctcttttggctttgggccgaaagccggcccaaaacctctctctctctccctcggcccagtccggcagcagccgcccgcgcgcgcgttcgcccgctgacaggtggggcccacctatcagggctgtcttcctcctccagccgtcgcccggccgaaccctagccgagccgcaccgccgccgcctttccaaattcgctcgcccctttcccgatccggtgaaatcaatagaggggaaatgatcttcgcgatgtcctctaccttttctcttttggaatcatcgcctaattcggtttgggtaccgagctagaattcgccttagagtaatgagtcgcactcagn

SEQ ID NO: 29982 - DNA, 9913 bp, Oryza sativa
  unsure (1)..(9913): unsure at all n locations
ntttaacccaaagattcattttttgcatccataaagggggaaaaattgaaatctccgaattagccaattttggttattgaccaaatttttaaaaagagccttccaaaattaataaaagttttaaattcttgtgtggcaaaagggcaaacacttttttttcctggccaatggaaaaaccgccggggggttggccntaaagggggccccataagggtttttctctccacgtggccggcgaacctaccgaccgcccgccccgcttccaattcgttggccctttccgaccggtaaatcaaaaagggaatgttctcccatgtcctcacctttctctttggatcatgcatattcgtttgaaactggggattggatcggatcgaattgtctctctctcggaacctacccttccttcgngtcgcggtcgcgttgggtttaacaccgcctcctgcccctaataaagaccncggagctcccctctaccgcaagccactttggctttagcccgcngcngtntgtagcgccctagccctgtaagcttttgcgcngtcgtttgtccacccgtgcgccgccgtcgctccggtcgtcgtcgtcgctcggaaaagccgccgtcgggatcaccaagccgtcgccgatctcgtccgcccctccgccgtcgctgtcgaccgctggaacaccatcgcggtcgtcaagccgaaggtcgtcgccgcttcttgctcgtaaccgttgccgtccgttgatcttccgccgttgttttggtcaccggtgagttcgctgcgtcacccgcatcgttttggtgctctcctttcgcgccgccgcgccgtcgttcgccggcgggcatgcgtgcccaagtcgtcgctggtgatgacgtcaccgctgacgtcatcgtcgtcgtctcccgtggtccggccgtggactgatagatctcggccgttcgtttccgtgagccgccgccgtgcacccggtccaccatgaacccgacccgctgacgcaataatcctctattccttttcaaaaataattcattattacgtcataattcaattaaaatctatataaaggatttaatccgatttaatctttgaaaattcataactaattcattgtaactcagtttaatgtggttcaagttgcaaaagttatataaaataaagatctacatattaaaattatccataaatagaattaaatttatttaattctttttaaatgggctttaattagattaaatcttgtaaaattcgtaataaattcatatgaagttagaatgaggccgttcaagtctcataattcatctaaaattatgatctacatgtttgtttactttttatgtactgtttatttggtttttattagtcttttcttcgttttgcgtgttagcttgtcgtttccgtcgttgcgaaggttcgtgagtgcgtcgggagtgttcagaagattaattgaagaccgattattgcaaggcaagtaacagagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggatattataagtgtgtaacgttattattatgatggatttgtatattaaattgtcagtttgtgtacctcggctgattcctggacgaggattttatgcacaaataagttcggaaattaccagtgaatttccgggcgtgacaaaaatatgaaacctagcaaagttatcatcgctgaagtttggctagacccaagagctagcactaaccacatctccacatcctgtgccattttcaatttgtatccatgatccactaggaacccaatgatgcttcacctttggctcgtaaacatttgttgtgacccctattccatatatatatcatcccaatatattatccctgctttctacaaggaaaaaaaacatttatgaatcaaaataacgtaaatacatatacgaaattttgcagcatgttaattacatgaaggactgaatgtgcaacacttagaccctgtttggcaaaatggttatgggaggtggagttgggaaatgaaaaggagaggatgcctaggattaaatgagatgaaaagaatggatggctagaattgaatcttacctgatgggtggggcatatttttccaaacccattagctagtcagaataaataaactaatatttattcataagcttatgtaagataaatttatggtactcagaaatataataatttaaagttggtaatttgggtaacaaatatcgacaaaggacttgtttatttgaaagagggatgtcaaagtgaaaaaccataatcttactaacaaatagcacttcaaattaaggggccattatataataccccatcaatttcttaatattttataatcttgactggtgcttgctttactttgaccactgatatattttaaattgttcgattatgataaatggaattcatatgtttatatttaccatgtaacatactacgttagcacggtgtaatttttagtacttataaatttatctataaaatagaaaatagaagtagtcaaactaaaacaatgcaaggtcgagggaatatttaggttttgtgtatctgtttgagttatacagagcaacacatatttcatttaacaaaattgattgagttcatttattagcacttaaatatgaaaacatccaatacttttgtatagctttttcatagaccaatagtaatatagtggttttgtgagtctattatgaagctagacatatgaacaactcgatacaaaaatcttacctttttttgttgactggtgctgactgcattggtattctgaattgagatagtcttgtttcttgttgcgtagtactgggatggttcctatagggcattctgcagtagctaggtagttgtgcttctgatatggaagatataaatggattttcaacatccatctccattagtaaagagcttggtttcaactaattgacaaacgaaaacatgaccattttacaaacgatgagtttacatcgcactatgaaaaaaaaaatcctaagtatgatttggtttgtactttacattctttcatgatgaagcaaagatacgcaaatttttttggctttagtgccaggtcgaagtgtaacaaacaaataaatttactattttatccaaaacaagctgaattagtgaatattctagtctcccccccccaacaaaaaaaaaatactatagtcccccaaaactcttgtattttgatttatgactataataacatacttaattattatctctctatatatgtattcagaattttttagcaacatattagacatgatatcaaatgttagggtgaaatatgtgctttacctgaattgtatgatctttcaacaatggatggttaaagcctggttgtctattcatattgatgcaatcatagacatcaccatcttcagcctgatacgatgttctttttgcttgttaggtacaaaacaagatgctatgtatgtacaaaaagatctaattttgcacttacctcgatggttttattaaccccataatttgtgagaccttgactagtatttcccctttggcttatatactgaatttcttcccccctatgattagaacaacatatgcgatagaagaagagttactgtaatcactcgactttccctcattgtgattatcttggaagattccaagattggtattgatacatgaagaagagatactatttatagggtggaaacagatttggtgatattctttttaatgctttgagggaataaaaacaatgtaggcaaggcatatataaatgcagtattgaatgcacaagatttgatacgttggatggtatcagtatgacagtaatttcattgtttttatgtttgaatgagttttcaaaatatttaaagcacatgttgtattaataattgtgtaagataccatcacttgaagattacatagaggacatgaaaaacaaagggaaatactcctaccttcaaatttatatgttttgtgggtaggaaaagactctaatctctatgggctaatcaatagcgtgtttgtaatactgtaggtgttggttgtcattaaacataatacaaccaccaacattttagtaaaataaaagaagataacatgttaccttgccattctttctttaaatcaacagaattccatgagttttattggttcaacatgttttgcaaggttaggtcataaataagttcatttctgaacattttggagagtttccgattgagttataaagaagcgcaccataaccaccaacaacatgaggccaaatatatatttgagtccaccatattgaatctctcgttgagacagtcgaaacggatatatggttcgcccgatttagtgtcggaagcactccgaacccattagtatatttgaaggatgaatagctatacacaattcttccatcaaacatattaagacattcgacgctccgagagaaagatatgtgagacattgctaggcctttagcctgccagtcaacttcagcctgagatgtgcctgtcaaaccactcgaagacggcaaccagatgtgttacacattcagaagacttaacaaaaatggctaaagatctacaacatctcaaatatctttaactcatactcatgtttaatatgtccctaacaaaaggaacacactaaacactttcattcaagcacatgatatctcaacatagggaattctaagttctaagttttagttaagtttatacaacttataacttagataagtatggccgattggccgaatagttaggttcgcggaagcatcttctacccaaaagatctttcctgcaaccgactagggtagaccctagtaagaaccatcctggaagaaagaaacatccccatcgaaatagagtgatctcacctgcaaccaattctaaacatgcaacaatacaacaatacacgcaagagtcagtacataaattgtactggcaagcaccaagcaagcctaatactctacatgcatggcgtattcaaagtaaagcttacatgggataattttagcataaagcaaatttagtttgcaaagaacatttcaaattcagatttattttcaattaaatttcagcaagcatacacttagcaaatgggcatcaaaatagatgttaaacacatataacatagctccttattgccttccatggcagcaaggatataatccataaatcacatcacattttgaagttcaaattcagctttagaagaataaaacacatgtctatactcatgacatattcacacgccgctcatgacagcgagcacggctaatcgattagttttaactctgcagagtacgtacactttacccacatgatgcgaaataataatcatgcaaaaagcatggcacgcgatacataagcacccgatttattactcacaacaaagcccttccaagattcatgatttagccttacaccagcacttacaccagcacgatacgtgttactccatcctaagccatactcgatatatgacctagaaccgttaagtggcaggtccacgccttaaacttaacgccgtggtggcagacacaacgggaacacaccacgtggcacaatagcattgtattggacacacttagtcacctaaactaccacttcggggtaaataggaagctcctctgaattatacgaactcatacacaccggcctaccagaatgtaaggctaaaccataaataatttactaagcttgggctatcccatactagcacatgtggttgtactgtatacaaaatgaactgacattgagtgaagtccttaggtcggtctgggcacattctccccctatcgacacacaactaaacaccatatgtgtaccacatgaggcccaaacttaaaatccacattttccaacattttatttaacaaatatcacattttatcattttaattcagatcacaaaataaatcatttcatatatgtaattgagcccaaatggtaagtaaactcatcactaagcatggctaagcatttctatagacttgtgacttcaaacatcgttcttaatgtgacacaatcaattgttcctaaggtttgaaataatggttaaggtcttttgtggagtttaggtgataatgcaagtaaaggagttgatctaacaaattttacaagattttaatggattagtgtacaatagacatgcatattttgcaaacttttcaaaaaccaccaaatcataggttcaatgtgatcaaagaggggaggtggcttgccttgctcttccactccttgttcagctccaaagtagatctcctcgagactcggcggcgaatcgtctaaacatacatatgcaaaaattaaaattaaaacatacataaaaatccaacatgctctaaaatgaatgctttttatggagttggtgtgctctgtgttaatttgatttttaatgaaagaaacttcaatctaacaatttacattcaaagttacagatttttaaagggtttacatgttaaatatggtcctaagtgcatttcggatttttgagacataaatctttatgattctgttaagttaaacatttttatatgcagagcatgaaaatatgattccaacaaaatttagttttcaatttttatagttaggatgaattttctacaaatttctaaagtttctgtcatttttcagttaataagaaacaagttttgcattttctccaatcttctcaaatcatttactctctcaggtccaccagtcagcgactaagctttttcgcataagcccctgggttcttgggaaaataggtcccgcagcccctagcacgtggtttaggtttttatgcaaaacgacacttgcgttttattttatttacagattagtattggtcccacttgtaagtgactgctcgagttgttaatacatccctgggagtctttaaattttaaaagccatgcccttgctctggacagagcagagtagcagcacagccgcgagcttcacagcatcaccggcggcgaacggcggcgattcagctcaagctcccaaaacgaaaagtgtagagaacaaccatacaaacccattggtggctttattgcaagctttggtgctctatagcggctgttagggtgttagaggcagtggctaagctcggcttgcacatgcatgtgggttttgaggctcgatctaatcgtgcatgcgtatggtaaggactctagggactcaccaagaagcgaacgcggctcggcgaagtcttggcgatggtgtactggttcggcgacggcgcggctgctacggtgtacccccgggcttgtactgcatagaaagggtacgtgcttcggtttagatcagcacaaggtagctctaggcgaaaaagattgcgccgaagctgaccagagaaggagaaagaaaggaatggcgtcggcggccggaattggggaagaagaagaggatctcccatcgtggtccacctcgcgtcgattacttcgggattcttgatctgaaggtgttgatgaagctcgtggcgaagtggctcagcttgttacgaactgttgaagccgggcgacaggcaaaggtgaagctgcggcgtccagagcgctacggtgttccgagttgacgcggtcgcgttcctggagattgggtgcaccaaatgaggtgttcttggttgtgttaaagacggcattgagaggggattacagaacgcatattgaatggaaatggggctcattggattgcgacagcgtcgaggacttctctcgccggcgccggagatggcacctccgttcccgtcgaatccgaggcggggttcctcggttcttccgcgaaacgagacaagggcgagagagagaaggttggtcggccgatcggcttatatgcggtcgccggtggaggaggagaggaggagctcacacgcgtggcgcgcgggttctgagccgtgggcccgaatgtgaggctgacaatgggatcccacattgcagccctggcccacatggcagcgactagtgatagataaggagaggagattatataatattgatctgatactggtttctcccattgatttaagaataaaatatctatgtttgacaaggtgaagtactggccaacaccataaaaccaccactaatgacgaaaagctttggaaaattaagtgcatgacaggcaaacttagacgctaattaacctgtgaatttgccagtaaatattaaaaattttcgcacaaactacatcagttccattttatttttctattttgtctgcataagtataattcgtagttgacgttcaggtcggatatataagaatatttttgttttcttaatacgatatatttttatataatagaactgtaataatttattgctacggttattacatatgatttacaaaacatagtaaataatatgcaatattatttaaaaatagatttttattataagtagggagtctgatgaataatttggttatgctttactgattaagactctagtatcatgaaattcagaaaatgattttttttttacataatgaataaactagttgctgcatctgagataacaaaaccgcagtcaattattacaatgtatttctatatcactttagaagaagtccagtcaatctatagatattgcaacaaaatcaatttcctaattttatgattaaaaaggcaaactaataatttagtgcaggatagcagcagttgcaagttgtggcttccatgccttcaaatctcaatggaccagctggtgtatatcaaatcaaccaatccaacgggacatcacatgactttcacaagaaaaaccagaaaaaccagggcctgagcaccttgtttctctattcaattttttatccaaaagggaaaaatgaaacacacacacaaatccagtttcctgcacattattatcatatatgtttgagaggtatttttgtttaactacataaaagcccacacactttgcggtgagattttgagaagaaaatcaagctaaaatatattaattgtggataaatatttttaatatatttagagctgatatgtgaaaattcttaggaatgaattgaacaaaaaacaataacaacatgttctcttaaaaaataacgacatggttattctagtggttatgtatcttcttatccaacgactgctatctttgctctaatattgcaatgtaatggttagaaagtgttgctttatatgagttaatgtttcttagtggatactaattatatagaaagaaagtttcaacaacaaagatgttttttttaaaggaacaacaaatatatcattaccacggatgatcattttaggtaaaccttttgcatttttagcatttctaaaaccacaactgagtgactaaatcgacgaagaaaactttaaagtaactctgaaatcaaaattggcttatacttataactaaggcaaagacaagcaatgcttaactatttgatcaaatagttaagcattgcttgaaaggtacaagaaaaaaactaatatatttttgcaccatcgtgtagcatcattacccttcttgattatacattaatgcttaattaatgttttcggaatactccctccgtactcgtaaagtaagtcattttggacagcgacacggtctccaaaacataactttgacttcttatttctataaaaatatttattgaaaaagtgatatatgtatacttttatgaaaatatttttcgagacaaatctattcatataatttttacattttcaaactcaacaactcgagagttattcatgatttatattctcaagatttgacttaaacattgtcctaagcgacttcctttacgagtacggagggaatatatatnnnnnnnnnnnnnnnnnnnnnnnnnnnnnnnnnnnnnagagttatacacaagggggcg

SEQ ID NO: 29983 - DNA, 2228 bp, Oryza sativa
  unsure (1)..(2228): unsure at all n locations
acgcccccanttaagtacacnnnnnnnnnnnnnnnnnnnnnnnnnnnnnnnnnnnnnnnnnacggagggagtagtaagtaaactacccatctttacctatctacttaaacttttataatgaactagtctattagtgttgtactccttctgctcaaaatataagggattttaggtggatgggatatatcctagtactacgaatctagacatgatcctctccagattcatagtactaggatacatcacatccaactaaaatcacttatatttagggatggagggagtagctacgtatttcctctccaacttcacgaggctagagatgccaccggccggcgacgacaagtcgccggcggccaacggcgccggcgacggctattcaaaggtactgcagggccggtacgagctcggccgcgtgctcggccggggcgcctcctccaaggtgtactgcgcgcgcgacgcccgcacgggcgcccatgtcgccgtacgtcaaggccatccgaaagcagccgcagccgcactaccacccatgtcgctcgcccgaggcggccgccgcggcgcggaggtgcgtggagcgggaggtcgccgcgctccgccacgtgcgcgggcacccgcacgtggtggggctcctcgacgtcctcaccacccgctccaccgtctatacctcgtcctcgagctcgcccgcggcggcagcgtcctgtccgcgctcgacggccgcggcggcggccactacgacgagcccgcggcgcgccgcctcttcgtgcagctggcctccgcggtggcgcacgcgcactctctcgacgtgttccaccgcgacgtcaagtcagagaacctcctcctcgacgagcgtggcgacctccggttcacggacttcgggcttagcacgttcactgacgccgaccagcaactcggcgccacagacggcctcgccgccacgcactgcggctcgtcggcctacgtcgcgccggagatcctcctgaagcggcggtacgacgccggcaaggcggacgtgtggtcctgcggcgtcgtgctcttcgtgctcaccgccggctacctgccgttcaacgacggcaacctcatggccatgtaccggaagatctgcgccgccaagttccggtgcccgaaatggtgctcgccggagctccgctctcttatcgggcggatgcttgaccggaacccgatacccgtatcaagattggtgaaatcttcgatcacccttggttccaacaagatgggagcttgtcatcattcggtatgatccaagctgcatcctctcattctaaactagaggtggagaaatgggaggctgggaggctgaattggagcaagcaatggagctaaatgctttcgacataatcgggttcgcctcgggatgcgatctaagcgggttgatcggtccattgccagatcgagttcgattcgtcgtgccgggtgcggattccaggtcagttctggacagagttgagaagctagggcgagaggaagggcttgtagtgaggaggaaagaggaagaatggcgtggaggagttcatgtggaggcaccaagtgggaaattcactgcatatgtaagggttagtctattgcccaaaaagatgctgatgatagaggctgaaaggtatatcggaaacgagattcctaaattttggcatcaacttcagatcggtaatttattcgtcagaaaatgagtatatgatgaacatgtttttatgcaagagatcgtaaatatatagaaaaaaatagtttagagtaatactccctccagattaaaaatacttggcgttctggatataacaacacgatctccaaaaactaatttttaccactattttctattacaatagagatcattacaatattatagaagtactaataaatatatgattttattaaaatacattttaagatctaaggaaaatactttagaagttattcaaagttaaagtttttaaagtttaacattagttttgtttaaaatgataattattttttacctgagagggagtaattgatattagtggacgttttcacatttgtatatcttgtaaataaatactgagacatgaatacacaaacgatcgatctcattttcgtcacgagtaatggaccataagtatcacttgccttgttacctcaagtagctgccacagatcttcaatagaatctcctgccactaataatggggatcctctagagtcggctgcggcatagcaggatgtcatttcaggcgg

SEQ ID NO: 29984 - DNA, 4280 bp, Oryza sativa
  unsure (1)..(4280): unsure at all n locations
cgccctttgaangtcaagtacnnnnnnnnnnnnnnnnnnnnnnnnnnnnnnnnnnnncgtcttcaccgagccctactcaaagcgcctcatgctccgcctccgcctccgcggcgaggtcctccatggcagcagcggtgtcacgctggagcagggccatgccgtggagttcgccgtccacgaccgcctctacaatgcgtgcgctcaccggtgaaggagggattggtgatgacggcttcagatcgacaccggggaagaggaagccgatctccatgcctcttgcgtctccggttgggattcttggggggtcttggaggggagatcaaggcggtgctgatggcgcggtggctcgtcctaatttggtccacggcggctagaacaccgaggtcgacatggcggtgaccctgggagcacgctcctgggcatccatgtgcacagaggcgttcctgtcgactcactgcatggaaagggatgagattagagggaatgaaaccagtgtcttgaggaggtaatgaaacgtggatgagattgggacgacgacggctcggcggcgattggcgccatccttcttggtagcccgcgatgagatgaacagagaaagagacgaagaagaacagagaaagagagattgacaactgggcccatgggcaaacttgtctttaaccaaaatttctctctgtttcgatcgaaaataattaaataatgggagaagtgtccagcagctaattaccacttttttaagtgtccacgagcaaatacacgatcttcgggtgtctcacagcaaaggccgtaatctttcggaaaaaatatcaaaaaatctgtagcaaattttatctttcacaaaatatcaaaatattatatggaaggtttagaataaaaaaaaatatatcatattggaaacaaatagaagaagatctgtagtacatattccatttatcatcggtggcttcgaaagtccgtttcaaatatgtgccttatgagagaagggatagaaataacatcaccttttaagtattgatgagtaaattgcaccagcggttttttttcttaacatgtaaatagattttacctagattcatgaacttgcaaagcacgtattgaaatccctaaacccggtttattatatcatcccggtccaaagccttatttgaccatgatcttgcctacgtgtcatgccacgtggacaataatatgccaaaatttcccctttccctcattttattatttattttttgggagctcctcttcctaaccaatctcctctccctctttcctttcttcccttttcctcctctctcaccatccaaccgtcggctgttgctgcttcgatgttccagttgcagcctcttctccgttgttgctgtagtcatcgctgcctgctgttgctgcttcgatgctgccaccacctcctctccctcaccgccgttgtcatcgcctgctactgcttctggaaagttaggggtgagggagggtttctctacagccaccgatgcctcctccgccctcccatggccgcaaacaaccttatcgccgtcggatatccacgtcgggtcatcggccactccgcccttggggcagtgtgtccttgctccggccggctggtaatgaggaggagcgcatattcagcgaaaagtcgaaggaggaggcacagatccagtgcacgcaacggtgaggaagagatggagaagaggagaaggtggcgcatacccgggggcacatgtgaagaggaggagaggaggtagcggatgagatgaagagacaaacaagaggaggtgactacaatgaccaggggcacccgtgacaacaacgaagggcggcagacgagacagataagaggaggcggcgacgacgaaccagggacgcatgtgaaaacaacgaagaggcgaaggagcggaggtggtggcgtccactaggagtgcgcacgatgaggaggtggaggaggaggagaagctcttggtcaccgtcaagtggagctcgaggtggagagaagggagacgacggggagctcgtgatcaccatcgtcggctttagcttgagcatctgctctgccgtcgggccaaccccgctaccggtgcctctttctctgatggccaacaccgctctcttgctacctccctatctctgctacttgcatgacgctgccactggcgcatccaacggtgggggatgaagagaaaagaagggggaaaagggggaatgggaaatttttccatgtcatcatcctcatatgcaataccacggtcaaacaaggcttaatagagtaaaaattgtttttttcccttttatgatctacatatatataaggaaatctattgcaacataagcaacaaataaattacatcctagcgtctgccttatgtaacatcgaaagtttcgatgatgacaaaaatcttgatcgattgatgacaagggagtgttcgatcttccatcaagtgaagataattatcgatttttgcggaaacttgacatacaagatccagcttccaatcaacatgatttcaaaccctccaatcataattctatatctcctttggttatcaatagtttaaaacctgattgacttcgccgagaaggataatctctatatgcgaatcgaaaaacacaagcaagaacaaagtcgattgtaactcaattgtagatgaatgattaagaacttgaagttagaattctacaaactgactagcgttgaaactgcatgacgatagaaaaaccactctaaactttgatggctattgaataagtatgattagggatgtcctagggtgtccagtccttggacttatcccatgacataattacaaggtctaaggcccaaatcaaactcaaattggatgatgcacgtggcttgttttgcagatttttgacatccaaggaagaattttaacatgggaccaaaactatttgaaagtagactccataaacattttaacaagtacttatggaccctaagagtccgtctagttcagcggcatgtccgtttaaaattgatgctgttaggagggccgaatccaaataaaaaagtgtagaactttatctctggtattctatagatgagaaatgacgtggtatcatggaagtagatttggggaaggatattggttagtccctgatcaactttatgatcatccaagcactctgtatacccgccccctttacttcacccatgcaattatttctgcaaacgagaagatacatgactcatgttacaataatgtttattgaaatatataacaataaatcttacataacaatcatacatgcacttttggttaatgtttactcccaatttcttaatttctagtttggctccctccaccgttatggtaaaaaatcgttatgttttaactatttatctgctagagcatatgtaatatttatgtaaactctgttctttattaccaatcaaaatagacaccttacctactttcatcgaaagaaataaaaaaacaacactaataaataatgaacatgattctagatgtagtaggtattattctagaatactcctcgtcggaaacatatgaaacgcatttccctcaaaacgcaaaaaccatgccccgagccccgacaccaactccgtcggctggaaagccgacggcccagatgaaagccagcggtgccaatgcgtaggccacgcatgcctccgcgcaaatcttatctcccgggaggttccgctccacttccctccccgagtcgctcgaaccatccaatcccccccccttcctttcctttgcccccattcccatcgctgctgccacggcatggccgttcccgccttgtgcacctcaggcacgcgccccgccgacgaggtgcccttttttctctcgctctcatctcccccattcctcccctcttcccgtgtcctgtcgtccacagctccccgaccaaatccctagccctcccattccccacccagcaggcctccctcgcccggtcacgccgcaagaccgggcccgacagcgctgccgcttcttgcccttctgccgcggttttcaagaggttgttgtcctgattcgctgcagcccggtaggtattgtccctttttctcgttggtaagtttgccagcaaaagaaaacgtgtttaatcctgaatgttatataattgagcatctcatggtgtctatgtatcagcatatgggtcccgngctcgggttcggcccaagggatcctgcactcacctcttgggggggggggnancngagattttccggaactccccagaaaccccanaatacccaaattttccctagttcccacaaattcccaatataccataatgtttcc

SEQ ID NO: 29985 - DNA, 2411 bp, Oryza sativa
  unsure (1)..(2411): unsure at all n locations
ttgtcnannntttgaantcgctcggacccancgggaggatgcatatacacgattacaaataccaactccacctcgaagataatatagcatagtatagggnttgccttcttcgtatgttatggccgaattctgatgcataacaaattttccactatatgtaagctcaaaaatgcaaaaataattaccctcgaacctaaaaaaagtgtatacatgcaagggatcatcaatcctacatataaatacatgcaaataatacacgccctgcttggcagccattgttgcggctgtacctaagctactagctgtggccgcggtgtgcatccacagccacagcaatggctgctcagcaggcccatggtctgtaaaatatttcctggcggcgtgcgggcgacaaatccggcggcggagatgctcctgggcagcgtatccatccacatgcttgcggctcgaggcgcgggaggcggtggatcaggtagtgggtggcgcggcggtggctccgggcacgggctgcagatccagctgccgccggcggctcgacgcatggccagcatttttggcagcagctcccggcggtgttggcaatttcatctgcatattttgcagtttgcttgttgaaaatgtgatgaatctgtatgtggatttgagtatggatctgatgccgatttaaattgattttgaatttggattgaaaaaaaatgcagctgctctggatcttatctatttagggtcatgacattaaaaagaaaaaatagagtcatgccatgaaattattaaaaaagaaaaaggtttgtatttaggtccgccataaaaaaatactctttttttagacggatctcttaaatatccgccacaaaaaatcggcgttttcactggcggctactaaaaagatccgtcagcgaagaacagagctactataaaaaattttggcggcatttaaaaccacgcgctccacactaactcccacatccccgcacatgctcacaaacacatgtttagagggacccactaaatttgtattaaagcactttcgcatgtgtgtaatatttatgaaaacaaaagattcatggtggtaaaagattcatggtgggtaaagtttgtatcaacgactctacaaccatacaaccacacctttagtgtgtcctagtcccttgatcggtggttaaaaataggaaccacccaaaaaaagtggcaaccgacccactcctacttctctgcgtattggaatttacaaaaaaaaaaaaggccggtgcacgcacccgaagagtcgcgcgacaataacggcattgctacgtgattgactccatcgccatgttttttgcgcggcatcacgacgcatgattcactcgagtcgactcactccacttccaccgtccgcgcgactcacatcacaggtgcgacgccgatgcccgatagccgactccgcaacaaggactcgaggaccacgaccgcaagttccgcacaccatcgccgagcgtcgccgccattcggccgccccgccacgagcgccaattgctgctgccgccgcccgcgtggccgcgtcccagtgacagcagccggctagtagctctccgccactctccactgcccacgcggctgcatgctccccattccgactttcggtattctgtgaggtgagaccgcgacgaccaacaacactacttcgtttttcaattttaggtcttctacctttttcagatttatgtttaaaattttaactctggttgcattgtgatattaaattgtagtattatatagtagattgttgattgcatctctttttggaaaacatgtagcaaagaagaatgcttctaaattgctttcttccccggttatggtagacgagcacactcaagaacaagatggggatgaagaagatataatgagcactttcatggccattagaagacgtacatccgataagaattaaaagtaatatggtgatcttattcaaacttttatagctatattactaattttatatgttttaagatgctttattaaaatatcatggtacacttatggtccattcttcattatgagaaaaaccgttgtatatacctgaattttaagctaatccactctatgcccttgaattttggttgcttccttgtatatccccaaaatttgaatttgatcccttccatacccctgcggtcagttgaccgtctaattactataaagatgactattttaccctttggataaacatggaaatttattaattaaattactaaaaatatgaaagtttgtcgcatgaaactattatagttatggggttgttgtgtgatgtattatttatcacaaaatttatttttagataataaaaataaaaatatgtatttattttttaaaaaagtcataaaaaagaggagcattctaaaagataggactacttatgctcactataaaan

SEQ ID NO: 29986 - DNA, 9756 bp, Oryza sativa
  unsure (1)..(9756): unsure at all n locations
acggcntnattgatgtctcnccnnnnnnnnnnnnnnnnnnnnnnnnnnnnnnnnnnnnnnnnnnnnnnnnnnnnnnnnnnnnnnnnnnnaagaaatttgctagaattgtttagccctctagacctttataataattaattatctaaataatataaattgctaaggttatttgacattgcaatggtatgtaatgcaaggtttatttttatgtaattctgttaatgcagatgcttttatttttaaatctagtttgataattttatatatttcaaactttgtgaatttatttcacgcctaatctagaaaaagatcaacgtacttgaaccctttacatgtgtgtaagaaaggattattgtgtttaaatgcgcgcgcgggcagggccggggggcggggtgttaagagtggttacatttttttatcgagcacggctacacgtattaaaatttccttactaaattttactaataatcatctcaaccgtttgatttatatagataaaaatcataaaaaaaattagatacacttatagcatgacacatcattgttagtaagaatttagtaaaaaaaaaagttagtatgtatagcttttccaattttgtcaaggggcgaaaaaatagttttctaatgaaataaaatagtgattgttttaactaataatgtcttatagggaagaacgcttgctagcttcatattggtcgttaatggatgtgttaatcattgtggaggtcacgcaattagttatattactccctccatctatttttgatagtcatattttcaaatctgaaaaatttatttatgataggtatatttcaatccaacaacttatcgtcttagtgtcttttttggatttaatgcgtgactctccattcttccacacaagattggctacatggacatcgagaaatgtaaatattaatgaatcgcttgtttacgaggaatgactagtatcatgtttaaatagatgataagtagaaacacttatcgttggtctgtgtgctaagataaaatatgactattggatggactacaactttaatttcgagtttcgatcgggggtgactctttcgtagctgtcgtttggtctttaataagtaggtgattggaaagaataatctagttttaacacttcgatccatgttgttaattaattcatgctcctgtttatgaggccactaatgcttccgattcggatgtttttgttctataagaaataacacgtttagagctgttgcctttggtttatggaaaaactcgatctcatgatacggaaataaaattccctgtactagctagacagcctgctgctgtcatgcaagaaggctaaaaacgaatggaagtgaagatgatcttatcacaactcgcaagtgaagataatgatggtggcagcgtatctaccacccacaaactcagttgtatttttttacaacaactgtatgtacttcttttttttttaaattacacagcacaacacagatactcacagcacacgcacactcattcttactaacacacgcacgcaaaaccctacccctatgagcatcttcgaagactgaactagtaaatcctggagattgaagaaatcaccacagacgcctcgttgtcgacgggtacgtcgcttaccactgaaagcacaatgccgctaaatcttggaaaattcgctccctcgtggagtcgaacccaggacctaagatgttactgaggctcttgtaaccactaggatcctttataaaaggaaaaagtacgaattacctcccgtactgtagtggtcgaccgaattacccccctaatcataaaaccggacattcttcacacccaactatgcataccgaacgaattaaccccctcgacccaatccgcggtggttttggtctacgtggtgtacgcgtgataatccagtcagcattctatttattaaaaaatatgaaacccacctgtcatactcctcttccactcttcctctctcttctctctctcgctcttcctctctctcttctctctctcactctctgtctgactgtctcactcttcctctctctctcacgggccggtggcgctaggggacacagcggcggcggcggcggttttgaaatgttcacgctctgggttttggtttgggtttatggcatcgggtgtttttttttttaacttcgatttgatccccaatcatttcagattcatttttgtttccctttttgttaagtttgcttcgattctgaatccacttcttgtttccaactgaagattatgtttctgttccaaaatttgctcgattcgagtgcgtctacgaatttggattttacaatttgacagctgtgattatatcgtgcaggtagccgagactacggcgatggtcgatgaggaggagcccctcctgggaccagatcagtctcgcgctcgccgacctgcgcggcggccgcggcctcagcccccgctccaagcacctcgtcgccgcgctcgtcgaggccgccgccgctaagctccaccccaatgccaccacccttcgcctgtgccgcgccgccttctaggggaaggtagtctggatcctcgccgcgacggtcgccaccatgttcgccatcgacgtcgcgctcgccgtcgccctcgtctccgtcggggcagaaggtggcggtggaataggggcggcggcgaattgaataactaattacgtatcaccccggattgtttgggaaaggtaattcgtatttttttctttataaaacaatatttctacgtattgttaatatcttatcctctctctaagaatttaagtttaccatgcaaaaacatccaaaaaaatcagggatgatatatgttgttccaaaaactttacaaccaacttgctctaaacaatgtgcatatgtataattcatttttatccatagcaaaacacgtgtatttaagtatgtcgtgaactttatgataagccacctttcgagaatgacgtgacaaagggagcaacagtacaagactcccttctagaagaaagaaacgttgttggggccagaagcagggaacaggacaagaagccccacaatcatgcactagtagttgtatggggaagaacaaataatcgctcccagttgtttgcaacatacatatcgaatttgtcttgacgtatattcatccggcgattaaagtaccacctcacgtgaaattcatgtggttctagatcgatgcaaattaacttaatatcctctctctttgttttgttatggagaacggcattattgttaattgtagattaatgtgtgccattctatgagctatatgagctacagtgatcaggagtaggtacaattgtatattataagctagctataaacacatttcgagaagacaaaaaataaagagaaaagcagcggactatagacttatagacagctgcagtatggattccaagatacctgtgtgtatatgataggtggaatcaggtattaattttataatatatatttatagataactattgtataaattagctattaaattaactatagataatttagagtgctatattattaaactacttgctcttagtaaacttaactgttaggccgagtttagttccaaaatttttcttaaaactttcaacttttctatcacaccaaaacttttctacacatgaattttcaacttttttccgtcacattattctagttttaactaaactttcaattttaacgtaaactaaacaaacgctagtattttataatggtgcattcctttcacacgaagtacttggagtgttacagtgttgtcgcatcacgctgactcagcacagtactactatgcatgtggctttgggatccccacattgggcaatcgagcatatgccacgctagaacgtggtccaagtgaccatttctgggtgcggtagcaagtacgagtatacgactactcttttcgatcaacgacaaattaagttaattaatatattgtgatatagagttcctgtacatattactctatatccaacaaacaagcagtaatgaacaggcgaattaacgtgatgatcgctatatgctgcatgcacgtctgtatcatctagtactagtaacctaaacaccacataattatgtggtcaagtggacaatgatcgatatacgcatctctctcacgacggaagaatctgtaggtgagcgttagacgtgcacgcttgcgcttgcacacacatttctcgtttcccacctatcgatcaccccgaatgaccttcagaattatatatttcggcgccgcgccgtgcactccacgtgccctcgctctttgacaatttgtataatccactgatctcttcagtcttcccagttctcactgtctgatacttgaagtcttcccagttctcactgtctgatacttgaagggtgtgtttgaggagaaggggattgaggagattggaagatacacaaaaagatgtgagccattaactcatgattaattgagtattaactattttaaattttaaaaatggattaatatgattttttaaagcaactttcatatagaaaatttttacaaaaaacacaccgtttagtagtttgagaagcgtgcgcgcggaaaacgatgtgcattcttactccctatcacccaaacaaacacagccgaagcacagaagcagtaggtttggcccgggtaccggtaaaaacagtaagaaaattttccaaccatattatccacttctacaaaattaatactccctccgtttcaaacgttttgactttttcatggtcaaattgaagtttgactagggctgtgttcgcggctagggagtttggaactaaactctccgcacagaaaacggagcggtccattaacacgtgattaattaagtattagcttttttttttcaaaaatcaatcaatatgagtctttaagcaactttcgtatagaaaccttttggaaaaaaaacaccgtttagcagtttgaaaaacgtgcgtgcggaaaaagagaatggtgagttgggaaagggggattccgaacacaccctaagtttacagaaaaatatagcaatatttttaacatgaaacgaaagatctattaaaatatattaaattttagttttaataaaaactagtttggtgtaatagatgttgctaattttttctataggtttgatcaaacttaaagtattttgactagaaaaaagttaaagcgacttataatatgaaaccgagggagtataataataatatctttatcagcaggtacagtttccaaatattagtttttctactatctattagcatcacattgaagtttacattaaatagttaaattcataaatataaaagatttcaactatttttgtaaaaataaaaagaagagactattatcgatcgatcgttttcatctctaggtttgggtcgccctaaaagtttttttttataatactctagttttagttgaaatatctttttaataaaagttatcaatcaaagtttgtaccttaatgccaaaaacaacgtgttctttgcggggttcacaaaaccaatggaattctgtaaaaaccgattggttttcgtgaaactactatgtctccgtttgtgaaaaccggtcggtattaaccgattttcgtatagtattgactgaaagttatcggcttttatcggttttcggtcggatttcaggaaacccatgaggagctgtttctactctgaaatcaaaaagttaccctggttcttctttgtaatcggagcgagggagtaatttagcagacatacatatattggcatatcatatcgcacagcatctgctgtctaattattcgcatagtatattcagttgtacctcccaagcacattagaagtaaaataacgacaagatgcgcatttgtttcgttaacagtacgtttcaatctagctacggagttcactattcacagagacgaagaaatatagagttatgatgcagatgcaatacacgagtcatgagtgacgttcatatattcctttccttgcctatttttttcctctattttgttcgtaccgaattagcagtactccatgacgttcattagcagctgcacagccacgtgattccgtgactactccgctaattaattaaggctctgaaattaaagtaaagaagctgcatcaagtagctgtcttaccttccagcatatttggaaccacacaaaccggttcatccggccgaccgatcacttcgcctagttttgtgatcattcgtgcttcgggcattcatgctttcaatcatccaaagttcaaattaacatgacgacatgacatctacggacagagcaaacttattcatgaaattcaatcagacccgtcattattactccaggtctgttcatagggctttagcttctaaatcttactcgcgtgctttgtttcacctctttgtttcattcttttgatcactctaacccgctaattcattctctttttgataaagctgcaaatttttgattgagagctggatctggagcccatctcaacatgtgcatcctatgatctttggaggaggccaacatcgacgcaatcaaattcatggctgcaacattcgtacggccgaccaaaaccacgcaatcgatcgcgtcaccaacccccccaaaagatctccaacaattgtcacccaaaggaaaaaaaaaagaaggaaaagacccctcctgtcctaatccaacgcaaaaacaaatgagggaattcccaaattccaatcacacgaaagcgtgaagcatcattggattagacgaggtaatcaaattaagcggcaaaaaccgtttaataaatagtagtactaaatattcataaaatatatagagaaaatcccttgtatacccctaaaattttagctaatcccttctacgcctctgaattttgcttacttcattatatagtctaaaatttgattttgatccattctatgctcctcccgtcagatgaccgtctaatttctacaaaaatgaccattttatcctttgaatgaatataaaaatttatgaattacattattgaaaatgtaaaagtttatcacatgagactattattattattgtttgttgtgcgatatattatactccccccgtcccaaaatataaggaattttggctggatatgacgtattacagtacaacgaatctagacagctttatgtctatattcattgtactatgatacgtcatatccaagcaaaatcccatatatttagggacggagggagtatatgataaaatttatttttagataataaaataaaacatatgtatttgttttatttgttcaaaagtcataaaaatgaggagcatccatacaaagctaggactataaatgctcacgatattttttatgaatgctcccaatcaaaagaaatctattgtcctattagatttctctactattataaaaattaaagatatttttgccagtattttggtacgtcatccgtgtttgagttggttttaagttcgttctcttttggaaatacatattggtgtttgtgtcgaattttaagttcgtttgcttttgaaaatacgaaagaagtcgtataagaaatctttttagaaaaacttgcatactagtttgagatgaaaatcggactcctaactgcagctcatgattatcttaaaaatatccaagcaaattcctacagtgaatttcaccatagctaaattgtataataataataagattaaaatattattcactcgttacaacgcacggacatcttttctagtaaaataaaaattttaatttattacatttgttttatttttaaaatttatgtcaaaattttccgcactaattatttagtctcattagttacataaaatgcatatactatacactcaaacaaaaatttcattatttttcaaacttatttccaaacctaaatcatcaagggcattaaagacatgagccaccaaacttaacagtgaaatgatagaaaaatgtaacggcagggacatgaaaaggatcaagctgaaattttagaggtatataaatatgctcatatttccttatttgatctctctgtaaatagaagagttccctttcatacttcctatctatccatctaccgaaatacaaccacgttctcttattaatgagggatactttcgtcttttctctcaatgcaaatgtgaatcctgataattaagaataaaatttattttagaacaaaaatagtaataatccattacacctcccgaaatttcgcttgctcggctggatcctctgactcttccagtctccacgcccacagccgcaacaactggttaaaaagatccccgcgacgcgcacgcgacgcgacgaccacccagccacgcgcgacgcgccggaacagccgcgcccgccatggcgaaccccatcatcccgagcagcagcggcagcgacggggaggaggcgaggacgaagctcgggcggctgaacgcggcggtggaagcgttcgtgggtcgggcggcggttcaagctggcggcgcgcgggtcgacgttcaccacggagctccgcgccgggacgaccacgttcctcaccatggcctacatcctcgccgtcaacgcctccatcctctccgactccggcgccacctgcaccgccgacgactgcgacgcgccgtccccggcgtgcaggttcccgcccgtggaccccgggtacgccgcctgcgtggcccgcgcgcgccgcgacctgatcgtcgccacggcggcgtcgtcggttatcggctccttcatcatgggcaccttcgccaacctgcccatcgcgctcgcccccgggatgggcaccaatgcctacttcgcctacacggtcgtcgggttccatggctccggcacgctcccctaccgcaccgcgctcgccgccgtcttcctcgagggactcatcttcctcttcatctccctcgtcgggctgcgctccaagctcgccaagttcatccccaagcccgtccggatatcgtcgtcggcggggatcgggctcttcttggcgttcatcgggctgcagagcaacgaaggcgtgggcctcgtcgggttcagctcgtcgacgctcgtcacgctcggcgcgtgcccggcgtcgcagcgcgcgttcgtggcgccggtcgtgacgttccccaatggcacggtggcgctcattgcccggcggaacccgttttcggcgggatactcttgcttgttccggccggatgaccttcccgaccttttggcttgccgtcgtcggctttcttaataatcggctcttgcctcattaagaacgtcaaggccgcatgaactacgggattctctttgtgaacttcattttctggccggcaacaccggccgtacggggttcccggcaaccccgcggcgaccagaggtttggtatttcaagaaggtgttggagtggaccgatccaatccaccgccgggcgctttaatttcgggagccggtcacgctttctttggaagcggtctttacgttctgtccgggacattcttacaccaccgggggttttcttctatggaggttccccgtttttgacaaccacggggaatttagggaaaattctcctttatttcacccacgacacattttgtgtttctgtgtgaacttcccggacgggttaatttgttttacggggaaaggggggggggagaggttgtggcgctccccggggctatatttgggggtggtttaacaccctctgtggataacaccgggagagggcccctctttgtttttgtatataatatccgcggggaggatattaaaaaaaaagagnggnggtttacacggggtgtggccctctctcgtgcgtgtgggggttctctctctgacg

SEQ ID NO: 29987 - DNA, 2406 bp, Oryza sativa
  unsure (1)..(2406): unsure at all n locations
cgtggccnntttgttgacacnnnnnnnnnnnnnnnnnnnnnnnnnnnnnnnnnnnnnnnnnnnntgttcaagtaaagttattaatcaagtttcagtccctgagtgcctgtccattttcggaggtaatataacaaaacaatcatcatttgaaaaaaaaaaatcgaccttttacaatagatgtcgagaacttgtaaaagatttgcacattattccatcgaaataacatggtgcgaaggtctaaatatacaacgaaccaaaattttctgacaagctgatctaaattcatttgtctgtccacttttaggtgaaataacttgctcgagtgtccatctgtttgtcattttttttgaaagaactaaaaagagaatggaactaacccttgtgagcgcctgagcgggctcctcatttattgatttttttaatcataaaacaaggtttagaaaaaataaactataatacccttattaaatgaaatatagctagggttggaagggtggttagggtaaaatgaaaaaaatgaatactaagacatgattagtactgtagatgttaattattttgagataaaatttgaatactaatgagacaattattttagaacggatatagtatttttaaggagaaaaaaatatgaaatgttatgagaaaagaaagggcaaacgatgccggcgaaagtcaagaattgcgtatcaagtaaacgggtatgaccttacatgatggtatctttaattaaatattgctaactgatgccaacttatgtgaattggcgtgatgggagcttttaagtggcactatcaatcagtcataacattttgacttgttgacatgaacatatatactgtagaaagctacgaatttgtattaatttcctgtggacatgaacatctcgtggagtcgaagctaattgtcagatgggcttcttggaaatttcatcccatgcatggatggagatttgcaatagaatactctcaaactaattactcgtgctaaaatcgaaagagcacttgtgccaagggctttgcataattgcattttgggaatttcaattaattaaggatatatccagtgacaagctaaatattaaaaactcgtgaaagtcatacctaaaagtttcgtaaattcataaaaaaaatactagtgataggtgtagatatgaaatgcattttcaccaaatctcaaattcaaacttaatttcatttatgagtaacaaagaagaaaaaaaaggtgaatggtaacaagacactgttcatctgaaatttgtctttctttttctcttaaatgaagttgagtttagagttaaagattttgtgagaatgtattttatatctacacctatctctaatatttttttcatgattttaagaaacttttaggtatgattttcacgagtttctatcacttaactcgttttcaccggatatgtccccatttcaatttagctgtgatatattttctccatttctggtaagccatttattttgtccatttttccttcaatagtttatttctgccacagggtttatctcactgaccttgaattcaaacagtgaagggggaaattaacgactccctccctttcatactataaggcactttaactttttttaattaattttttaagtgtgattaagtttattgaaaagtataacaatattttcgacatcaaacaaacatattatcaaaatatatcaaatgttatatttgtataactaatttgatgttataaaagttgctatatttttctataaatttgattaaatttataaaaaaattgacttaaaaaatcaaaacatcttataatataaatgaaaagaatagttgtcactccatacatatgactttaacaaaaaaaatctcaataagaggacgacttcaacaattcgccactttacagatgttagttaatattttttcatctaatatttcagtgctgttaataaaacatcaatgtagccatttttcacactaccatctaataggaggggaaaattgatatgaattaattaaaataggacccatgattagggggtaaagtgtgaaaacaaaggctaagatgatgtttttatttagagcagtcaaccattagatgagaaataattaattgagatctcttccatccccttctcctgtcgtgcacgtgcatacttagaaagtaaccatcggattcaatgtattaggccccgtttggtaggactctaaactctagctcccagctactaactccaactccaactgaagtgggtacgaaagtgtttggctagagtagttagctccactccaccacgtctcttgtaggcatttcgtcgaacacctggttggcgtcgcactgccgccgccatcgccatcgnnnnnnnnnnnnnnnnnnnnnnnnnnnnnnnnnnnnnnnnnnnnnntcaccngttcctg

SEQ ID NO: 29988 - DNA, 2287 bp, Oryza sativa
atttttttttgtttttataaaaagtttataaaactctcttaatagagaagtggtgcgtccactgattttgaaaaaattacgggggccccccaccttcccctcgaggagaaatatttcttcaaaagagggaggggaagaacacggagattttttccccccctttaggagggattttttttttttttaagggccctttttgggtgtagtggaaaaaaggccaaattttttttttaaagcgcgccccttggaggagaaatgttatgggattttcccccaccccttcccgtggggcggggggtttttgaagagacccccggtttcttttttttggcgccgttgtggaggttctaaaattgggtccccggttttacttccaatcccaattaagggggtacaaaggttttggcaaagaatttacccccccccccagtgtcttttgaaggctttttgttaaacacttgggttggtgttgcatttcccccgcattgccatggtttagccggggtgtcacgttggtgcaagcccagggcccccgttgttggcccttgggccccggccggaagcttccaatgaacggctaccgccgttgaagggccgccagcgaccggccacagcctgtgggcctcccggggaaggcgcgcttgcagctgccgatcggtccgcggctctcacgcatcgtgccaggccaccagtgctcaccacaccgtgccaccattgcccacccccgccagtcgccgccgacgccgacgccgacgccaccgcccgtcgctgctgtagggaggaagatggggaggagagagaattggaggagatgaggtgtgaaggggtactttagaggcatttttgtgtaaatacattaaaaaattaaagggtagagggtcttttggggtggagtagagctgtggagcagcaaaagcccacctccacccccgtagtacaaatttgtggagtagctctgccaactccactccaaaaaatagaaaatttataccgtttggcacagttccagctctagataagttggcgttaggagctagagctgtgctaggccttattcttaatcaacattctaatctatccttaccatatgagcatgacccgttataatgtaggggtatattacttatctattaaatggtaaattattaaagtcatctatactcgagcaagaggaagctcgtgtgctggtagcacagtgcacgttatgtgcacagcgccatagacctagcttgaagaatttcccaaaaagaaaaaaaaattcaagtgattgagtgctctaaataagcatacaacggaagaaacaagggaatttaaagaaaacaatgtgtaattcaagtgtagaaggatgatatgtcccgtacaatgggaatttcattggtatgtgggaaatttcatttacagcattgtatgcttatttctcaagcatagaatgaggatagaggctatcgtatgctagtaatggttgggtccatacatggctttttttttactcgtgtggctcataaacgagtgataaggttatttgggcgtcgtcgttaagatctaaggctgagttcttatctatacttttccaactcacctccctcatttcccgcgcgcacgtttttctaactactaaatggtgtgtgtttttttaaaaaatctaaatgaaagttactttaaaaaatcatattaatctatttttaaatttattttagttaatacttaattaatcatgtattaaacattacttttgttttgtgtgctaccaaccctcactcccaaatacaccctaaagatagtggtcatcatgggctgggcacttgccgcagccatctgagcaaaagtcagtccacgcactcgcaaaactaccgcaaaatactagtacctctactgatcatgagcccaatgtacaaaacatctcggcctcctccactaaacaaaactccattgatcattatttccttacctcattgccactataagcacaacacttgagggaggagagcgacgctgatgccgcctcatataatctccatcctagaatgtaagaaaattatagcaaactgatggttgagattaaaatagtgcggccgtgtctttacccttacaacgggaaggaatacgtgggaagaaactgatggtttcacatgtggtttaggttaaaacttgctagctgccaacgcttcttctcctcctgatcttattattttctttttgttgccttaatcttgccgcctaagctaatatccattgtggaacgctgggaaaattacagaaactggtggttgaaacttgaaacgtgtgg

SEQ ID NO: 29989 - DNA, 3889 bp, Oryza sativa
  unsure (1)..(3889): unsure at all n locations
tgtaaaannnttagaatccctctcgccacccatcaaatattgcatattccctatgagaattgctatgaaggctactcgccaaagaaataaaaacacccataaagataattaagcaaacatactgataaattgataatatttaggtttggtacaaatcaatcatggtaaattgatgtcttaatcctactgggagttttcctttagataagtatgacaaatcacagactctaaaatttccattctcatgttattgtggaggatattatccatcctattatttgtcttctcaaccatttttgtgcatcgaaattatcatgttatagtgatgtgttctatcaaaaaaattgcacctccaaatacgagcaacacatagaaatatttttatcaatcttgcaaaagtggtttataaaaggtagctctattattgataatgcccttgtctttgtatctaatttattttgaggcccattctacttcacaaattcttatcttaatctttcttcaaatattaaacctccatcaaaagcatacagtaaaattagcttaggctcttccaatgtcttctccgaatcaagcctggaactttcgacaagtgtagagtggagatgacaaatattgcttgaatgaagcattttccctacctctataagcatacaatgaaattcacattgtacacatgggtaataagcatataatgggaatattgcttgaacatgagaaataaggcaataagcaatgtacagacattttctctttctcaataggcatacattgggaatttcaagtgtagggtggagacgccaaatattgcttatcccctatgaaaatttctatgaagactactagtcaaagaaataaaaacgccaataaatataattatgaaaacatactgataaattgataataagttaggtttggcacgaagcaatcctagtaaattgatggctaaagcctactgggaatttttcttaagaaaagtatgggatatcacagcccataaaattttctattctcatattattgtgcaggatattatccatcctattatttgtctcctcaaccatttttgtgcattgaatttctcatatcatagtgatgcgttctataaaaaaaaagtgcacctccaaataccaacaacacacagacatgcttttgcacaatcttgcaaaagtggtttacaactagtagctctattattgataatgcccttatctttgtatccatattctgaggcccattctacttcaaaaattatgtttttttaaatctttcttcaaatattgacctccatcaaaagcacacagtaagattggtaatgaatatgaataaagaaatcttccgatagtaacactaagtataggtatgttttacgctgttttctcaattgtttttgttcctcgaggaaattaacgtatgcaaagctattttgcataaagtttctcgtgtgtgcacaaaatctcgcataggtcctcgaaccacctgaagctaggtgcgatcttgtaaattaatttaaaagttgtgccaactagtgcgacaacttgtctagctgctatgcctttgatcttaactaagaggtaccacgcgggcaatatttgcacaccaacaatatttacaaaaccaatttaacaacttgtatgcatgtagttgaatcagctaaggaatatgttggttctttttactatattcacttttacagtataaataagtgctaattaacatgtttctgaaaaaaatattgtgcaaatcttatagagctgcaatagttactgatggttggtgtcatacattgtcggttcacattaaagtactcgagtagagttttcattcgattgtgtggcatagaaacgagcgatagaggttatgtgtgtgttgttaggatatggagacagtggtcactgtagactaggcacctaccgccaccagccaagccaaaatcagtccaggcgcgcaactctaccacaacaaactagtaacgcagccggtcgtaagcccaacgtacaaaacatcccggcctcctccactcaaataactccatcaatcgttctttccttgcctcattgctagtgtaaccgcctcattcgatagagggaagcgatgccaacaccgcctcagctaatcttcatcctggaaggccaggaaattacagcaaactaatggttgagattgaaacaacacagtcgtgtctttaccctcacaacatgaaggaatgcgcaagaagaaattgatggtttcgaatgtggtttaagttaaaccctgctagccgccaacgcttcttctcctcctgatcttattattctcttcttgctgccttaatcttgttatgtttggttcctgatcggtgaggatgggtaagtagggttaaaccattattacttttttccttccataactaattggcaggcatgttgtgtttgattcgtttaagttaacaaggttatgcagcggtcgttggtgctaggaagagcaagaagcaacaatgcattacctctccctcctcagcgatcaacttaggctcttccaatgtcttcatcgaatcaagcctagaactttccacaagtgtagggtggacacaacaaattaatatttcttgaatgaagtatttttcctacctcaataagcatacaatgaaattcccattgtacacataagaaatagacatacaatgggaatagtggttgaacatgggaaataagacgataagctaagtacaaacattttccctacctcaataagcgtacaatgggaatttcatgtgtagggtggagacgacaactattgtttatcccctacaaaaatcccaatgaagattactaggcaaagaaataaaaacactagcaaagattattatgcaaacatattgataaagtgataagataggtctagtccaaagcaatttcatgccttaagcccactaggaattttcctttaggtaagtacgacatattacagatcctaaaaaaatttgttctcgggttaatgtgaaggatattgtccatcctattatctgtcttctcaaccattcttgtgcatcgaatttctcaagtcatagtgatatattctattaaaaaaggtgcatctccaaataccagcagcacagagaaatgcttttacacaatgttgtaaatgcggtttataaaaggtagctctattgttgataatgcccacaacttctaatctaatttatcttgatgtccattctactttacaaattgttctttaatctttcttcaaatattgacctctatcaaaagaacattataaaatttgcaatggatttgaattgagaaatcttccgatagtagcactaagtatagctctgttttctgaattgtttttgctcctcgatgaaattaatgcgtggaagactattttgcaaaaagcttcttgtgcgtgcacataatctcacatatgtcctcgaaccacctgaagctaggttcgatctcgtaaattaatttgaaatttgtgcaaactagtgccacgacttgtctagttgctataattttgatcgtaattgagaggtactatgcaggcaatatttgcacaccagcaatgctttcaattgtgtttcgtccactgattggttaaactatgcttgtatgcatgtagttgaatcaactaaggaatatgtaggttctttttattatattcacttttagagtctagataagtgctaactaatatgtttcttgaaaagaatattgttcaaatcttaaagagctgtagtagttagtgatggttgggcccaaacatggctttttcacattaaaattttaattaatttcccattcgaatgttagacannnnnnnnnnnnnnnnnnnnnnnnnnnnnnnnnnnnnnnnnnnnnnnnnnnnnnnnnnnnnnnnnngggcggtacttcaatgagcccgc

SEQ ID NO: 29990 - DNA, 2564 bp, Oryza sativa
  unsure (1)..(2564): unsure at all n locations
caaaagagaataaaaaaaaaaggtgagaaagaaaaaagagggccccttatggaagttattaatggtcattaaaggggtgcgccctgctcctgggagagaaaccttttaaaaaaagagccatatttggaattttccacccacaaagcccccttttttttttttaaaaacagacttcccccaacagcaaacatttttccatggctttgggagcccacaagagtggcgaaaaaaaatgttttcatgagtttttataacacaaagcaaagtatctggaagaaataaagaaaccaatcttaaaaaaaaaaaagataagtaggccatccttaaaaagaaaggaagtaaagttgaccacttaattgctaatcattggtccacagcaaaaatgatagaatttactgagtgcttcaaatttctgaaatcttgggcttttctaaacacaattaaatttctgaaatcctcggcttttctaaacacaattgcaactttcaaagattcacctgcaactctctgtaagtaccactgttgacactgtatgcctaatatcctgtaatcagcaatcacattacaaaaacatgtgaaagtactcaaatattaagtaggtgctatgttcatccagacgacgatgtgaggtagcttatcctttgatgtatttcaattacgaacactgaactgccaacaacaaaaaataactagtattacactgcattataagttcagattccttagaatccaattacattgttgtgcgaatttcattgagctatggattttgggaagacagaagatagaacgaataataagcaaaaggataagcagtgcctttcctaaggcaacgaaacatttcgacattgaaacaattctatggctggccatgatcttcaggttgctgatcctggcgttcaccttgccaagcccaaacaatgtccttaagagctggtttcatgtcctccttccacaaatgttggtattctagtgtatctccattgttcttcttgatttctaccaaatgaaatgaaggagtcacctcgaagatctctgcatcgattgccaatacacctttccttccttcacttgcaccttccattttcagcacaccaccttctttctttttcactgtcaacttcgaacatgaggcaacatcctctagttttgagataatagctgaagctgattgacttgatgtaaaccttgcttctttctttttatcagtctcctcaaacaagccagaaagatcaaagccttccgaaagagaaataatatcgaaagcgttaaggttggttagctttcctgcatcctgtttctcctcagtctttttgctactactgctacccatggaggagaaaacaacattaacatcagcaagagctgtaactggttcatttgtctccacgttcttaaggattagcttgctatcaagtcctttcttgaaccagtaagtttccattatttttgtaattggcattctacttcttgggtttggatcaagaattctcgaaactaattttcgtacatcagacgaaaaccaagctgggcatttgaactctgctttcccaatctttctgtacatctccatcaaatttgaatcttgaaaaggcagataaccagccatcagaacaaacaggatcacaccacaagaccatgtgtcaaccttgacaccgtcatacccttttcggctgatcacctcaggcgccacatatgcgggagttccacaagttgtgtgtagaaggccatcttgtcgtcttgattcagcaagagcgctcaatccaaaatcggtaattttcaggtttccattttcatcaacaagtaggttctctggcttcagatcgcgatgataaacgcctctactgtggcagaaatcaacagcacttactaattgctggaagtatttccttgcagcatcttctttcaacctacctttagctactttgttaaacaactcaccgcccttgacatattctagcacaaagtatatcttcgatttggtagccatgacctcatacagctgtacaatgttggggtgcctcactaatttcatcacagatatctctcgtttaatctgatccattaggccaaccttaaaaattttgtccttgtcgatcaccttgatagccacactttgtgaagtcacgatgttcctaccatgataaaccttggcaaaagttccttgccccaataattttccaatctcataccttcgcagtagaatgtttccattcttctcaagttccatcattcaaaacaatgctagcggacaattctttattggaattntagaggaaaaccgtanaagcaaaaacttcaaccatcatcagaaattgcatgatctagcatagcagtatttctgacattgatagcatcattattacttntgtgatgcagaatgcaccangtgagcaactgaaaatctcgctcattcaagaaaaatttagggtgggaattggtccaaaaaaaatccaaaaattggggggggggaaaaagaaaatnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29991 - DNA, 2506 bp, Oryza sativa
  unsure (1)..(2506): unsure at all n locations
accgcctttaaaaatgtgtgtcaaccgcccaaatttttgcggccacaaacccttagaagggttccacaaaaaccgaaatttccccaattttcctcaatctggagaaatttcttttcaagccatttaaaaagggggntattttttggtttaagaacgcgaaccaaactccccttcacaattgttttaagaacgtgttttactataagaccattttttttgtttgcaaagcccgggttacattaatacctcgttttcaaaatgggtgtgcaaccaatggagaaagccttttttaatggaatattttttgggggaagcaatctttgtgattccatagagggctttccgggaacttgcattttgcattccaggcaataagccatggtactttttggcagaaccaaaggagcgtattacaatggttaaaaagtgaaagaaattatgcagatacacagtaatgggtgaaaaaatggtcgtcttgttaactattgagaacaaaatgcacatcagttgaaagaaagcangttgttgtagcaataaggttagatgtgagtccattaattgattacaagggtcagtttgtgtgtgtagatgtgtctatctgttccctataagcttggtctagcagattaaggctacttttcaagcctttgaagcaaggtacaggtccaatgaaggttgggcttaggggtgtggcaaagcctaatctcaagttgggccaacacatgccctgggccgatgtgtgaatgtgaacaattcacctagctagaagcagcatccactcaggaaaaagaaaagctaggaacagcgatgcactcatgcacatggataggtatgtggccaattaacataattgataattcaaactccagtaagtccaaatcatattttggacaaaagcaagcaaacagcacatgtgcacatgtgcacctaaagacaaaggaaatgcatccatataaacatttggcaaaattttccaaacaaactctgccaaagagaaaatcagaatatatctcatttgttggcttaaaaccttatagtatgtagacaccgcatggccaaaaaatgatgatgtaaatatcttgataaaaataaaaatatagcaatcagtactttagatatatactttaattgactagaaatcaggtataattttattattaaggcccactgcagtaatggattccattactgttgtccttatcagcagattattaaagtttggtaggaaaggtatgtagaacaaagtagatcacctaaacctttaaaggaattttttttacaataaaaagcagagacactgagaaagcacaaggtaaaaccagtgataaatcaacccagtggattatctgaaattttcttcctatggcaataagtgatgtggaattgtggatagtctgagaattcactaaaacagcatgacttattctgtagatttaattacagctttccaatttactgaagtaggtccctaaccagttaaacaaaaatatctagagaaacgttttatggaaaggagttgaactatttggctggatacattaattagcagcaagaatatgtgcaatcaattactagtaaataagaatgctaagcatccttgacagcttgacctgtatcactcaacataagtatggtcaatgaacactcaataaaaatgaattgaagcccatgtggaagtgaacatgcatgatggttttcgaacacgtattagatggaggttacctaggggttcaggtgatataatgtagatattggaccacacagtattttttttattccaagtggaaattttgtttgtccctatgtgattaacatataattgagtgagagatgcactttctgtaaaagtacaccatatttttaccataggcatagttttaggcccatgaaattgtagcgggcccagtggctaaattggttgtgcagagaaaggaaatctagatctgaacagcaaattctatttaacagatcgattcattcagtttcaccagaagacacactgacacacaggtaataccagctgggttaattaagaacgtcaatactagaaatgggttcacaggtgatagtctctctacctctcttaatcctgctacagcctatgaccacacaagaattcctggtctggtggttatgctacttaaaaaagggaaaactctttacgaaagagagctcagttgcataattagcgcaaacaaactatctttatcattggaacaccgacaattcaaaggggaacccgttgatattgagctaagattctaccaccgtgtaaggcttatgaaacctttcagtgttgtnggccccggagacaaatttttcttgggcctttttcccggtttgtaggatcacggccaaagtttatgaatttctattacttttgaagaccgacaacccattaggggtttatcgcgccccctttaattgaacccaaatctctcgggttatggggatttgcttatcccaaaaacccttaattatgtgtgaagacacaacgccttcccct

SEQ ID NO: 29992 - DNA, 4346 bp, Oryza sativa
  unsure (1)..(4346): unsure at all n locations
ccctccaccaggaaaaacgggtgttttaaaaagccaaacaaaaagtgttcacagaaaatgtccaaccttttataaccggacagcccatcgccccaaaattcctgtgggtgttttggcctttaaaaaggaaaatttttaaaaaaaaggtcagttgaatataggccaaaaaacataccttaatttagggaaccccccatatccaaagggaaaccgtgaatatcggtttagcactttaacccccggtgaaggtagaaggaactcctccagaagctgtgggcccggaaaacaattttcttcggtgggcttttcccccggtttgttcaaatcacgggcaaaaatgtataatgaaatttccaacaagtcggtcagagttttgacaacaccatgaagggcttcatccgggcacccaatttcaattgaaccccaaattctccgacgggctaaatggcagactcgtgcttaacccaagaaacagccttaaatcaactgggtaaaaagcacaggagggcacaaaccngacccatttcccagcgcaaaaagaagacggatacttttaaagcaccacggatgattgcagccggctgccaagaaacccgaatccgactcccacgacccaagaatgacccgggggcagcaatgcaggtttgcagggtgggacggggggctgctccgatcgcttcgttcgttccttccttctccactgctgttcttggtgaagggaaggttggggcaggaaagaaaaagtgcggggaggaaggcaggaaagtggggaggagagaagagggatggcggatttatggtgagacggacgcgaggtcatgtatgtggtccggcccttcgctggccaccaaacctttcactgcaacgggtggcctcaattatgccttttggccctttgcactgcattattgcttgcttgcttgtttgatttcgagggttttctctaagggccttttgagttcgtgaacaccaaattttttaacatgtaaaatcgaatatacggatacatatttaaatattaaatatagattaataacaaaaaaattatagatttcgcctaaaaactgcgaggccaatttattaagcctaattaatccgtcattagtaaatatttactgtagcattacattgtcaaatcatggcaatctacacacaatttatgtaattaatattttttatatttaatactctatgcatatgtctaaacattcgatatgacatggtgaaaaatttttatttaaaaactaatcaagacctgaattgcctttgcaaagtgtcagatggtatgtctgggaaaatctaagattctaagaatcaactgctccttccattttatataatataagacataactacatttatttaagttgtttcataatagaaggtgtgtataaatgcatgttattaactagcacatctttttcattaaaatattattatttaaatcatctaccatcaagatctctaattttattaggcgcatgtaatatatttattaaggtaatccaaactatgatggtttgggtggtcgtgtggaattgagggagtacttgataattaagatataataatacggaggagctgtgaaacccagcttcttagagtttagctcgttcatgtttcagattatgtatgtagagcgtctcagaatctcaatgaaagtacatattattttggagaagcctttttatttcgagagaagctgcagttgtcaaaaatttttctaaacaggcccagtgactctgactcgtagttaagggtgcattgtccactttttaaaattgtactccttcatatttcacgtgcacgctttcaaaattgttaaatgatgtgtttttgtaaatgttttctatagaagaattgcttgaaacaaatcatattaatttttttttcaagttttattgttgacataaaaattatgggtacttccactttaatatttgtttaatttgcctctaattattggtaaaattacttattttaaatacatatttttgttaatcacataaattttcttccatcgcctcttgcacgaaagcgaccgaggcattcacttgttgctcccatgatacgatcattacactaacacgatcattacactaacgcgtcaggtacatcattcatatcatacatgtgcatagtggaataattatccaaaaaaaaacatttgtgattattattggtcatactaggttgcttaaaaaaaatttcagttaaactttatccactgggtatattaccggtacaacgcacgggtattttactagttttttttcatataaaacagaaaagtctgaaaacgcgtggaccaattttggtaactggccgaactcccattagactttacgggcaaccggcccatcacgcttttttgcgtggccgtaatcgaaaagaattcgtccccctagttgtgtccccggggagaataaatttcctaatctaaattattccgccaaaaatccgccgcgattggccaccgctggctccatggcaagcggaagcggcgagggcaagggccgccgccaccaggacaatatcccaagcgtcgtcctgctcgagctctggggccacgtcgccgacgatgaccaccggcctgacgccaccaccgccacttccacgacgagcaccggcctgccaatctcggtgaccttgtgcgccgccaccccgccaagcctctcgcacctctccgtcgactgccctggtctggtggatctggatcccaatcccttagataagtttgtggcgcccacggtgatcagcacggatgccgacctcgtcctccttcgtgtccctgtcgatcgctttgccagatttgatcactgtttcagcgactacttcgtctacaaggtgcactctcactctgaaagcgcaaagctgcaccgtctcccgagcccacgtggccgtggctttgcagacgacaacattgccatactgagctgcggcaacgacgacgacgactcctacgctgtggccgctcttcaacccttgcatcatgtccacttcaggcttcacctgtgtcgctctacccccgatggaaagccagggagttggacctcccatcagttgacagtggaggagccgctgaggggaacggtgtgccccgtccctgactcagcactgaggaggatcttccatgccaccaccaaggtgattacgcttggaggtgctaaaggtacagttggctgggttgatctctggcgaggcatccttctctgtgatgtgctcgacgagattgagagccccaagctccgcgatttgccgctgcccttgccctctacgggcaactggcctttgttcctcaatcgctgcccctactattgtcgtgacatcgtcgtcaaccagagcagagacactatcaagtacgtcgagatggaattcaccatcttgaactcatctcaagatccacgctcctcgtatcacgaatgggtggccagccaagaatttcgaagttcgcatctagacatcttggtcgatgatggtagcttgaagatcaacacatggaacatgcctatcccggtcactcatgggatgactggaagcctggatgctccgtcacttccaaccacttggacactgccctgcatagttacatgaggaaaatagactacaagaggaaaaatgccgccatatccgtggagagtcttcacacggcttaccctaccctgagcatcgctgatgatgatgatgttgtttacttgctatccaagcgcaccacaagtggaaactattctaatccctcgaggagatgtttcctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcacgctgcaggccgtgcatggttggaaaacaaagctcacgtgaatt

SEQ ID NO: 29993 - DNA, 1233 bp, Oryza sativa
  unsure (1)..(1233): unsure at all n locations
ccgccctttgantttgtagattctnnnnnnnnnnnnnnnnnnnnnnnnnnnnnnnnnnnnnnnnnaacgtactttgtcttcccgtccctaaaacattgtgatatatctgtaatattttaatatttttaattttaaaaataatttagactaataatatagatatttaaattaggtgattagtaaattcaaatcaactatagtttggaataaaaaaacaaaatgatatatgccaagtacaatctaataacaatagaatgcacttttggttaatgtttactcctaatttcttaatttctagtttggctccccccaccgttatggtaaaaaatcgttatgttttaactatttatctgctagagcatatgtaatatttatgtaaactatgttctttattaccaatcaaaatagacaccttacctactttcatcaaaagaaataaaaaatgtagtaggtattattctggaatactcctcgtcggaaacatatggaacgcatttccctcaaaacgcaaaaaccggggccccgagccctcgacaccaaccccgtcggatgtgaagccgacggcccagatggaggccagcggtgccaatgcgtaggccacgcgtgcctctgcgcaaatcttatctcccgggaggctccgctccacttcccttcccgagtcactcaaaccatccaatccctccaccttcccttcccttgcccccatttcccaccgccggcgcgccttgcccccattccccaccgccgcggtgcgggcgccgacgaccttcacacctcgagcacgcgtgccgccgacgaggtgcccttctctttcttactctcgtctcccccattcctcccctcttcccgtgtcccgtcgtccacagcttcccgaccaaatccttagcctactatttcccacccacaagcctttctttcgtggtcacgcgcacgaacgggcccgacagtgccgccgctttttgcctactggcgcgggttttaaanagatggtgtcctgattgtttggacccacaaagggattggtatattttttgctgggaaattggccgcccaaaaaaaagttttaataccatgttgttaacccggcccttcatggggggtttttataccctttttaattgtttggatggtnaggggcttttcacccattcaattcccacctcccccgaaaaaagagcccaaaattacccaaaaaaccccctccctgcggctctttaaaaaattcaaagaccg

SEQ ID NO: 29994 - DNA, 1977 bp, Oryza sativa
  unsure (1)..(1977): unsure at all n locations
gtgtgccacatggtctttagaatagcatttgcatcttcctccgtcgcaacatgtctgattaatgcctcattccaggcgtttgttccagggatcaaaagctcatgtacatacgtgagcctattccaattcttcttctgtataacctcaactttctcaccatgcgccacccatctattcctccaaatcttggtagtccgcctgtctcctatcctccaaatcagtcctttctttagcaattccagcccatgttcgattcctttccaagttggtgaagtattggacgggaaagctgtatcagtaagggagccattggggtaatactttgctttcagcaaccgagcgcacaagctattcggctccgcgatcaacctccatgcttgacgtgctaataaagcctgattgaaagaccgagtatcccgaaagcccaggccaccatgaagcttagggctcgtgagcttttcccaggatatccaatgtactttcctctcccctttgtcatgtccccaccaaaaattgcgaaccatctattcataatcattacaaaaatgttcaggcatcttaaacactcctatcgtgtaggtggggagagcttgagctacactctttatcagagtatccttccctgcagctgatagaaacctctcacaccaatctgttaatctcttagaaaatcttcccttgattggttggaattgttctgatttcatcctaccttcgggagttggaaggcctaggtatttatcttcaaaacctgctctttgaatctgcagaacagctttgatctcctcctgcctctcctatgagcaaaattcactaaacaacagagaacactttgctgggttaataagctgccctgtgcttttctcgtatagactgagcgcctccagcaaattctcgcttgatcaacctcggcttgaaaaaacaataagctatcgtcagcaaaaagtaagtgggagatccccggggctccccgacacaccttaattggttggattgaaccttccaagctcttcttctccagaatatgtgacaacccgtcagtaataaacagaaacaagtatggactaagaggatcaccttgccgcaatcctcttgttggggtaaaaggatctagcaggttcccatttaaacagatactgtatctaacagatgtcatacatgacattgtccacttcctccatgattctccaaaacccattctttgcaacaccccatccagaaacgcccaatcaactctatcataggcctttgaaagatctaatttcagagcacaaaaattctggttctcccttttgcatttttggatggcatggaagcattcgaaagcgatgagcgcgttgtctgtgatcatgcaacctgatacaaaagcactctatgcatttgatattacatcatgaaggagcggtctgagtcgattaacaaggcatttagctatcaccttgtatatcacattacatagattaacaaggcatttagctatcaccttgtatatcacattacatagactgatgggccagaaatccttcatctcctccggtgacttagtttttggaatcataactatgacagtgtcatttgctccctcctgcatttcgcggttttcaaaaaatgcttgtaccactctgttgacgaaaaaatcgaacacaccggcctgggagatctgcttagctcctgtgcagttccaaagattgatgagatgcgagcgtgccagtcaatttgatcctacaactgacaaaatatgtaagcagcagataaaacagccgattggctgacaagccgatggagtagttccaaccgatagctgataatagccgatgtcgataccagccgatagcgatagggtttaagcaatcggctatatgtccaatatagataatgatataaaggcaatcggttgatgatgatgtaataaaataacaatataaccgagtagaaaccgggtaccgagctcgaattcggcataatagcagtactcan

SEQ ID NO: 29995 - DNA, 14855 bp, Oryza sativa
  unsure (1)..(14855): unsure at all n locations
cagagaacnggtagaatctcattagtnnnnnnnnnnnnnnnnnnnnnnnnnnnnnnnnnnnttcacattcagtttcagcaaaacaatacacataaaaaggcaatattcagatattactgattcagtctcagcagaatgaacaaccagaaaatttgtacaggtcccaaaaatcgattcaatcacaagcaatactgaatagacaacataacaacaaagtttcatcgaatttggttgtgcatttcacaagcagtattgaataggcctgaacgacattgtttaatgaattttctcatgtaattcacaagaaatgttatattattctaaggtcaaaacacaataccaccaatattaatcgatggttcgttctcgggtggttcaattggagaagtttgtcattgtagatcttcattgttttctcgatggaagataccagcgaggatcatacccttcgcccactttccttttctcaccttgtcctttttctaccttcttggacttgtattcttccatggaactttcaacacgctggtagccatcacatatgaactgaaacatcatcatgatggcattcacgtggccatgtaataattccccttgtttgctgtttgccttgatgaaggttgcaccttcacatcatccttagagttcattgactccttagttgtggcttgatgtggtgaaaaatcctcatcatccacatcatccatggatgccatgccttactacaatacagaagaagtaggagatcaataggtgcaaactaaagtataataatttccaacacaaaagagatagattggagaacaataccaagatgacgagttgaagttccagcagtcctatgcagccgacaatcagtggtgagtattttttcttggttcatacttgttcacccactcatatataggctaaggaggataatgttacctttgttgctatcatgatatttatggaaagatatagcaatattgccttgtatgtcttgtgagttgacatgattgagcatgtaatacatggaaatattgccaaaatagcacctgacagagatttggatatgatttgctaacctttaaactggttcacccacatatatataggcaatcagtgatcaacaatttttggacacgaaatccatctcagaaacaaccataaaattatccaaataatatggtcaatggtaaccttgctcgaattcagaattcgccaaaatcaatagacttcaaagttcaaatgatcttcaacaatacaaattttgtgaacacaaaggataaaacaacagatattagtataacttatgccaatggataaaatctgcacatgataaataataagtgcctacatgcatatacaacaaactaatgatgtgactataccaagaaggaaaaaaaattatcaacggcagttgcacaactgcaaatggctagatcaggttttaactgaataaagttggcacaatcgctgatcgtcaatgtcaacctagatgaatctatatatgttgaaaattaaccgaaaacaatagctaaaaatgttatcctgcaataaaaggaaatggtgaagtgtatctattcagaacctttgacatgcacaggaaatgtcaaaattctgatagggctttgttgaagctcaaatagatccatacctacaagcattaatcagttataggatatacaatgggctcaactctgtttgtcgaggtactcaaaaggaaatagcaatgcttagaaatatcagtcaaaggtgcaatgcaaaaaatgatggtaaaaattgctcccagaaaataaaaaggatgaatggcaattgattggcagatacttaatcaaccaaatgtggaaataatcgtagtgcaaatcattcatgattaaaatacaacaaagtaagtaatacattatgagctagattattacatgatatagtgcaaatcattcatatttttagagaatggatcatatttcaatatgtttataaaaatctgtagaaatttcattgggagtaatatctcaatgttgtacacaaaataaaccactactagatagaacatggagatgctgcataaatgtttggcaaacttgtgttacagcaacatagcagcataaaatccatgtgcttctatgctgttacaccatcaaatttacaacacccaagatcactcatattaactttgatttttctttaataaagcaattctcagttgtaaagacggtaagcttagtaactggcaaagaaatgaattttgttttgagagagcctgttttaataactttttcatgcaagcattactgaagctgtgagggggagtatgcagtacctgattatgcagtccctcctcttttctgaattttgtgggggagattccttgccaagcgagcctatcaaggagcaaaagaaggaaaaaaattagcaagattaagagttggaaatgaccaacatctccgtaacgatcagcagactaattagatcagcatcaaaagcaaaacatttgatatagttcactccataaagaagtccactagggcgagaagatataatttgcagtagtttatcccttgatccggtttgatcactccgtaaaaaagaaaaatacctgtagcctttaaatgcgatgaaacaatgtaattttctggtgtcatagaattaataactgatatacttgaccaaacaagttccaattctgttatttcatctacatggtttagaaacaaacttaataaaactctcaaaaaaaagctactaatcactgataccaccaagctagtagctgaactactcaataaaacactctataatcgttaacaacctgttgacgcgaaaaacacacactggcctgggagatctgcttagctccagtgcaggtccaaagtttggtgagatgtgggcgtgccagtcagtttgatcctgcaactgacaagatatgcaaatagcagatcaatgagccgatcagttgacaagcccatggagtaattccagccgatgccgataccagccgatggcgatagggttttgagcaatcggctatatgtccaatgtatataatgatatgaaggcaatcagctgatgataatatagtatagcaatataatccaatagaaaccaatcggctagcaagtcccaatctctgatcaacaggcagcttcttctgcaccgaccgattttcctttccgggacgaaattggcttgaactaccgacgtggttttcgtcggcatcactgcatcacgggcaaccttccttcgagggtaacctcatcccttcgttttagtagaatctaaagaatttgtagtcccaatgaggatcgaaattgttgttgtctttgtaacactcctctttctgcctctcaagcttcccttgatatttgctgatgatcatagcggcattgggccgatagcttcttctattggctatcccctcgcttgtgtggaccatgttgacaggaaaaggattgccgtcgatctccatggatttctttgggtcgtcgaacttgattcttccctgctcaatggcggattggatctgctgcctgaagactgtgcactcattggtgttgtgagaccttgtgttatgccacttgcagtattttctcttccctagctctgtagcagatggaattacatgaccagcaggaaggtggatttgtttctcccgaagcaataaatcgaagatcctatcgtctttggtgatgtcgaaatcaattttttcctcctttccagagtccttgacccattggcacgtgaccactcatttgttccttgcccattcagctattgctacctcagggtcctcatcctcttcggtttcagagacatatgtgctaacattgttcacctttttatatgcctttctagcctcaagaaacctttgctcgtgtgccgtcaccttctgagctaggtgagctagactctcgaattcctgggctgagaacttctccttgattggcaccagtaggccttggaaagcgagatcggcaagctgggaatctgttaaagccaaactaaagcacctgttcctcatatctctgaatctctggatataatcttgaaccgatttgtcatgcttctgtttgattgacgttaaatcggacaacttcatctaatgaatcccgctataaaagtacttatggaactgctataaaagtacttatggaactgtttctccagatcggcccaactttgtacaaaattatatggcaatgatgaaaaccacgtgaaggccaatcttgacagagacagaggaaacaatctgacccttaaagcatcggtagctgatgactccctgcactggactaagaatcagctgacatgttcatatgttgtcacattgtcctgtcctgagaacttcgagaaatctgggaccttatacctgttcgataatggtactctctcaaaatattctgggtatggatgccgatacaagttctcactatccttaggcttgtgcccgaattgttccctcatcacattggctatcatatctgcccaaggcttctgctgaggtgctccctggatctactgcggcacctgatccagttggttgtattgaggcaggtactggggctgaggcgctcctcctagccgatactgtatctgaggtgagtggggctggtactgaaaattaaggttgccccttaggtgaggttgaggagtttggtgtacgatgtgttgatcagggttaaactaggtgccgatagttggctgttgttgtgggataggcgaaagttgtcccatggttatttgcggaatcgtctcaactatcggctgtcttggtctgaacatagatgcgacttgttctggagagatccgagggatgttatgccctgcatgttgcggttgtggcctgatcagaacgtaaggattgaatcctggctgcccttgtgccgatgttgatggaccttgcccccagggggcacaactgaagccatcggctgttctggggcggcactcgagatgggttgatgcctgtccatgctgacagttttgtagtttggaaaaaccctccaggcagaaaaactggacctttggcttgatgctcagctatcgtgccgtcaaccacatatttgatcatgttggtcaacatgttgacaagtactcctgattggttgaccaaagcatgatgaacggcataatcaacctggtcttgcatacatctgagcgcctcgagatcttcctcctgattgttgcccttggctttgtcgtctttgccagaacttgtttccgcgtcatcgttgttcgacagaactaccttatatttctggaccatggtgtcggaacgagtctgtgcgaatgaatgcaggaatcgttttgcaagtcatctctcatcttttcaaattctgccttctgctccagggtcagcttgtccattgttattgggatgacattttctggatcaacttctctctacttgaggcttgccatgaagaaaattttacgaaagtcggtcccaccgggcatgccaaaaagtgtgttgatgcggaaaacacacgtactggcctgagagatctgcttaactctagcgcaggtccaaaattgctttcgggttccgagcgcgctagttggtttgatcctgcaaccagcaagaaagaaaaaggaacaaagttaaatccatcaacgatagccgatcggctggattgccgataacgtattgttcggagccaagccgatgttacttgcatcagatcagcaagggaatataaggcatagaaattattagatctacccaatcggctgtagacgtcagcagtacgcaatctatccaatgaaagcacatttggatcaagtgattgggatagatcgggcgatatgccgagacagtataaatcacttaatatctaaatgtgcttcaaagtagggattatgtatgctcacagcatagccgattgagcaaacctaacgtgtatcgactattactccgataccactttatactacaatattagcacagatgaaatatacgaaacgtagaccaatctaacaagcaaggtgtcatgtcccaaaacgactctaaaatatatcctttaaattatgcctagaataattaaaatccgtgtgaaagcctccaacaattaaaatgtgcaaagttaaaagtcaaataaggcttaggggatttttgtatttttcctaaaagcctaaaaggtgtaaataaattttagtggaattttcagagcacaaataataattactaagaaataaacaaagttgaaaaagttttataaaaagaaaaaccttaaaagtcccccttccctcccttgggccgggccggcccatctctcctccccccctctctctctctcctctccccgcggcccactcagcctctccccgcgcgcgcgccgctgacgggcgggcccgcccgccaccctcgctgacgggtggggcccacccgtcatccccatcctcccgccgctccgcctgcgccaagcgccgccgccgccgccaaatccgccgcatcccgccgtccccgcgtgcaataaagtgggggaaatcactccccgtgatcccctctccctttccccccatttttccctctctctcttgtgttcaaacgggcggatttgcccccgcaaatctcggcagcgccattgatggcggccgacctcccgcgccggtttccttcccctccggccgctctctcccccttccaaccctatttaaaccctccccgcacctcctctgtccgtttccgcctctcgccgcccttcctcctcgccggaatcgagctcgcgccgtcgctctctctctcctctattgccaacgaccttcggccggccttctccgctcgccgggaccgtctcccgccccggcgtcgcctcctccggtttcgccgcaccgccgtcgaccccgtccacccccttgccgagttcgccgaccgccggaacgtcgtcgaccccgtcgacccgagccgcgccgccgccttcctccgctccggccgcctttttcgtcgtcgccgtcgacctagggtgagccgtggaccgccgcctcttttcccccttcccttcccctctctcggccgccgctccgccgtgcctatggccgccgtcggtgacaataggggcgcgggcaccgcctcccgccggccgcgccgagtggccgccttcgggcgggccgagtggctgccgcgtggggcccggtcatcagccgcccgcgccctcgggtgcggctgatgcgtgttacccacgacgccggccggtgtgagcccgggtgcacctggtccaccgtggaccgtgaggctgccgcatgggccccactcctgtggacccggtccgcgtgccccttcccctcggctgacgcaataaacccctttttaaattaaattttaaatgaagaaattcgcaaatattcatttaaagagcatataaactttaaatggccataacttggccatttgaactcggaattggaccgttcaagtctctaatttttccttaagaagtcaagaacccatttttgtgctttgttcctacttgttatatggagtttattagagtaaaaacccttttcatttctgttggtcgtatagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatttagccatgcctatttacctttgttatgaccttattattattgttattgttattattaccttgttcaccctagaataaacaaaaccccaactagtggacactctactcatggtaccactagtatgaatttaggtagatgcttcgctggttaattaggcaacattaggtggttttacaactctagactttgggaatattctcatcacctggacactatggaatggatggattattgggaattggattcacacctccccctctattcaaaaccctcaaaatggttttaggctgggctcggggtgcatggttttgatagtagcacctcggccataaaaggaccagtcttcgggcctctgttgcaaagcactaccgtacttccacatgtctagtggctaaggcttagtttgtggctcagtctggttataaacaaaagtacacggatggagatggacgaagtcgggggtcaatggacatctctagggcaaatgaaggctacacgagctgcggctcggtagtcgagatgtcatggcacagggccggtgtcctgctgctaggggctcggtcctgcctacctgtcccgaaggttccggccgtaggtggggttgggtcagtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataatctattcgaatagccgcgccctcagttatgggcaagccgagcaatgtacccaagttagtgttttaattcttaaaacctgcttaacaactaaaatgtggaatggatggcctgggttggcttgggacgagctgggacccagggtcgggttgccagttcggtctgaatcatcgtaggccttgggttaaggcaggttcgtgtgggttcacggcctttattaataatattgtatagttctagaatcgtgtttacaaaatagctttgagcaactaagtgtcttttaatgccgtttactgcaaaccctaaccctttatattataacccccttgtactcccttgcatttattctgcacttgtgggtgtgtcttgttgagtacggtggttgtactcagtcttgctcaatttttcccaaacccagaagaggagcccctggaagatgaaggctttggtgtctagctcatgcctgccgtcaagcgcctgtggtcgtcgccctagtcttccgctgtttcccgtttgtctttgtgtgtgctgggccttcgccgccctgtaataaattaactatttacgcttccgcttgttgaactctgaactgtatcaacttttggtgtaccttgcctcctaggacaaggaataatgcacgcacgtaaggaacgcccgttagattatttccggtcgtgacaagcccccagcgttagatcgtagtcgatttaacatcggggacactcgcgcaatatatattgtataaaaacatgctctaggtaaacataataaattatagatccgacaatgctgtatgatcttgaaaagtaggtacagtaaattgtatataaaatattgcgtacctttgtagatatatgccggatatatctacagaattagtagatcaatttaaaaaatcaatctactaaatacctgatcatgggtggctggacacgtactgactccatacatatgcatgtgtactgtgtacgtgtaaggagcaggcatatttgttgaattcgcgtcatcaggacgagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgcgccactgtcgacgtttgatgtcgcgattccggtatttgcatagtatggggatcgtcggtactaggacatacgcgagactgaggtaaaagagacagaggcgacgatttttatacaggttcgggcccctgaattgtcaggtaataaccctatatcctgttggccgaagccggtattgctcttattcaccataatcacacgagtacaatatttggggtagcctatctaactgttgtcgacatggcggtctgtatgtctgactcgtagtcgacaacagggtagtcttcctcctttagttcctgcccggcaagatcagagatagcacttttgtctctcctgacagtatccagagacagcgtaggggactagccgtgcttatccctgaagtcgatatccaacgtgttgtcttggcgtatgttggtttgtatgttgtggcttctgttgttccgtgtatgttgattatggtcggtgttgattgaggtggtcgtgtcccctctcctcctaaggggtcttgtatttatacccataagtgtccccttgtccaagtaaaactagggaaaccaatatggatacaatccgagtagtacttgtcgtttccatacagaactctggttgtctttccttatccataactcctcctatatccgcaggttgtttccgtataggacatggtatgtggtgggtcctgctaagatttagtcaactactattaggtatgtggtatccataaccctgacagtagcccccgacttcaatgcaaatgaacgagttcctattctccacagcagaccttggaggaactgttatcgagctcatgtgaccgttttcggtgagttcagagataacgttagatttcctttatcagcctcgtgcaggcacctaaagggtttgtctgagtcaatctccaacgtcaaccaagaaagtacagagcatacgactaagtctcccgtcttgctgtaatcgagaatttggattgaagtcatgaaattttatcttggcgggtacaccatctcttcattccgtattccttgttgagatccaccaaccattcttgagtgatcgagaaggcgcagagtctacgacggagccttgtcaacatttgtcgtactcgccttagtcgatcttggtgtagaaccacagagacatgaagtcttcgacaatgttgaatagaattttcctgaaatcaacactcagaaaagaacattagataaaaatatcccccgagcgagtgctcaaagggtaacgtgttatagaatatatgaaaaactgaaaatgaattaggtttacaaactaatgttttgtgtatgagcgtctactcttttaccgacttcgaccagtcagtttgttgagttatacactctccctagcccccagccttatcgtcggagaatcgttctcggatgataaggctcttggacctttgacctggcttagttgaacaagcactgatcctagcccccagctgtgaagttagaaaattcatttccgattacacggcttggttaatacgcacggcgagaactcttaaacgaccagatcttagatggtctttcgtctctaaaggatccgacaaagccttatccgctctgggcgtccccagccgaagttcccttaggttcctcagagactttgtcaagacggcgtaaagggacattaggttaggtttcaacgctaggtgtctttcgtggtaagggatctctgggtaaaacacttggcgatattgtgcacctgatatcaacattgttgaagtagaggtaatgggagaatcgctacacctctggtcaagaaccaggtagtagtcgtaactcaaccactagaagtgaatgtacgagagatcggtacgattgactggttgagaaccagtgagtaggtgtctctcgatcatttgaagttgtggtgcatggactgctgcgttattgctgtagccgtacctcgaccatctgaggttgcggtgcgagagattgctacgcactggttcgaggaccagcggacaagtagaattatctcttggacaccaatagaggttgcggtttgagagattgctacgcactagttcgaggaccagcgaacgtgtagaattatctctcaaacaccaatgaaggttgaggtgtgggagattgctacgtactggttcgagaaccagcgagcgagtagaatcatctctcgaacaccaatggaagtggcgggagattgctacgtactggttcgagaaccagcgagcaagtagaatcatctctcgaacaccaatggaagtttgcggtgcgggagattgctacgtactggttcgaggaccagtgagcgagtagaatcatctctcgaacaccaatggaagttgcggtgcgggagattgctacgtactggttcgagaaccagcgagcgagtagaatcatctctcgaacaccaatggaggttgcggtgcgggagattgctacgtactggttcgagaaccagcgagcgagtagaatcatctctcgaacaccaatggaagcactagagttggtttattacatgtgtatctcatgtggccagcatgactcacacacccaacttgtagcatatccggatgtccgttcgcaatcatgtcgggtgatcaagccgacaacgttcacgaggaattatccgttaacaacatttttctcaaatagtccagccacggccggcgctatgagataggtcgtcggtctttgttggtaggttgggcgcgacgactctgcatttgtcgagattgttctcaataatgcggtgtacttgatcacaacctacttgagtgctcaattattcctgaaaaatattttctagaagacaagatatatagcagataatatcaagtgtgtactcaaaaaactacatggattttctagcattatcaggatataacgagcatatataaatatcaggcattatgtaaaccgtaaacaagcatgatttatatggaagaaaatagagtgaaccctgtcacgtcccaaaacgactctaaaatatatccttaaaattatgcctagaataattaaaatctgtgtgcaagccttcaacaattaaaatgtgcaaagttaaaagtcaaataaggcttggaggatttttgtatatttcctaaaagcctaaaatgcataaataaattttagtggaattttcagagcacaaattataattgttaacaaataaacaaaagttaaatgattttataaaaagaaaaactgtagagagccccctatccctacctctccctattgggccggctcggaccatctctctccccctctctcctctcccccgcggaccatacggcctctccccgcgcgcgccgatgacgggcgggaccgtccgccaccctcgctgacgggtggggcccacccgtcatccccttcctaccgccgatcccgccgcctagcccgcgccctagcgccgccgccgtcgtgaatcccgccgcccccgtcctccccgcatgcaatcaatacgggggaattattccccgggatcccctccccctttccccccatttttccctctctctctccctcggattcatttggaaacccctcccctaacctcgacggcgccattaatggaggccgggtcttccgcgcccgttttcccctcctccggccggcccttttcactcccaaccttatattaaccctccccgaggctcccaccaccggtttcgccaatcaccgccctctctcaaccgccgaatcgagctcgcgccgtcgctccctttttccgccgtcgccgtcgagctccggtccgccgccgtcgtcgcccccgaccaccttccacctcggcgccggcttcttcggctttgccgcatcctggccgacctggtccccccctccgtttcgctcgtcgaccgccggagcaccgtcgaccccgtccacccgaaccgcgccgccggctttcttcggtccggtcgcggtttccgtcgtcgccgtcgacccggggtgagccgtggacccccgtttcgtttcccccttttccctcccctctatcgcccgccgttccgccgtgcctatggccgccgccggcgcccataggggcgcaggcgcgcttcctcccgccggccgcaccgacgtggccgcctccgggcgcgcctagcggctcccgcgtgggggcccggccgtcagccgcccgcgcctttaggtgcggctgacgcgtggggcccacggcgccgccggtgcgagcccgggtacgcccggtccaccgtggaccgtgaggctgccgcgtgggccccactcccgtggacccggtccgcgcgcccctcctctcggctgacgcaataaacctttttttttttaaattaaaatttaaatgaagaaattcgcaaatattcatttaaagagcatataaacttcaaatgaccataacttggccatttgaacacggaattggaccgttcaagtctctaatttttccttaagaagtcaagaacccatttttgtgctttgtttctgcttgttatatggagtttattagagtaaaagccttttctttttcgttggtcgtgtagacgctgcagcttcggaagatccgctcttcgtggaagttgaagtcgacgtttgggaaagcgagcaaggcaagtcacatcatccttgaacacattgaatcccagtttataaaattatattgatttaaattattgcattatcgctttatttaaattccggcgttatcactgttttgataaaccatgcctattagcctttgtataaccttataattgtaattgtaaaaaaaaacttgttcnccttaggtttttcgggcccccggctagtgggcgctctactcatggtnccagggtcccgagctcgnttncgcccttggtgagccgagatgcattcaacccaggngnggggggtgggagagagaatagaaaaataatacgtaacagcanagattaaaaaaatgattantagtacgaaaagaatatttaacagaaataaaaaaaattagaatgagagggt

SEQ ID NO: 29996 - DNA, 3405 bp, Oryza sativa
  unsure (1)..(3405): unsure at all n locations
accccaacaaccataaaggcagaaagggccctccttcccacacggataagaggacggtggtatattctttttttaagccggaaacctagtgaccccatcggttccaaaaatccctttctagggaataccctgacaagttaagggtttagatatattggaaaaatatttgccaggtcactaaaaaaattggtttctccttccggatgaagaaggtatatgtatggacccaaagtccctttgtaataaatcaaaggggatttgtggggcaccatataaaacaatgtgnccaagtacatgactcacttgattcttaatggaccatgaaagcaaanctacacttccaaagcancggataaggattgaaagaaaatcagtgccattgcatctataaatagacaagcgcaatgaaaaccctccccatcgttcacacagttcaagcattatacagcaaaaaaagaaagatctagtgtcccgtagcaatgaagatcattttcgtctttgctcttcttgctattgctgcatgcagcgcctctgcgcagtttgatgttttaggtcaaagttataggcaatatcagctgcagtcgcctctcctactacagcaacatgtgcttagcccatataatgagttcgtaaggcagcagtatggcatagcggcaagccccttattgcaatcagctgcatttcaactgagaaacaaccaagtctggcaacagctcaggctggtggcgcaacagtctcactatcaggatattaacattgttcaggccatagcgcagcagctacaactccagcagtttgatgatctctactttgatcggaatctggctcaagctcaagctcaagctctgttggctttgaacttgccatctagatatggtatctaccctaggtactatagtgcacctagtagcattaccacccttggcggtgtattgtactgagttttaacaatatagtggttcggaagttaaaaataagctcatatatcatcatatatttcacctgagaaactcggggtgatatatcctcgtacatcgtcataactaattaccatcattggtactctacaatattactatgtgcttacattcgatccaaagctactttgtctttaagatataaatggagcgtataaaggatgtccatcctttaattctagtaagaacaaacacgaagcacatatgtcaaatactaaatccactacaacaaaattatagaccatacaaagcacgtaaagatgtagcaatccacattgattcttcatccactactaaaataagcgcatgtgaaaggccgcatatgcatgatcattgtgaatatgacatgcccttatcgagcaaacgtgtcacttcatgcaaatatgttgtttgtttcaagcgacatcaagatatgatttcaaagttttaaacattggtatattaatgactttcatatctgcatattaatttcaattgaaagccatcttgttgcccatccttcctgacaagatgtagtgtacaaggcactctttagttgaggctcgctcactttgtattacagaagtataacctagacgtaactaattcagtataaaagcaaaaagtgcatcagcaacgatgagggtggaaactagaaagaaggatttatgatgttccttagtttattcagtcacgaaagaatgactttaaaaaaatgtacacttctttcaaagtgaaaatgatgagatgtcttacttatgtaatgctcctacacgctgaggttgttcttgctgacaccctcgtttctatgagaagtttattctaacatagtaagttgatatttacagcaaacaaaatggataataatcctgatgtttcaacaaaactagaggaactcactgttaacgaccaaatttggtaaagccatgggctgggttcaaagctagagtcgaagccggatttggaggaattctttttaagaaagccagagtgtgtatcggctacgggcggcatcagctgccgtacgtatcggctacaagcggaatcggctgtcgtatgtatcggctaacgccaaatccaatgaagacaagccgatgtagccagtcttgaaaagacaggtccacaactatcatcgggatcaatcgaagtgcttcatagccattgccacacaagaatcggtccagcaaagggcaattgtatctattaattaggtttagtttccttaagagatattttggtaagagtccgcctaagggacttgttcgtattttacattgtaataaagatagagtcatgtccaacaaggagatgttatgtactttgggtataaatatgacccgagaccttataatcaggggacgacagctcaataatacttcggcgcatcgccaccctttttctctttcattgtttcgacgagtttttgctttcgagttgggctgcatcaggttcgatctccgacgaagaggtaaagcttgttatagcggattgcgttctcaggattagtgcttacatctttatgacactctaatcctatctatgtgaatcaccgagttatcatatatgctgcataatctagattgatctcgtcatctaatctcatcggctagcctctatcatcgaaaacggccgacagatttagatatcaacattaagctagattatgcggtatatctaccatatcaaatgagtcttcatcgttcttgcttagatcttatgtttcttttcacacttaatgctgcattggttaggttcgatctactaagtactgtcttgaaacattttatctagctctttctatgaatgctaatagagttagtatcggagtttcagccgatcttacctgatttagccatcgtgtttccactacttgggtcttgatcgtctaaatttgccctttatattaaaatatcatctatttgaagtgtattaagctctctatcaatctactagttcaccttatgtcacgaccggaactaacccaacgggcgttccttacgtgcgtgtattattccttgtcccaggaggcaaggtacaccaaaagttgatacatttcagagtttatcaagaggaagcgtaaataattaatttattacatgggcggcgaaggcccagcacacacaaagacaaacgggaaacagcggaagactagggcgactaccacaggtgcttgacggcaggcacgagctagacaccaaaaccttcatcttctaggaactcctcttctgggtttgggaaaaattgagcaagactgagtacaaccaccgtactcagcaagacatacccacaagtgcagaataaatgcaagggagtacaagggagccataatatagggggttagggattgcagtaaaacaacattaaaagtcacttaagtgctccaaccctactttgtaacacaagtctagagctatacatattattaatcaaggccgtgaacccacacgaa

SEQ ID NO: 29997 - DNA, 2098 bp, Oryza sativa
  unsure (1)..(2098): unsure at all n locations
cactgcgattagaggatctcatcgttatcatggactgctacactactatttactagatcaacgacatggttatcttatcaacatccccccctttgggttcccaaaaagtttcctttctttttccaaaaccaaataaggcccctaactctctgctgtcgttgatgggcaacttcgtcatcatagccggctatctctgttgccgctaatcatcattaccgtcggatgcgtttgccattgccgactattttcttcatcttcataattggtggatttcgccatcaccgttgatgcgcgtctacgtcttcatcgttgggtttgcttttgtcaccaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaatggtgtcgaaggcatattttttggcctaggcctaatatgtctgcagcccatattttcaggtgtggcctgtcacgttcttttagggacttaggcacttttcgcttaggccaaagtgcgcgtaatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtgggaccatgtgtcttctagggacttaagcacatctgttaaagcagtgtgcgcatggcgtatgcccaatactttggaaatttctttattcacaacatacaagcttctttatagctattttgctatgtgaattttcaatgatgtagtcagctttaggttgcacgcatcatattttacaaagcagtcggtatatcactcggatcatgttattcagggattcacaccgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatgtaaccgatcatgacttgggtattacgtttccttttatattatgaagccgcctaaagtcctgatttgataatattgtaaaatagatttaggaaaccgataccgtatgggttaaggtttctatcttgtaatcctgccccccatcctatataaggtgggcaggaggccctctagggggcatgagacaacctgatcgtcagatcaatcan

SEQ ID NO: 29998 - DNA, 8867 bp, Oryza sativa
  unsure (1)..(8867): unsure at all n locations
ngcgggccagacggcggtgggnccgcgcgcgcgggggccatctccccgtcgcttttgccgtaaaatccaccgtcccgtccccgtcccgcagagctgggccaccggtcgactactcatacatgtcgctgtgtcgactgctcgtttgctacttacgccgagcggcgcgtgcccccgccatgtgacggttttggagcatgtactgtacaaactagtagcacaagccagcggcagtggagttctcccgtggccagacagcgcgcaccgcagagtattacaagtggcgcgctagatgctgcatgctgtctgctgctcggccgtttcctccttcctgcaacgatcgatccagatccggtccacgggtagcaccgtgcggtgtctcgctgcttgttctggggcttgcacaccaacgttacaccgcacttgtacctttgggttacgtggcaattaattatctgtcattcgttgtctatgatatatgggtccagtggtaaataatttaattattctttgggttaattattctttgagttcggggtatctcacagcttgtagcttctggggcttgcacatgcgcttggtttctttcttttttcgtcgatttgtaatatacgtttgttgagcctatagatgttctgggatattgtttgatttcgtcgattttactgcaccgattggttttccactcaaactggtttgccatctttgttctcacgttttcatcggtttccaaatttctgctcaaacaggttttcattggaaacagatcaaaattctgttgcttttttgctcaaaaccggatgttgggattcttttttctttttttttggacgaggattaggattcaaatttcgatttgggaatatttattggttcaagaatttcattattttgctgatgcacgtatccttcaaatggtactgatgtacgttcactttatcaggaaattggaatggatgagaaaggcggaactaggctctgttctgcttttattatctccatcagcaacaattcaagaagataattaacggtaatcttcctaaacaactaaaggaaggcctccacagggaattgaatctgtggttagcgtcatctcgctagaagagaaggacgaggtaaaaaaaacacataacatcaacatttaaattactaggatactgaactgtattataaagtactgatgtataaatcatttaacctccattgtgtcatagaaatatcggcaagatcaaaaattggtgacaaaaccttgctacgctacagaaacctgagcttgtgaaaatagccgaacaaatataacgatgctctctctctctaaaaaaaatgatgctgtatgcaaaaatagttgtttccgaaggtatgcaaaaattgtattatccaagtctaatagagcttcagttggcaaaatgcagggcggtgaacaacaccatcctagttcaatttataggctgcttgagtcccttccatagatgaaccgcctgccccaatcagatactaccagcatcctggtgcgccagctgaattgcttactgcattccataagagcaaaacgccattaaaaactctacacgacacgtccatacatgcgagggaagatgaagtgcagaaaggaagacaagcatgttcagtagggtggcattattaatacctggcatagacagaataccatagccattgggtgctgtgaccaacatgtatccaatcacccggcaattgagcggctgtttgctctccacccagtggagcaaactggccaaggtgcctgtacctgtaaatcataaagggcgaccattagggactgctgtattctggatgccatgcaaaagaaatctcgtgtatcagcaatatgtgacaagattggtaggcttttgtttggtttgctccaccaactttggtttggcaatgccaattgtttttagctaccaaccagttagatgactaatttattggtgttgtcgatttcttggcatagttgattggagtcataaacaaaaaaagttcatccgtaaatccatatcaacatggtcagcagtgtttaagtgcctaatgtatgtatgctaagagagcaagggaaaacaaacctgaaaggtttgaaccgatgacgccctgtgcctctgatcctcaacggaccttcagggttctcttcacagtatttcatcttgttgaagcagtttgccagataggctccctcttgtgaagcaacctgaagtgccaaacgaaaattcagaatacatgaaacggtttgtagatattcaaggacacatcaatttgacatataaaatgccaaacaaaaatttactccctccattcaaaagtctaagccactttttttgtcactaagatcaagaaattacctcatccaccatgtgacaaaaccacaaaaatttactccctccattcagaagtctaaggcactttttttgtcactaagatcaagaaattacctcatccaccatatgtgacaaaaccaaggaactatatacatccatacaaccaattagtaagatggttctttgtgtttgggtcaacaatttaatttggcacataaagactacaaatatacccaatctcatttggaaaacatataatggtttgtagatatttaaggacacatcaatttgacatatattgcaacagatttctttccctatgtgcaaagtgcaaactctctaatggtagacatgaataattacctgagctgttgctgggagcatcttaacttgcgagtccactcgagcaagggctttcttgaattcctctatgttcagctcttttgactccttaatagcattcccgtctgaatctttgagtaggtcatggaagtccttcatttggttagttttaaggtacaactcaacctgtgggtacctttcatagatgtcgccaagaacatttttaattttcttgacagtcaaagagccagaattgtccttgtctgctacccggaaaattgaagcaatatcttcctgaatatacatatcaacacaatccattaagaatgtcagaaattcataaacaaaagtagttgacaatacatgaaatttgtttgctaaacaattactagcatttatgttaagatggcattaacactacaacaggtagatgctagatcatgtcaatcttgcctttctcacaaaaagaatttgaagtaggaactgaaaacatcctccaaaaattttgaagttggttcagaaaggaacaccacggtgtaaatctttataactataatagtgatatgtttgagatggctaaacagcttcacacaaagttgcagtctttaaaccataataatttcagcatttgtaattttttatatttaatcatatgaacttattatcaaaacaaagacttagatataattaactggcaacttaacactgaaaagggctaattgctgtacataggccactatttgaaattcaattatgctagcttagtattctagagagcaggcgatgaaacatgttaaattataattataccataacatatcgagatgttcttgccaatgacaaaatatggtgcattctttacttgaacaaaaaatatggtatctttgcattgagaagtacacacataccataacttttctttgagttattgtcgcgcaatcaccgagagcatatacatcatcacatccatgaaccctgagccattcatcagtagctagcactcgtcggtttgcctataaattaaataagtgttttaaaaacataatttagtgtaatatgttgaaatgtattctcttatgagttctgtacgagatatacctgaccaacttgcttcatgaaatccattatgaggggacgggttccaataccagtggaccaaacagccatgccataaggcacagcaatctctccagttgcagaattagtcatagtgatagccttatcagacaccttcacaaccttaaaattcgtcttcaaatctatgcctgtcctcttgaatttatcttcagcaaattgggtaattctcttgtcaaacctgcatatatagaacattaaaacttttttttgcaaagaatatcataaaactgcatcaagaaacagaattttctgaaatttgaaggcctcctacatatgtaattatcaactaaaatgcttctgatcggtaaaactaaaagggtgaaggttcaaaattactaacataaaactaaaaatgtgaatattttgcaatggttcaacaagtacaacagatctcaaggtcttacattgtaaggatatgatctccagcttcaattactgaaatattcgcatacttcttcacatcaggatacaactttgccaagtcctcattgacaaagtcatgaagctctgcagcaaattctacacctgttgggccaccaccaataacaacaaaatgaagattcttcttcctctcttcctcagttaggtttggaagggacgctctttcgaaacatttcaggacactcttcctaattttttgagcatcttctacttcctgacagaatgcacatgacgattcaattcaccatgcaaaatatgttgcaaaattgaacaacataatggatataacatactaaagaaaaagaagttatgacgaaagatggaacaaggatattctttgtttgacaaagaacaagtatatgtaaagatgtaaaagcaagtttgctgaaggtaattcagacattgaccaagagataagctgaaagagtcgtaactgataagatgataaaataaaaccgagttttgttacaacagttaatttctttcattaacctactgccttattagtactgacctttagaaaatggcagttttcaacaacaccaggggtattgaatgtattaggtctagctccaacactgacgaccaggtaatcataatctacaacaaattcactatttccatctgagtctgatctgcagtggatctttttgttagttggatcaatcttgtagcactctgcttcccaaaatctaaatgcgccgcctctctggaaataatgtacatgtaatatttgtgagaattcttgcattacaaaatgatgcaatatatcaataatatagctaattgattattaattcagtaaggtcttacctttctcacaatattacggataggctctacaatactacgtgcttcaactgtgccacatgtcacactaggcaacaaaggtgtgaaggtaaaatagttgcgaggtgatacgacatgaacatcgtacaaggaagtgtcaatatttctcaagaaacttgcgcctgcccaaccagttccaacgataaccaccctcttcttgccagttccatcatttatttgaagtacttgattatcctggcaagcataagtcaaagaaccaacactgcaaagatatttgaataaaaggtgtgtgagaggagagactcagagtcctgaaatatatacaatataaaatattatgaaaactaatattaagagtgcatttgccatctcagtgagttttaagttgcatttactagtttttgatttgccaatgaataccaactaatgaacttatcagagccataacagaacatgtaaataaaaatttcttccagctataatgaatagcacacctctgctgctagtcttcttcactttcaaaacagaaagaaccacaagagaagtattcactaaaattgcttgagacgcttacaagattttgctacatggcccaaaaacagaaatctggcaatacaaatgttatttcacttttgtgatcaaacaatatcatgaacagtatctgctgtgcacaattccaatatgatcccgggttacaataagaaatatgaaggacaaaccatcaccatgaatctatctgggacaaacatgtctagcatcatggattaatagctatagcacattctcttaagcaaaagggtgagaatacaatctgcttaaatgcccactcctctgtcccacaaaaccccaatatatctgaagatgtaccaggacaacgtgcgtgtctaaatacatcttcaggattggactttttattggacgaatatattattatttattatttatgacgttaaataaacaagtaggacatgttttggacttttggtgacacaatacatactcgtctccctagaatcgtgaggcggtgatttcaatattacaatgtcaatgaacaagaataatacaatccgatttagacgattggccaagtaggcaccatggttccagcacacttcaaataatttgttgtttcactttcacatcacaatcacattctttttcaagtgtcaagatgacatagataatattttttagatttcaccataaccaattatgaatataaacgtgaaccagatttgttagatctatgagtaattttaccaataaatgatcgaacttctgaacaactttttcacccaaatcttaataaacaacgtagtgcggtgtttaagtgttgggctaggtgtaaagtaagcgtcgggctacggacttcaggggcaaaagaaaagttgcaggttgacagatcaccaccgacttaattcttaaaccgaaaaaaaaaatccattgaaaagaacatccccgattaaactaatctcatgttttggaggaaaggctttaactactctcatgtttatacagccgccttgatagaactagcgcaaaatcgcgacgaaaacatttacacggtgtatcaaagttcggcaatcaaaccaaagcgcggacgcgcgcacgtacggcggcccaacgcaccatatccagcgcaaggacacggttgcgcacgcgtataactagatcgatcaacgggggtgaggtgtatatcaggggcgcgcggagcatgagggggagaggcggaaacgtacccggcggtgaggacgaggagcctcttctgccaccgcggcgtgcggcgcgcggcctcgacggcgcggcgcaccaagctcaatccccccgacgccgacattgcgatccggccacggcccctactacgggtggtgtgggacggagcagggaggaggaggaggaggagacgaggcgaggcgcggaggcggcggcggagaaggagcggtttgctcgcttgcgaacacgcggcggcggacgagggcgacgtgcctcctggcctcccggagaaaagcctaattataaacaaaaccacaggagaggagagagagaattttgtctgcgtgggccgtggagcttttccactttaacccctcataggttgaccgatttgcttttaaaccccggagatttgactctggaatgttgggtagggatacgattaacaattaaatgttttacagggggagatcagcaagacagacaaatgacagtttcgtactgcgtaataactgcgtttcatttccttccttgttcagtcgcggcgaacgcgttcacaccttggacacgatcgagcggtgcaccttgtccgaggctgtccacgtggacggcgcgatgttcgcgagacgggtcttttggcttgtgagacaagaaagaaagcgagatctttttttggtcgtacctgaaggttggggttgaggagatgggaggggagtggggccagctttgctgcggcggcggcccagctgtaccagcactactgtggctgcgttcttttcagggtagtcctcctcgttttccgttagcacgcttttcaaactactaaacggtgcatttttctgtaaaaagtttctatacgaaagttacttaaaaaaatcatattagtccatttttttaaaaaagaatagcagatacttaattaatcatgtgctaatggatcgctccgttttccgtaatcactgttgagaagaagaaagaacgcagcctgtgtaacaatggcgctatagggtttttttatgttgttttggaaacgtgtgatgcttttcttttcaagcacgattacccagttttttttttttgagaattgattacccagttttttatggcaacgtttcattggagattataataatgggtaccttaaataaatcagaattgctatatttcttgtgacaaaaattcttgtgaaagaatctgtcagataatgtacccttatatttgctcttatacgctatctttctttcgacatattttcttggaaaaatccgtcagattttgctcttacatttgtgcaagtggcatgctatatttatttcgatataaattctaggaaaaacatttttgttagattttctatcaaaatgttgtatagctctctgtaaataaatttgttgaaagacgtgcgactttcggtatataaaagtgcaacttcagtactagtaatatgcccgtgctaaacgctacggtgcaattctatatgtctttaattattttttaaaatttcatgttaccaaaataatatttttatatgatttgtgcatttaaactttaattaaattcatatcgtgtataaaatatattttatataaagtgcaatattatgatattacgtgggcacaataaaactttgcaagacttaattatatataagcaattaagtatacaatataaaaggaaaatatacgcatgaaaatatgttaaagaagtatagagtcattctattatttgttattttgttaagaaatgcacctatgggagggactgagaagaaaaagaaaataattctataatttttttcttatcttttaagatcactattggtagatagtattttttttatacgtctatattgtatttagagacgtgtagttatataaattatcgtgcacctatattttttttatggaaggaactgtcgttttttatttcactatgacacacataacatttcacaacggttttgatataaaatatttattcatctcatgcgcatcttttttctttgtgagtgacataataccactggtggagaaaccgtctttgnnnnnnnnnnnnnnnnnnnnnnnnnnnnnnnnnnnnngagattacaagggcgcc

SEQ ID NO: 29999 - DNA, 4000 bp, Oryza sativa
  unsure (1)..(4000): unsure at all n locations
nctgtcccttganaaccatcttgtgcncgcacgccngcaggtcgactctagaggatcccctttccgtgcgcactttgcatgttgggaacagctgattccaaacacagccttgattcgtttttaagatagaaaagaactaccacagagttgtagtgtgtcaagaaccggtttcctttgggtatatcatgcgtgagtttctctagttttgttgaaacatcaagcttattatccattttattggcagtaaactatcgacttgctatgttagaaaaaacttctcatagaaacgagagtgtcagcaagaacaacctccgcgtgtaggagcattccataagtaagacatgtcataattttaactttggaagaattgtacatctatatctatactaatataaaaaggatgagttgagcctagcaatgcttcaggccaaatcatcgtncctaatccctaccatccatccgcatctgcatcgcatcatcaccctaatccctaccgtccacccacatcgcatcacaaatccgcactaatccactgcaatttcaccctcccacagcgacctcatcctctctccaccgaattttttggcctgcgggctttcccccggccccaacccggnnggaagggaaatggaaacctttccttttttgggggggggttcgccctagcgcacggtgtatcgggccatcgcgcttgcgcgccatcctaaacactccccgcaaacgtcgccctccacccacccctctagattaagcccacccttcctccaagctcccaatccaccctttctcaagcctcccagggccagccgtgatcccctccaccgggccactaccgacggtaccccccccccactccctgacgcagccagtcctcctcgccgggtgcacccatcttcgtcgttgtccactctttcggcggcatcaccacccaggtgcgccacccggtcgtcattccttctaccaccgcttgaaggtgcagactctggtcacaatgcacagcttcaccgtgccccggtcactatttctctcagtcgcgtgccttccttccttcaaggcttcaactgacgtcgccgtgctctcttcttgctcgcgttgcttgaatgggcaaaggctgcttcgatccacgcagtattcacccgtcagattactttttgtatgggctcaaaccctgaacctcttttctttgaatcttggtatcaatcttaattaaggttcctcaacctccctccatctgctttggatctttccttcttaatttccagtgaataatcggtgaaaagaagaccagctctggcgcctaccaatgcacagcttgagcagagcagcgatgaggaccagatacattcgacaggcggagaacaatgcacaacggctatggcagatgcggctgagaggatgagacctcattcccgatctagctgcaagctgcatgtggctgatgcaatctcctccgcatccgtttgctgcgtctccggccctccgcagcccgcccatgcaactttggcgcatggtactctggcagccacaacaattaatttgcgtcgctcagtggtgatgactgacgaggtacacatccgcttgattttgtttatatatgttactgaatcttagctcgaatgattttttttcttttactgagcgcagtaagattgagatagatcagatcaatttctttttgctcttccaaaggccttaataagacattcaagaagctagatcatgatgtcaaatattccggacttctttggctcagagtaaatttctgccagcttatgctataacatggaataaaaatatacaataacacaaatgtctattgcaaagaaagattctcactctgcaattcttttgaatctattgtatatttgcaggggtcagattgtcaaggtacttatcaacaattcaataacgatataacaacttgttaaatctcttaattcctgcttcatgtctctgatattcagatgttaatcagtcaattgtttggaaggaattgtcaagtcaccttggggctttgcaatgttaagggtagatgtccaaaggtgtcttaggtatatagctcagttaagttgtggcacaaattatctactctaattggataaaactgcaataattatgtaaatatttatattcattgatgaactcaatagtggcttggtggcatatgatcttaaaagggccccttattcagacagatcacattgatgccaaaaatcatggtagattctcatagataatagggagaaaattaaagggaattaatggacatgtataacaatgttgcatgttattcttcaattattggagcggtccagagaaggttgagaatatattggccataataaaagagtgatggagcaatctctcaaagaatctctgaataacatcagaattcataaggtatacattatttgttgcttgattcactacataatatctagagtgttaatgccaagccatgtagtgctctactcacactatgtagtacatatactatttactcataataatttcattttgaaacttgtataggagaactttgcaaagaagcatatgactacaatgtgctgctgctcaggtaataagtttcagcatcaaatttcaatatgtgcaatgctggttttaggttcagatatctgactaacctttaccaaatttagttccaatatgaataggtgacacagacacttcttcatggttccatagcagcggcggtgcggagggtcaacaacctatgatgctatcggaagaccccagcttgctccatctaatgtgagataaagctagatgatgaatgcataancttcaggagatgccatgaacttaacacaagcctggcaagctctcatgaacttaacacaagaaagtctgctcctgatgtagggacattgggtgcagatcttcctaggctacttcagcatgagcaagcagtcaatcaacaacgccggcaacaagcgcaagctggatattgtgactgtcttaatctaattaaatcaaaattagttatttctctgccatttatttggtgttaacataaatagttctgatgtatgtccttttgtatgcttgtaaagaagagatgccatgttatcaggagatgctaatcagaactcatctcagaaggggtgtgcggctgtgctatatcaattgaaaattgctttttttttcaaaacaaatgaatgacagttaaacaataagtcgtaaacttgaaaaatcagaaaaatactacgtatgtttcttattaatgaatatttgaaattgatgttcgcaaaatactaaggaagttccatgtatgttaaatggagttcaacttcgagaagagtttttttttcgatctgaaggcccgtagtatataatcaactcaaagaaatcttaatggatgatccaacttcaatttggaaatatatggaataacaacatctttataataatacattcttattagtttcaaaacccattactctctttcaaatttgacttgactatataaaaactttaattccttctctgtttcagtgatttatttttttaccaacatagatttcatgcgctattgtattccgatcgtatgcaacaatgagctctctttttttttttgcattttttagcttgaatggggattaacatgaagcttggtttatttattttatcaccacattgaaataaatcgtcttatatacatattgcgacagcaaaatattacgttgatgccatatgtaatatgaaaaacgtgccttgcacgtgcatgattactagtttttttaaagtcactctttcatgactgaataaactaagaaacatcataaatccttctttctagtttccaaccctcgtggttctgctacactttttgcttctatactaaattagntacgtctagggtatgcttctatgatacaaagtgagcgaggctcaactaaagaatgccttgtacactacatctttgtcaggaaggatggacaccaagatggctttcatttgaaacttatatgcatatatg

SEQ ID NO: 30000 - DNA, 7314 bp, Oryza sativa
  unsure (1)..(7314): unsure at all n locations
cgagacgcccaacagttgccttcttgtttattaaccgccgaccgggggagtttaattcttgagggtgcaaaatctcccgggactctttggggttaccaaattagggggccatgttgaggccggatatgccttggacacaaaaggggggccacaaaaaagaaaaaatggtccccaaaatttatctcatcattcggtcaacaagggaatagggagccggccttttggggcgggaattccacagcaccttggggcggcgggttaaaagaatttaggttttttacccccaaccggcaatggcgtatcgttccccagtttgtggaaaaagaattgtctttcataagcggggtctcgcaggtatgaatcccaccctaaagagtgttattttaccaggcccccacatccatgcctatgggaacaacctcggataagagaggttgtgataaggaaagcacccgatgtctatttgaaccgaaaggcctgctcgattgtaccaaattggttccatattccacttgccaagggacccttatgggtataatccaagacccctagaggaaaggggaccgaccactcattcacaccaccccaatcaacatacacgaacaatagaagccacaacatcaaaccaacatacccaagacaagccgcgggatatcgccttaggaataagcacggctagtcccttacggtgtctctggatactgtcaggagagacgaaagtgctatctctgacctcacggggcatgacttcgagagggaagactaccctgttgtcgattacgagtcagacctacagcccgccatgtcgacaccagttagataggctcccccaaatattgaccgggtgtgattatggtgaataagagcaatacgggcttcggccaacagaatgtagggttattccttgacaattcaggggcccgaacctgtataaaaatcctcgcttctgtctcttttacctcattctcacgtatgtcctagtaccgacgatccccatattatgcaaataccggaatcgcgacttcaaacgtcgactgaaatcatatcttgatgtcgcttgaaacaacatatttgcatgaagtgacacgtttggtcgacaagcgcatgtcatattcacaatgatcatgcatatgcggcctttcatatgcgcttattttagtagtggatgaagaatcaatgtgcattgctacatctttacgtgcgttttatggtctatgattttgttgtagtggatttagtatttgccatatgtgcttcgtgtttgttcttattggaattaaaggatggacatcttttatacactccatttatatcttaaagacaaagtagcttcggatcgaatgtaagcacacagtaaaattgtagagtaccaatgatggtaattagttacgatgatgtactacgatatatcaccctgagtttcacatgtcaaatatgatgatatctgagtttatttttaacttccgaaccactgtaatgttaaaactcagtacaatacaccgccaagggtggtaatgctactaggtgcactatagtacctagggtagataccatatctagatggcaagttcaaagccaacagagcttgagcttgagcttgacccagattccgatcaaagtagagatcatcaaactgctggagttgtagctgctgcgctatggcctgaacaatgttaatatcttgatagtgagactgttgcgccaccagcctgagctgttgccaaacttggttgtttttcagctgaaacgcagctgattgcaataaggggcttgctgctatgccatactgctgccttacgaactcattatatgggctaagcacatgttgctgtagcaggagaggtgactgcagctgatattgcctataactttgacctaaaacatcaaactgcgcagaggcgctgcatgcagcaatagcaagaagagcaaagatgaaaatgatcttcattgcgacaggacactagatctttcttttttactgtataatgcttgaactgtgtgaacgatggggagggttttcattgtctatttatagatgcgatggcacttattttctttcaattcctcattggttgctttggagtgctagttttgctttcatgtcctattaggatccaagtgagtcatgtcatttggacatatgttctattaggtgcctcaacaaatcccctttgatttcatcacgaaagtaacttttgtgtccatcaaatatactccctccgtcccataaggagaaacccacttctagggatgaacctagacaatcatttgtccagattcatccctaaaccctaaaccttgtctaggttcatccctagaagttgtcattttttgggatcggaaggtgtacatgttggttagcaggctagaaaaataatgatatgacacatcgctcactttatacgttagtttggtaaggattgcaaccgttatctagctatattcgttatgttttgtgagctattatttcactaatgcatgacacgttgaacattaaggtcgtgtggcctcatgcattttatattacaaaatttcaacaagagtgacaaaaattatggtacaccaagtgctttttattgttccgttgttgtggtaccgaacatttgattttacagcaagaattaggtttgcactgaattcttaaatcaccattcgagagatttacgagaaatcaccattttgctatacctgtagtgcaggattgacgtaattcgtattcttgtaaaccaacttgttacgtgttttcttgtctaaactttttggatagacttgggctgtgttcggaatccagggttcccaacccatctccatcgtattccgcgcgcacgcttttcaaactgctaaacggtgtgtttttttgcaaaaagtttctatacaaaagttgcttaaaaaatcatattaatccattttttgaaaaaaaagctaatacttaactaatcaagctctaatggaccgccctgttttccgtgcgcactttgcatgttgggaacagctgattccaaacacagccttgattcgttttcgagatagaaaagaactaccacagatttgtagtgtgtcaagaaccggtttcctttgggtacatcatgcgtgagttcctctagttttgttgaaacatcatgtttattatccattttgtttgcagtaaactatcgacttgctatgttagaatgaacttctcatagaatagctagtcccaagaaagggactagctagtgtgctgtcgacangtttttaggtccagaactgtcaaatttttcaaccataggatttgtcatcaacgattacaggaaaacagtctgcactagtacaaaccacgagtcttagtgcccaaattgataataactttcaattcaaaagtaatatgcatatatatgtccctgaaaaaaattacaaatcctaattttataccatgtaattaccctgtaactactctagttggtgtaagtgctatgtaactaactagagtatgtaactagagtataagtgttatgtacctagggtgtaagtgatatataactacaaatgctattaataatcagaaagtgcccgtacctcagcgtaacgtgtggcaagtttgatggatagatcctagctcgttcaatgcttgtctagcccacacgagattttttttattctacccatatggccgtatatgttgcacgaatcctggagtgcatctaatggctagaaaatcgaaagttttctaaagaaaaaactgtcgccagttttttagcaaaaccgttgtttcttttttcttttagttacataaagagacaaaaaggagatccaacgtcccacattgtttcaatccccgggacttagtatattttgcactacttgacgagctctatacatccatggttcctgatcgcctattcgaacaacggtttaaaaaaattgaacttttgcgcatttgttctaatattccccgaaatatactaattcgaaactcggggcattacacaaccttagtgtgtaggagcattccataagtaagacatctcataattttcactttggaagaagtgtacatttatttaaagtcactctttcgtgactgaataaactaagaagcatcataaatccttctttctagttttcacccttattgttgctgctgcacattttgcttctatactgaattagttatgtctaggttatacttctgtgatgcaaagtgagcgaggctcaactaaagaatgccttgtacactacatcttgtcaagaatgatggacaactgtcacgcccagaaattcacgaaccagaatttctaagctgaatgtgcattaaacccatgtccagaaccagccagggtatacaaacgacaattgttgaaatacagatccacgttttacaaaaatataaaagattacaaatgcagcggaaaagatgaaagccagctaagcctgaagacttgactccacatgcatctttgacggcagcgacgaaaccaatttcttcgagacatctccaactaagaagaacttcaactctggtgtggggaagagagagcaagactaagtacttcccactgtactcaacaagtcataccggaagaggaggtatgatgcaagatataaccaaaggaggctagcggttcatttgcataatgcttgcatttaaaagcagtagttgaaagcagtaaaaacagttgtagtatttaatcaatattaaccaatcactgctcaacactacaccacattgagacaagcccaaaccaccacctgaactaactagttacattagctaactaggggtgagaataattgtcggtgatatgggcctgaggatatgagaagtatggggaagtctcaatcccgtccagccacgcggccatacagcctggccctccccccacatctcggacgacgcagaggcagccagggggcctcggggtgccacgtcacgcccctttgaccctcaggctgcctcgccccgaggccctcgcccggccgccacgtggcggggggagtgagtggggcggtggccgaatctgagccgccatcaatgaatagcaccccaaccgtcccacaccgcatttaatgcggtgagggcggacgtgcggcgctgcccgattgacccgcgtcaatcgggcgtgaccggtctgtggccgatcacatccaatcggacgggcggcggtgcccccacgttccgccctgtgctcggcggagtgggggcaggtatgccccgtcccatcaatgcatcgtctagagccccctccacgtgaggtgaaccgccaaaagtctccattcacttaaaggggaatgacaagggcgtcccccgtgtcaggcaggggacggcgctgggccccactcgaggacggacggctgcttagcttccggtgaaggcacgaatggtggtccgctccaagcggcgtgggccccctcccttgaaggagtaggtagaggcggtgcatgtggtatccccttgaactataaaaggaggaccttgcccactgaaaaggggggatgactctcacttagcctaagccccagaggaagaagagtaagagttctccctggagtttagaaacctttgtaacactcaaccctaaatcccacgcacaggagtagggtattacgctccctagcggcccgaacctgtacaatcccagctctcacacgcggtctcgaaagactctaggcagatatacgttcttgatcagtgcgccctttcccccggccgaactcacaaaagggggtccctcaatcacccgcaagagaggatcattcctcgacagctggcgcgccaggtagggggaattcgcgcgtttgaaagagaaatcgtttccttccaccacaagtttccctccatcctcaacgatcatggtcgaggtcctagaggaagaagtggtggcgcacacccctactccctccgggagtgacgatgctagcgggagccgcggcccccaccaccgtcgcaacaactctcccactcctgcccaccgcgacccccccacagagggaggaacctctccccgccgccgcgcggggagaaaccgcgcagtgtcggggcacggggccgcctgacatacggcaacggcggctcatcccgaggcgcactttaggcggcgggagcccttctacggcatccccccataaattcggagccggagacccctgtccagcgatggttggacaacatgaccaacctggtcaccactgcccagcggtagcaggctgcgggtggccgacccgccgcctctggtacctcgcgtaacccaccgctctttcctcgtcagcaagaaggagggcccgtcggtcggccctgacttcgaggtggtcgacggccccaacgtcatcgaggatctcgggaagccggggacgtcatggtggcctctacgaggagggacgctcgaatcaacattgagcaacacagggacgagcactgggcggcccgcatggggagggcgccttctcatccggagtgccccgcttcttcacgcgaggcggcccgcccctcacatttaccccttggagggaccagttgcagggcctttcaagcgagtcttcaaaagtccgttggcccccgaagtttccccccaacctcacggagaaatatgatggcagcacgatcatcatgatgcggggggcgacgactaggtcatggcgaatacttccccatggctcttaaaggtcaggtgcgcggctggcttatgactcagccccccgactccatccactcctgggaggacctgtgccagcagttcattacgaactttcaaggcacgtatccccgcccaggagaggaggcagacctgcacgctatacaacggaaggacgacgagtccctccgctcatacatacagcgcttctgccaggtccgcaacactattccctgcataccggcccacgcgggcgtttatgtgttctagaacggcgtgcgacacaactgcatgctagagaagattgcctccaaggagcccaagaccatcgccgagcacttcgagctggcggacaaggtggctcgaaaggaggaagcgtgggcctggaactctcccggcaccggcgcggcggctgcagctgcccccgagcccgttttcccccccccccaagggggaagaggaagccggcccactctgatgacgagggccacgttctttgcggccgatgggccttttgggccccgtgcaaagaaagagccacccgcaacaagccgagctttttccaaattaaacccccccccccccctttcccctctggggggggtaaaaaaaaaggggggggcggtttgcggataaggggggtcgatgcacaccacctattgggacaaaatgggaacaaccttaccgaatggagctgggcaggaaa

SEQ ID NO: 30001 - DNA, 3750 bp, Oryza sativa
  unsure (1)..(3750): unsure at all n locations
agtcggtcaggaacttgcccgagcggtaccgaaaggccgatgaggagaagcggcagagtcaacgggagggcaaggcccccgcgacccccgctagcgaccggcggggggaggccaataaaaaggcccccgccgatgatgatgatgacagcgaggacctggaattccagatacctcagggaaccgtcgccactcgcgacggggggtttgcgctcacacctcccgccgcagtttcaaggccatgaggcatgagcttctggccgcgatcccaactcacgaggcaacatggaaggcgcgctggtcggaagtgaaactgaccttcgaccagagcgaccatccgacggtgctcgcttggggagggaagttggccctcgtgatctcccgaaccatccacaacatcaagatgaagtgtcctctagtcaacgggggggccggcctcagcatcatctccccggctgcctttgatgcccttaagtccccggggatgaagcttcagccgtacctgccgatcatcggcgtgaccccgggacacacgtagcttctgggtcacgttgagctcccggtaacctttcgtgactctaccaacctccgcaccgagcgggtcgacttcgatgtggcggatcttaatatgccctacagtgcggttttgggaggcccgcgttggtgaagttcatggccgccacccactacgcctacctccagataaagatgccaggccacagtggccccatcaccgtctttggcgatgtcaaagtcaccctggcttgtgcagagcagcgcgccgataacttggcggcagccaccaagccgcaggccccggagccctccacaccccgcgcctccaagaggcgcctcgcctcggccgacgagttgcccgtcaaggagattccccttggcgatgatccatccaagaccgccaagattggcagtaccttggacgccaaataggaaagtgtgctcgtctccttcttgcgggcgaactccgacgtcttcgcgtgaaagccatcggatatgcccggggtccccagggaggtgatcgagcaccgcctcgcagtgcggccagatgcgtgacccgtccagcagaaagtacggcaccaagccccggagcggcaagccttcatccgagaggaggtgatgcggctcctggaatccgagaagtcatccacccagagtggctggcaaacccggtggtcgtctcaaaggccaacggcaagctccggatgtgcatcgactacacggacctcaacaaggcatgccctaaggatcccttccctttaccacgcatagatcagatagtcgactccactgcggggtgcgaccttttgtgttgtttagatgcctactccgggtatcactagatccgcatgactaggaaagataaggaaaaaactgctttcattattcctgtaggcaccttttgttatacaactatgctttttggtctcaagaacacaggccctacattttagcgcatgactcgtattactttgagtgatcaaataggcgtaatgtagaggtgtatgtcgatgacttggtggtaaagacgcgccaccaggacacgttgttgcaagacctagctgagactttcgacagcctcaggtccacgtgcatgaaactgaaccccgagaagtgtgtgtttggtgtgccggcgggcaaactcctcggtttttttagtttcctcatgaggcatagaagctaatcccgagaaaatacgcgcgatagagaggatgcgccccccaacaaacttagggatgtgcagtgcgtcacgggatgcatggccgccctgagtcgattaatatcgaggctgggaaagagggcgttgcccctattcaagctcctcaaacgctctgggccgtttgtatggtcggaggaagcggagcaagctctcagccagctgaaagcttacctcacctcccccctatcctagtggccccgggaccagaggaaccgttgctgctctacttggctgtgaccccccattcggtgagtgccgcccttgtagtagagcgtgacgaaggtgacctgcgtcgcgagcccggctatgggaagggaccaggggtccccttaactagtgatggcccctcgtcccccaacagcccgatgcccgaagcccccaacccccgggaaggccctgaggtccccgtgggagagagagaggccccggcggacggccccgaggcctgtcgcactgacgtggctcgagaccccctcggggcccccgagcacgggcgccccgagctaggttgccctaacgacaaaggtcgaccccaccgaaaggtgcagcgccccgtctatttcatcagctaggcactccgagatgcgaaaacctgataccctcaggcccagaagatgctttacgcagtcttgatggcctcaaggaaattgcgccattacttccaagcgcatcgggtttccgttgtaacgtcttaccctctcggccagatcctgcacaaccgagagggcactggtcggatcgtgaattgggccatcgagctcgctgagttcgatctgcactttgaaccacagcacacgatcaaaagccaggttttggctgacttcaacgctgagtggaccccggcggacgactctattccgtcccatattccctccctccccggagatggagaagacccgaacgccgatattcgcaccggacattgggttatgcactttgacggctctctcaaccttcaaggtgcagggaccggagtcacgctgacttcgccaagcggggatgtcctcaagtacgtcgttcgacttgatttccgagccacgaacaatatggcagaatacaaaggactcatagcgggactgagagcggcagccggaatgggcatccgctgcctcctagttctaagcgattcccaactggtcatgaaccaggtcttttggcccaacccgctcttttggcccttcgcggtctggggtctagacatcctagggcccttcaaagcggccgaggcgggtaccagcacctatacgtcgccatcgacaagtttaccaagtggcccgaggcttacccggtcgtcaagatcaactggcattatgccctcaagttcatcaggggcatcacatcccgattcggagtacccaaccgtatcatcacagacaacggcacccagttcaccagtgagctattcagcgactactacgacgacatgggcatcaagctgtgcttcgcctcgctcgcccaccccaagagcaacggccaagttgagcgggccaatgccgaaatcctcaaaggcctcaagaccaagacgtacaacatcctaaagaagcacgggtattcttggctcgaggagcaacccgcggtgctgtgcgcgaatcggaccaccccgagccacgccacgggggaaacgcctttttccctggtgtacggccctgaggcggtcctatgctcggagctttccctacgtttgcctcacgtcgcgctgtacgatgaggccaaccaagatgatcttcacagcgatgacctcgattatttggaagaacggagaaggcgcgccgccctatgtgcggcgcgctaccagcaaagcttgcggggctaccatcagcgccacgtccgagcccgatcactacaagtcagcgacctcgtcctacgccgcatacagtcgtgtttagggctgagcaagctctcaccaatgtaggaagggccatacaaagtgatcgggggtccccggccgggctcggttcgactaaccatggaggacggcacggagttgcctaaccccaggaatatcgagcatcctcacn

SEQ ID NO: 30002 - DNA, 2783 bp, Oryza sativa
atcgagcatctccaccgtttctaccaataatgtcgcgcgttttttgctttcttggggctcgggcaaacccccgcacactcctcagcctgtgcgggcttggccgagggctaccactgttaaatatgttgtatccaatccctccctcagcaataaatttttctgcttaatcaaaagctgttgcgcgccctttcttactccttcctatggctcgtcctggcttaaggacgattcgcgcttgctccggaccctaagtggcgttggataacctgaaaataaccgaaggggagcctgaacgcgggccgtgccccgggctgcagcgaaccctaggggctcggaagggcctacacatggccatccccgacccccgatcaccgtggcctcggtctggttagtcccgctgggcggctcccctggagcgacggccttgcccctcgccacctaagtgtcgcggaccaagtgcaaattccccctttttaccggaacgagcccgaggggcgggacaaagggagtaaaaatggcaacttgatcgtaaagaagtcaactaaatgcgttcgctttgtttttttccttgccgcaggcatttagaagagaaagcaaggatgtaaaagtgcaaaggagaagctttatttacaaccaggatggcacaatggcctagagtttcaagcgttcaccacgagcacataacaaaataaaggaggagaggcgggggcaatcacggagtgcctgggcctccaagtacagcgccgctgaccaccttgtcccaatcctcgttgccatcatcgccgccgccgtcatcactcccgctctcctcatctgagggaagcgcgagggtgaaccaaggggccgtcccctcaaagcttgagatgatcacgtcggccgcgtcccgaacttgctcctgagccctcgtctcaatccctgggggaaatcctcgagcacgtgccacggaaggatgttggggtcgcgagcttgatgactcgcgaggacaagctccaccgcagcccgtgccaaggaagccgatgacgacttcacggcttcgccgacctcctccttcagcctctcgagatccgccgccatctcgtccagccgaagcgcgagcgccggtcttgtgggcaggagcttcttgtcccggcgcacggagatgcccacccggcgtcccacgcactccagccgttcgatggcatcgtagagttggccaggcccgatgtcgttggtgaggtggagggccgcgatctccccagcctggttctgtaccagacaccccaggttggcgagagtatcttgggccgcggtgagctggctgaccaactcggcgtcgccgggctgcccgcgcgctgccagttccttctccctggcctccagctcaagcgccctcgccaccatcgccgtgcgctcaacacgggcgctttccacatggcgggtctcatgcccagcaacggcctcctcacatttggtgagctgctcgcctagccggcgcgccgccacctcgcggcggttcacctcggcctcacgctcggcgagcgcggcatctcgttcccgccacgcctcctctcggagccacagctcctctgtgcgacgggccactaaagcctcagtggcaatggtggtctggttgcgctcggtcgcggcctcctcgcggaggcgaagggaggattccgcctcggccgctgtcgcctcgtggacggccaaggtagtctcgtgctggtccaacgcgcgcgcccgctcctcaagcgctagggcccgctccttcagctcctgggcccgctgcgcctgtgcccgaccgcaccccttctgttcgcgttggttgcgatcgaggacctcgatccgccggcgaatcgtggcctcgaactcctgcgcgaagcgggtgcgctcgtccaaggccttgcgctcggcctcaagcgccaccgaccgggcccgcagcgaggcgttgaccttcgatgcccgccgaacttgggccgcggccgcgtcgaggaccccgcagggcgttctcaaccctctttggcaggaccttggcgtaagcctcatactgcaggcggatgttgcccagcacctccgctaaagcgcttgatgtgatgagcgccgcctggcgcttctcctccgtcttacgcatgaccgaatcaagcgtctcctcgcgcgcctggatcttctccagctgggcttggtgcattttgcgccccgtctcccttgggggaccccacccttttggcggcgggggcgggttaaattttttgacccacgggtgaggtggggtccgggccccacatttttggggggaggggactggggaagccttttaccaggggtgacccgcggggcctccggggatgtaaattcaaccctaaaatgtcgaccatggcaaaccccaaagagctcaatccaacaattggcttgcaattaaaaactataccctatccttatcctctctcctttccaatctcctcttcccgtgacccatacacacaaatgcttgtggtaagttttctccataccttggcaaacatattggttttgaagcacttggcgaagtggatataatggtatctcataacccttgataatcataaaaccaacattttccacttccaaaactggttaccagccttctataaataatccaattgtttgtccccttttgctcatttcccgcaaattggggatttcggggggaaaaaacccccccgctcatacaccccaatgtggtgggaaaaaagttttttataaacagcgcttttcagtgtggaacaggttggatagccccacccttcctgggtcttcaagtctttggt

SEQ ID NO: 30003 - DNA, 9764 bp, Oryza sativa
  unsure (1)..(9764): unsure at all n locations
atgtnnnnnnnnnnnnnnnnnnnnnnnnnnnnnnnnnnnnnnnnnnnnnnnnnnnnnnnnnnnnnnnnnnnnnnnnnnnnnnnnttgttgtgaacgatttggggatgaactattgtgtgaatgatttgggatgaactatattgctatgagtgatgaatgtttgatctgagatgatttgggcaaatagcaaaagaacagttaaaaagaaaaagagaaaagaaaaaaaatgaaaaaaaaaccctatagtcgggaccacatttttagaacaccaaccgggactaaagtcccggattcgccgtcccggttgcataaccgggacaaatagatggttgccaaccggcggcaaaatcggttgtgcagcagtgaaaggcttcaacccaagcgatacaacttcagcttcacaggacaactccatcttgacccaacagaactcagtcttgctgatgacagtgcagtgctgtagacgtcagttcttccgcacattgttccagtttgatttgatcctcctggctttgtaaacctgaccaatataagagggaaacaaacagatgaaacacaccatatcaggagacttgatcttctttatccttcaaaacatattacgggccggcttcctagagggcccaacacatggcggccaatcccgcaatgtgattttttttttccatttggtatataaactatgccctgatcaaaaaattgctcgaaagagtgggacggacatttgagctccaaacaccataagccattaaccataaggctccaaatatatttggccaactcacagtaaaaaaaaaaaacaggtcgttgacagtctccttttccttgcaaaaggcacaagtttcattaccattccagtttcgtcttacgagattatcttttattaatattgcattgtgtacggctaactaaatttttttttatctttaatggtagtttagctttcaatgcaatttatatgatgtggccatatacagctgtgttgtcacatcctgattttttttcaggatttataaattatttaataaattattattagaatttatattaaatgttctttaatttacaagtgaagttaaatgtgggaaataaaatttcctaaatataaagcatggatggatttaatttttattaaattctccatgattaattacactctctgaaattttctcggatttttcagagctcaattcctaaatgatacaaagaacagttcagtaattatttgatcattaatgatctaattataattgttaggagcttttcttgtttaaaaatccttaaattataaattgttgtttaaaaggaattattagaaatgatcttaaaagcctaaaagagaagatctaattttaattaataaattccaatataaaatagggccagataaaatttcattaaatactttacttgattctaaagttcctagatttttctgggatttatttgagccaaggaagtatttttaatcaatggaatatcatttcatgaataatttaaattgaaaaaggtttttaaaagtctcttttggctttgggccgaaagccggcctaaaacctctctctttctctctccctccccggcccagtcggcccaaaaccgctctctctctcctccccggcccaagccggcccgcatccgagccgctgctctcctctctctctcccgctgacaggtgggccccacctgtcaggcctgtcttcctcctcgcgccggccgccgctcgaaccctagcgccgcgccgccgtcgtctccttccaaatccgaccgtctttttcccaatccggtgaaatcaatagaggggaaatgatcttctcaatctcctctaccttttctcttttggaatcgtcggctaatttcgtttggaaatccgtggattcgagtttgattcggatcgacttctctcctccgaaccctagctttccttctcgccgccggtcgccgtgggcctccgtcgccgctcgctagcccctttataagcacccccgagctctcctctatccgccgccacctttgccttagcccgccgtcgcgtctagcgccgcctccgcgcagccctagccgtcgccgtcgttgccgtcggttcagccgcgccgcgtcgccgttgcagccgccgtcgtcggtcgtcgtcgccaccatcgggatcgtgaggtcgtcgtcgtccccgtccaccgcttcgccgccgccgaagaccgccggagcaccgccatcaccgtcgacccgaagaccgtcgccgcttcttcctcgtcgccggcgccgtctgttgctcttccgccgttgttttggtcaccggtgagttcgccgcgtcgccctctacccgttggtgtcctccgtttgcgtcgtcgcgccgtcgttcgccggtgagcatgcgccgcccgagccgtcgccggtgatgacgtcatcgctgacgtcatcgttgccgttcgccatagaccggtcgtagaccgtttagatctcggccgttcgttgtggatagggtagatctcggccgttcgtttccatgagccgccgccgtgcacccggtccaccgtgaacccgagcccgctgacgcaataatcctcttttccttttcaaaaataattcattattgcgtcataattcaattaaaatctatataagtgttttaatccgatttaatctttgaaaattcataactaattctttgtaactcagtttaatgtggttcaagttgcaaaagttgtgtaaaataaagatctacgtattaaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgagtactttatatgtactgtttatttggtttttattagtctttttcttcgttttgcgtgttagcttgtcgtttccgtcgttgcgaaggttcgcgagtgcgccggaagtattcaagaagactaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgattactttattccttgataccttgggttattataacttgactatttgagctttatatattggttcagctagatattagatatgattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataaggggatgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgctataactggtaataatttgtttagctcctggtttggagttagatctgtacggccgggtatggttgttcagaatggttgggcctgtgcagcatgggtgtgttgttcagtgttgattaaaatttctgattaattactccactgttttacttctcttaaatgttttgctaaatgctgcttttgcaaatgagcctatattatgccatcctttggtatctttgtgcacttgcatatttgctgtgtggcttgttgagtatgtcatatgctcattcttgcaataatcaatcaacctcagttgaagaaaaaggatccagaaggataagacgtttggcttataccccagttgagctgcctgtgggagtggagctgaagccatcgctagaccgttattccgctgctggtttcttttcttttgtaagtgtgtaacgttattattatgatggatttatatattaaattgtcagtttgtgtacctcggctgattcctggacgaggattttatgcacaaataagttcggaaattactagtgaatttccgggcgtgacatgtgtgaagatggttgtacgttgactttacagaaaactaaactggccactggggctcctgtcacgcccagaaatttgacttccgtcaaccagaagtcacacttgctgaacttggcgtatagctggtgctccttcaacttttcaagtaccagacggagatgttgctcatgttcttcctcggattttgagtagataagtatgtcgtcgatgaacaccacaacaaacttgtccagaaattccatgaacactttgttcatcagattcatgaagaatgcgggtgcgttggtaagtccgaaggacataaccgtgcactcatatagcccgtaccgagtggtgaaggccgtcttcggaatatcctcttcccggattctcaactggtggtagcctgatcgcaggtctatcttagaaaacactttagctccattcagttgatcaaataaatcgtcgattcgcggtaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtacggtctcttatagattggagcagttcccggtgccaagtcaatccggaattcaatctctctcttgggtggcatggtagtgaggtcttcggggaacacttctggatactcgcagactatgggtatatcttccaattttctcaagttcttctctacggtgtccactgggatttccgtctcaatctaattcaacgagacccctttctttggcgagactagagatttgtacaccacggtttctcccttctcgttggtcaaggtgactgtgcgactcgcacaatcgatgactcccttaaacttggtcagccaatccatcccaagaatgacatttaggtctttggattcgagaagaatgaggttggctagaaatggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcactagaatcaaaaagtactgttgcagggattgagttaacagggaacgtacccagtacgacctccggtgctgcttgtgcctcctctgcagatgcgtggttgacacgagcctggataaaccttggcccggcacgcctgggcttcgggcatttgtcagcgaagtggccaagctcgtcacagttgaagcaggaccctggttttgctcccgtctccttcttggcttgcgcgggctggcctgactgtgccggtgccactgatgggcgtggagctgcaccgcggttgggctgacctccatggtggttctgactgccactggtgccctggtggaagttgctagggttgaacgggcggtgctggcggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtccaagctgacgcgggaccctgaagctggtgtgtggcaaaagcgaccttctcctgatcattacactgcaggagattcagcttcttctctattgcatggagccagtcgttcgcctccatagggttggtggtgctggagaaggtgggtggcctgacgcgtagaaactctggcaacttggactgagggggagggggaccaaactgttgatgctgctgttcggcgtgctgcatcatcctctggtgcatctgctggtgctgctgctgcatctgctgcatcatggctgccatcatctgagtctgatgtgccataacttgggcaagcgtcggattctcgggaagtggtggcggaccattgccagaatcactgttggggtgcacaccatcagcgcgttcttcgccgttgctgccctcgcctgttgcgcggctaccagtcctggtgtagaccatctggagggaaaagcagacggggaaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagaccatcgataaactaattggaaaacgagactaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtgccactggctggacccctggcggctgatgctggagcgaaggagagagtgaacgcgggagctggaactggagctgcaggaactgcgggcggaactggaggtgctgcgggagctgttctataggctcgtaccgttgcatcctttaccaataaggaggcaagcactcaagtctcagtaaatcaagaaaaatgtgtagaatccattaaaaatggttttgttctctgtttcagtagtcttatagcctgtttgcaatgtttgctttgtatgccgctagattccgatccctccgacgctccggtgtacttcgagatagtcgccgaggttcccccagcagcagagcaaggcaagtcatgcttgtcacttgaacatgttgatcctatattgcaaatgctcaattgtttcctttcaaatattgcattgttttataatattactatgggatggttacctattgttacagccatgctttttggataccatgctcctttgttagcttgggttataacatgattagagtttggactaggaattgcttagccttgcttagttcaactagatcacaatggggaaaatcatattaatgtttagactgttagttctaatggtaatgttggtttaataccaccgctctggtgttggttaaataaaatgaaccacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgccggcgcacggaaacgtgtcgtggggctgtgtcttgtgggtacagttgtacacctctgatcagagtaaaactattcgaatagccgcgcccgcggttatgggcggtcaaccagattcaccgtgattagaatcacattagtttagtctaatgaatttggatggtataggtggttggttgggcctgttgcaacgtggtgtagcgttggacagtggatgattaatactgcttaatttttacaactgtttaaatctttcaatctctgtttataaatgctcgctttatgcaaatgaaccactttagctcttctttgatgattccctgcatcatacctctattccggtatgacttgctgagtacagtgggtagtactcagtcttgctctatttttcccaaccccagagttcgagttcgggtcagatgaaggtttctctgaggagtaggcttcgtccgtgccgtcgaggatgcctgtggagtggtgttcccgctgcagtttagtcaaggattagctccagtttcttctgttttccgctgcatttatgtaagactttacgatgtttgtaagacgtggatctgtatgtcaacattgtcgtttgtgtaccccggctggtcctggacggggattttaatgcacattctgcttggaattctattcgggaatttctgggcgtgacagctcccaactccattttgcttcccaactacagcaagaagccccaaggcttgtcatcaactaactcacaacagtgcatagtgatccttgagtactactctaccattgcattgtatcctcattatcaatcatattctcctaaattaagtacactaccttggtaagttgtaatataatctcagtagtttggtcacacagaccatcctaattcctaaaccaaggaatattattatgatccgaccttagatccttatattgtgttttcacacccatattgtgctacattttgctaggaatgagctcaccatttattggatgtggatttgctgccaatatattggcaaaagcaagcttcggtaaaccaacatctactccaaatgtaacagtgcggtgcaacaaaattcacctgagctttgttttccaaccatgcacggcctgcagcctgagttttgttttcaactcatacagcacaaataaggtatatataaatttccccagatatcacagcaaattacctgtaggcttaagatgtttggagatcccagtggaaaggaagcaacgcataaaaccaaggtgactcatgctatgaagtttctccagttcttcgagaacacgtgccctcatgttaagagtgaataccatcttggctgctccccttgtggtggggagtggtatacctttttcttccaaattcgatgcaaatagttgtgaaaaaatctgaaaaaaaaattgacaatgtagagtataatgatacctactagtccaccaaaattcatgttcaaattcgatctacacatcgagaaacaaaaaagacaaatttagatataaacagtactctactattcatacgctgaatttgtcttttttatatctcgacgtgtgagttgagtttggacttaagattttgtgaagttgtatatatgtgttgtatgaatgtnnnnnnnnnnnnnnnnnnnnnnnnnnnnnnnnnnnnnnnnnnnnnnnnnnnnnnnnnnnnngagacgtgtccatcaatggngccgt

SEQ ID NO: 30004 - DNA, 21942 bp, Oryza sativa
  unsure (1)..(21942): unsure at all n locations
ccccttattagtcgtgccaaatttcaaccaagcattatctgtgtctttaaggcccctaaaaatccgctgaatagctttccagtgttctttacaaggattagccatgtatctactaaccaaactcatagcatgagataaatctagacgggagcaaaccatggcatacatcaaagaaccaacaacactagaatatggaactctagacatgtattctacatcctcatcagtactagcacattgtaaagctgataatttaaaatgaggtgcaatatgagtactaacaggctttgtatcatgcatgttaaaacgctgaagaaccttcttaatgtagctttgctgactaagaaataaccaaccggaatttctgtctctagtgatttccatacctagaattttcttagcagcatcaagatccttcatatcaaactcactactcaactgtttcttcaatgtagtgatttgttccttgctcttggcagcaatcagcatatcatcaacatataacagcaagtatataggtgacacattaacaaatttaatatacacacagctatcaaattcagatctcttgaagccatgtgacaacataaatgaatcaaaccttttataccattgacgaggagactgtttcaaaccatacaaagatcttttcaacttgcaaacataatcctccttaccaggcactatgaacccttctggctggtccatgtatatctcctcctcaagctctccatgtaaaaatgctgtcttcacatctaactgctcaagctcaagatcatgcatagcaacaatactgaagaatgtgcgaattgaactatgctttacaactagagagaacacatcattataatcaacaccagcaatttgactaaaaccttttgctactaaacttgccttaaacctcggagggtcgctagaagataaaccctcctttctcttgaagatctatttacaatgaacaggcttcttctgttttggcaagtgcacaagctcccatgtgtcattcttctcaagagactgcatctcctcctgcatagctgagatccacttctcacggtctccagaaacaacaacttcagtgtatgtggctagctcaagagtattctccacctgttcagcacaaataaaagcataataaaccatatcacattcctcaataaggcggactggagctccacaactcctctttgttctgcgatgtgcaataggttcatcttgtggctgcaaaacaggaggtgagtgctgaacagtatcattaacatcattaccaacaatttcagttttctgatcatccacgtgctccacctgcacgctaacatattgctgctcctcatcaaaaccacctggtatgacatctgtgggcaagctgtcattaaacataacagattcattgaaaacaacactcctgctcatgaatgtcttattagtttcaggattccataacttatatccttttactcctgaaccataaccaagaaacagacacttaatagctctaggctctaattttccattattaacatgagcataagcagtgcatccaaaaactctcaactgtgaataattagcaggcataccagaccatacctcaatgggagttttcttattaagtgagatagaaggcgacctgttgatcaagtagcaggcggttttagcagcctctgcccaaaaacgtttgttcatgcgggcgttggacagcatacaacgagccttggagatgatggttctgttcatgcgctcagccacaccattctgctgtggagtgtacgggatggtgtgatgcataacgatgccttccttcctacaataatcatcaaaagcatccgaacaaaatccaccaccattgtcagtgcgaagtacttttacctccttttcagtttgcctttttatcatgactttccactctttaaaagcagcaaatgtatcatctttatgtttcaggaaataaggccacacttttctagagtaatcatcaataatggtaagcatataacgagcaccaccaagagatggcttacgggaaggcccccacaaatcagcatgtacataatcaagtatacctttggtgcgatgaactaaggtattgaattttaccctcttgtgcttaccaaaaacacagtgctcacagaacttcatgttaccttgagtgcagccatccagcaggttctttttcatcaattctgccataccaagttcactcatatgtccaagacgcatatgccacatgttagtcttactaggttcatctttagaaacaacagcagcagtaacataaccatgtaatgtacttcctctaaggacatataagtttgcagaattcatatcaccaatcatataaacgagagaacctttcgatacctttacaactccacctgacccggagtatttgtatcttttggcatcaagtgtgctgagagagataaaatttctcgccatccttggtatgtgtctcacatctttcagcgtgcgtgtcatgccatcgtgtgtcttgatctgaacggagccaatgcccacgatctcacgtgggttatcatctcccatgcgcacaacatctccattctgcacagacttgtaagaactaaaccaatctctgttaatgcagatatgaaacgaacatgtagtatcaagtatccattcatcatgactagaaacacaaacaacaaaaacgacaagacaatctcctgaatcagagttatcagcactggtaacaacagaggccttaccatcagatttccttttctccttattctgcagcttccaacattcttcaatgaagtgatttttctttttgcaatacttacagaactttttacctctagacttagaacggcctctactctggttcttgtcacgatcattgctgtcgttgtaggttctctgctcagatctgcctctgacctgcaatgcttcgcccttagaggacgatgcatcagactgaaccatacctttcatcttctccctgttttggagcgcctcatagacttccgctagggttagttcactacggcttaaaagtatggtgtcacgaaaatttgcatatgaactaggcagtgagcataacagtaaaagacctaaatcttcatcatcaaactgtacctccatcgacactaggtcggcaacgatctccttgaagaccgatatgtggttcaatatagaaccactctcctgcaacttgtgcgagaacaacttcatcttgatatgcatcttactgattagatctttagacatgcagatcgattccagtttgagccaaagttctgcagcagtgttttccggcaacacttcttgcaaaatatcattagatagatgaagttggatcagcgacagagccttacgatctttccgcttctcctcagcagttcattcagtcgatttcttctccccgaagctttccagcgcctcatcaagatcccaagtttgcaccagaacagcccgcatcttgacttgccacagcgagaatcacgtcttgtagtctagcagcggtacatcatacttcatcgacgccatcgcgaaaccctaatgtgagaacaagctctgataccacttgttaggaaacgataagcgaacaaacgataaagaacaatagatcaatcacagaagacacgagatttaacgtgaaaaaccctcccaaaacaggagagaaaaaaccacgggcgccagccaacaaaatatcttcactatatctggggtgaggttacatcaccgcacggcggcttacaagaggtatatatatggtggaaccctacgcttcggcccaagccttccggcgacgggcctccgctccgctacggcagaagctggcctttattaagtgcaaatgaatttggatcacaactcaacactagctaccaacacaacacttttcattcaactgcttcccttaacttggagtattattgtttttcccattttatgatttttgcaattttctagtgggaattttgcaataacaattcaaaacggtgggtaaatttgcaaacgccccacagatataatacataatgcaaaggcttctcgtaagaattggacattaccaatatccatttggtggttcagatgcctgaaatggatggctatgaagcaacaatgcgcatccgcaaggaagaaagccggtatggaatttgcactccaatcatcgcattgacctctcattccatggaggacgatcttcagaaggcaattcatgccgggatgaatctacacatgacaaatccaatagaaaggaggacaatagttgaagctgttcatggtgtctgcaaaagacaataaccggtgttgcacaacacatcatatatatgtggcaatgagaaggatgagacaaatcacatcagcctaattgatgcagtatgtaggatgtaattacagattttatctttaagtgaaccttaatctcgaagcaaacttgaatggcctgggtcggcgtcgaacacatgatgaccgataaacagtgccggctagaaaagaacaggaaaaagcggagaagagaggggaagggcactctggtaaatttgcagattgcctgcattgaatttggattcaatattttgaactcctcttaagctcgatccataaatttgaaaattcaactaattaaatgaatattgatttttcaaatttattttaaaaaggaacttccataattttacaagatttgtgtaagagtgaattgcgtttatggccatatttgattactaaaatttcacttttgagcaccctttagctcttaatttttttcactttggacgatgctattttgccattgtttatactttgggccaccaaaatacttctcgagcacatcaattaccttaagcacatcggcatccgtatatcaacaatcttcccaacttacgtgtaaactattatttactattattgtacattagtccaaaatacaataaaggtagttttacctagtccaaagcaaaaatatttgttaaagggtgattcaaagtaaaactttagtaataaaaggtagatcaaagtgcaattaattgtttgaataatttatttgatttctccttaaatatgcacacttcagtttataattaaatcgaagtttaattcttgtaattgaataatatttattgaactggaagtttaattttagtttccacttgacttgcattcttctcaattcatttgaggctctcaaactaaacttcaaattgttttggttcttttgcaatcaaacagtcaaaaaatagtggcatggtgcaaaatgttttaataagtttgaaattcaatgtgttttcattattacctttctttaagtttgaatggggtacgattaataatttaattgctcaatctaacaaaatgcagtattcacattccaatcaaatcttaggtacataatctagtcaaataaccaatctgcaatagataactaagctaactgaacataacctaacttcttagaggtaagaggttgccgctgttctcataaaaggaaaaaaaaagttcggtccaataggccgcctagctaccatgacaaccgttgttgttcgtgggcctgactggctcatatccatcatgctctacatgggccttttcctttttgtgatatagtgatatctctgtgcgaaatacaaatgtgaaatgtttagaactaattttacttgatttccagtttgacccaagaactattgtctattactactgctgtctaggacactttcacagtttcactagcataccatcaaccaatgcatgctgttttcatatgtgatatgttatgagctgttttctgatctttccgagcatgtttgtagcccaaaatcccttccaacagtcttgctaacctgacattcttaaatattcaccttcgacaggcaaactgaattaactgtatgatatgcaaagctgaaatgtggtgacgaacttctgatggtcgccatttaactctggagagttaaaaattgtattgcttacactacataccatggcaaccttttttttttcctccgacttaacgtcccatttaactcctcagacattgcaaggtcaaattaccattctcaccccccccccccaaaaaaaaaactctactaaacataaggtaaaatgggcaaaactgttgcaaactttcccaaattaaatttggaaatatactattttttttctcagaaatatcctgtatgcacttaccgtggtctcgcacgatgatgacgccgggacttgcgaggctgcagacccctgtcgctaatcagtgattaattatcctaattagcgattaattaaatacaattaattaattgttctaatcaaaatatttaatcactaattattattaattaatcgctaatcatttgatttctaaaatgttgtcgatgttttgccatgtgagaccgctcagtcgtcgttacgcgagaccaccagcgttgtcacgctctcgttattctcgtgcaacggttcagtgatattgacggcatatttgtgttaaaaaaaattacatccaggttttttttaagaaaaaaataatgaacaatatatttttatgtacagtctacatgtttcacaaaactgtactacatgataagcaaattttaactgaactgcagatacacgccggtcttatcccttgggtccccaaatggtccagcagaacactccatcagcaacctccaattaaaatgtgacatccaaattttgtttccatcttacacaagatgccaagtcatacagtagagtagaaagaagactacaaaagcaagaaatgcagaagaacatgccctgcgaattgcaaattggtaagctctctgcttgctcgatctctggttggccctacactgccacacttggccaaatttcagcgtatgatgagttgatgccaaacatgttcgtgcaattttgtgtgaaatgattgtctgtttgtctctgaacatagcaacaaaaagaggctcgcgcaagcgcattgatttgcttggagcctgcctctgcatgtgatctatcagtgttccagatctctgagcttaggattagccatgcctagaagcaaacattgttggcactattagtctggtatgtacaaatgtttatatctcattattactttttagaaaaaaaaatgtatggccctaagggcccagcccaacacaaataattcaattcctatgaagatcgaatctattcttgtcaaaaccacgcaattttcattactatgttttgaacgaggaatttacgcatttatcagaatgaaaaatcatcagtatcggtttggtttatttatacatatggagctaatgtgatttgctatataaacaggtacaataattaggctgtgttcggtatttggagttaggaattctccctaaacatacgaaacgaggtggtccattagtgcgtgattaattaaatattagctattttttttaaaaaaggatcaatatgatttttcaaagcaactttcttatagaaattttttttgcaaaaaaaatatataatatttagtagtttgggaagtgtgcgcgcaaaaaacgagatagatgggttgggaaagctagcaaacaaacttatgttcggatgccccttttcccaacccctctccctcgtttccacgcgcacgcttttcaaactgctaaacgacgcttttcaaactgctaaacggtgtgttttttacaaaaagtttttatatgaaagttgcttaaagaatcaaattaatctatttttttaaaaaatagcaaatacttaattaatcacgtgctaatgtaccgctccgttttccgtgcatactgcgcttgttctcatccggctgtagcgaacacacccttagccttacgaatacactgagctattccttggaggaaaataaaaacctatgagctggaaaagaaagcaaaaatgtacccacgaattacctactaaaaagaagaagcatcgcacaccgacgatcattgtttgcactggtccacatgtcagctgctgcacacacagagattttgcctaccaagagaagcaaaaatgctcgcacgacatgaagcattctggtggcagaattcccaaaaaatttcacaatttgaccctttgcaaaaaaaaattttacaaataaaccatcaccaaaacttatttcaaaaataacccttggcgctgaacttagacacctcagcgccaaatagcgtggcgctgaatatacgttggcacgctgacttagtctcccatccgcggtggcacggcattcagcgccagttgacatggcgctaaggtgtctatattcagcgccaggtgatttggcgctgaccaaaagagtcatttttaaaataagttttggcagcggtttatttgtaaaaattttttttgcaaagggtcaaattgtgaaaatttcagcagaattccggtacaaagtcgcggggaagttatcatgaccacacagactgtacgggggagctagcgtatggttgatgcccaatcttgagcaggacacacccatgcagagagagggagagagagagagagcggccgtactccctccgtaaaagaaaagaaagataaaccttaagttttcgtatctaatgttttattgtccgtcttatatgaatttttttataactagtattttcattgttgttagatgataaaacatgattaatactttatgcgtgacttgtctttttaatttttttcatatttttttcaaataaaacagacgatcaaacgtttgacacggaaacccgaatttggttttttttaacggagcgagtacgttgaaacgagacgccatgttttggaccagaaatcatcatcgatcgctgcgctccctccctccctctctccagctgattcctccgcaatacacggaggcgcccacgtttggcctctggctgcttcaacacagctacgcggaatggagtggaccatgagcagctgcagttcaagttctctccctatcccacagccagcatgattttgataaatgaatacaaccaggaacaacaaactaaaaactactactctagaaataggatgattttgataatccggtcttgattagtgtacggtacgtttaaatttaaaagttcagcgcttatttttattggagtataattaaagtgaattattcatcttttctcatcaatttatcctcaccagtttagacttttaggttaaattgatcattgtatgcaactaaatatgatatcagaattaaaggtctagagtttgaatcatgtctagtgtgcaattaaataaaaattgatgtccacttctattccacgctaaagacttgagggagcctcgcgtgagggggagtgttggaatataaagggaattggccgtatttcctcattagcttagttttttgggttgaaatgatcggtttatgcaattttgtcaatcagacttcaataaaactttaaggctgttgaatgtttttttcttatatataatataatagataccaagtcatattttttcaagaaagtaatggttaaaaaagaatgtgcaaaagagagtactatgttttttttaacgatccagtacaaaattatgctaattttattggtgcccacgaatattatgcacacaggtgtgtttatagtgagatcaaggatgcaccgctagtttttttttgtctcttatggcgtccacaatatggaattttttgtctcttatggcgtccacaatatggaaatacagagggtcttaaacctcccaagtagtctttatacattgtacaagctagtggtccttataggagtcttttggatgagctatccttatgattaaggcctggccatatgaaataaaaagcttatcattcatctctctctcgtggaactctcctctctccctcaccaatctgttgcttgccgccaccgggaaagagaggatggcatccgcggaggaggctgccaaagttccacccacgagcatcgtctccccagccaccaaaggaccaccttagagtgccaccgcagtccacagttgtggtcgtggattcgcgccagccgccaccgcagccacaacctccctaagaggttgtaatcaggggaaaaacataccaccaccaccacatgttagcaattccaaacatacccctagacaaaagaactagcaccaagccagccgccactatccgtgactgaatgccgctagtcttgcaaacgccctggcgaacactagctccaaaacagaagatcgtcaacgggctcccggtcatcctcacggagaaagcttggggagggagaggacaagagagaagaacacccacttgtccctcacgccaacctggtgacgacaactgacaaaacgccaaaaaccaaattgagagaagcctgtgacggcgggaagatgagatctcaaagacgatgccttcaaggagcatgatgctcaagacgccaccgtcatccgtccaggaggtatgatgctcaagacaccaccgtcatccgtccaaaggactaggttttctcccggagaatctcccaaggaggaagagggtgtcagcttgacagcgccccaaaggggtgaaacgctgctagatgccgacactgccagcctagagaactccaagcaaggcgttcgcctacagttcactctattcaacatatcatcaacaacctaacacaaagccacccaagcggtctccgatagcacgcagtcttgctgcgtcagctatcttgcgtcggtcaaccaccttcggcaccttcggttgtgccctgctagccccaccgtccagctcctcgtggcatcagcgaccgcctcactctgtagcctcctagtcatggcctcgcgcgccgtcggtgtgcgtgccactagcatcacgcaccgccggcctccacctcgcacaccattagcctactccttgcttgcttgttgcgctggccacccataggcgtcgcagcccaggccacgccctcgcacgctgcgccaccgccatcatgttgtctttcatgttgccacgccaccccttatcgcagtgcagccctggtttctactctcctcctcaccgccgcttaaacttgtcggctggggcaccagaacgatctggcagtgaggggactaggtctagccccaatgatgccaaatctagccaccgatgactgtcacttaaagctctccctccggtcttagccaccactggagaaaccgtttgtaatcccggttgggaacccctgtagtcccggttttccaaccggggctacgaatctgggactaaagatgcccatctttagttccgggtgaaataatcgggagtaaagttgtatctttagtcccagttgatgttaccaaccgggaataacgagagggtagcggcagttccggttggtccacttttcttttttttttgattgtttctttgctacttgccagagttaatccctgtattttctcccaaatcgagtgtcatgtatatccccaaatcaaaccccaaatcctcaaatcattgtaacatcctaaataattcacatcacaaatcctaagttacttttacacacaaatcaaatacatcacaaatcctaaaaaattacacaaaaatcaaatacatcacagattatacatctcagatccatgcaataaatcacaaattctaaacaaagagattatacatctcggtgaatcataaattatcaaaaaaaaagaaaggctggcgcgttgccacccgccacggccaccgcttgccacggccagcgcctgccgcctgcggccccgtgcacggccccgccgggtgttgccccactgcctgccaccgcgcgcgaccccgtcggctgccggatgggaggggaggagggggaggagaggggaggggaggaggatgaaggggaggaaggggaggaggaggaggaggagtaaggggacctgaggggtaggaggagaggggaatgatccgatcttatctaaatatctcggtgaggaggaaagtcttgtctgatacttaaccgatcagatatgggagagaaatatttactcccagttggtgttaccaatcgggattaaagatctaaataatctttacttcgggttggtactatcaaccaggaaaaaagtggtgatctttagtcccggttggtagttattaaccaggactaaagattctcggcccctgacaagcctctgacaaattttttaaccgagactaaaaacaatctttaatcccggttcttattagaaccgagactattgtgaaaattagtcgacccagcaaagattatttcttcaatagtggcagagccctaggccgacatgaccatgagaggaggaaaagagcccctccggtggccgctcagtggcggggtagaggggaggaggggaaaggggtggggacagtgctcgcctagtcgccacctgtactgccctgcggccgtgcgacatgagcatattactatttgagtattggaatttaaaatatccaagaaacacacagtaacatcccacatgattaacatgcatgcaaagatgatgtaccgatggccgtttgcaccaatatctctgaaaacatcattgatgctgcaccctggtcgcggagctatcagcctatcactacatagaccatccagttggaattgcgtacaagggacggcaaattggattatcaggcatgccaagtgcagatgctggttaaagtgtgctgaaaggggtgaaaaaatcgaatatctcaatcgatcagttggtgagtagggccgggcgccgttgctgacttgccgtgatacagaaatattcctgctttacttttttccgaagggaaagaaagccaagaatcaaatggccaaatgaaccagcttgctataacaccctatatctcgtttgaagcctataattgttatggtgttggcccatatatataatgcagttgtcatgcaatggtggtgatttagtacaacattggaaatttaagaggatgatcagggtctctgcttataaatcaaaggatgattatatgataatctaaagcgttaagtcaccattcaaaaatgattatatgaccactactagaaaaacgatttttcatggcgttggtctatgattttcgctggcagaaaaatgccaaaaccacaagcaaggtcgtaatgagggaggtggggggcaccgaccgccagcgaaaatagatcttcgctggcagccacgttataccagccgccagcaaagatatgttcattttcactggcggtcacttaggtgcgccaccaactaaaatagataatttttgctggcgcttgggttatatagtccggtagggaagatacaattatttttgctggcggcccacttaagtaaccgccagcaaaaaccgattttcgctggcggtagaaggaccaccatctattaaaaaaattccacacaccgcccatgctccttatccacccacctttccagaataaaaatatctccacctctcctcttccccctccagatctagatcctctccaacaccctcatctcttctcctcctcccctccatagatccacggcgttggcgtcctctcctcctaggcggcggcggtggcggctccgttagctgtgcacggcggcgacggaaggtggtcgtcagggggcgtggcgacagcgactgcaacaggatgtgggggcgcggcgacagcgacgggaggagctatcgtgggggcacaacgacgacaggggcgcggcaagcttcttcttctccccctccccctccccctcccaaagtcttgctggtggctgggctttctagatcggggcttggtacggcagaaggagctcggtggcggtgatgctcggcgacggggctcacacatccggtgttgcgtggtcggcgacggcgacgacgtcctccttcctctctactgttaatgatgtttttctctttttttttcatgttcaaaatgcttgtatgatgtgttcacttccatgttaattgaatctagtgaactctggatgaggatttgaatcgatgctcgaaaatttggatgtggatttgaatctgtacatgctgcgaaaatatgatatattttcttttttttttggcaaaaagagattttggggattaattttttttatggaaaatcattttgactggcggcccacataatgaagccgccagcgaagactattttttgctagcagagcacataaggcagccgccatcgaagactattttcgctagcggcccacatatggcagccgccagtgaagacgattttcgctagcggttgtctttagctggccgccagcgaaaagttatctcctcttgcagtttagtgccgtcagcgaagatgctacattttcactggcctttgctttgtggtggcgctaaatgtcgccagcgaagacccaaaatagccaccacgaaatatggtttttgtagtagtggacaatataaaccgttaaagcaccttttttttaagtgtgttacgttcgtcttaacaagttaccatgcataccaaaagtcatgcgttctctacaagggattaacaataatagaaaaaaatatatcctccagttgatgcatatgttttattaattactccctccatttcaggtagtaacaggggtggagctaaagtcattaggggttccaggaacccggtgaaaaaaatatgtaactaaactttacctattttcaccatgtgtgcaccatcctcaatataaatttaggcacccgtatcaacttaaactcgatataaagtagagtaaattaaacaagtggcaccccctccatttcgtttagctccgcccctgtgcactaaacatgaagatgtgatttgatatttttatgacaaactttttttgaggaaaactacggcgggtttgaacaccagtctgaactttattcatttggttaaaaaaaagaactttacaaagggggaggtacagagggacggggggaagaaactaaaaattagaggttaattacagaaagatttagcgcccaagagtgaagttgttgtttgcctacaacgtcgttacatcggtttgaccacaattcgatatcgttggcgcagcgacgaagaactatcgagttggtttcgtcaatggagttgaagatcttcttgttgcggcgctatttgtcccgcgcaatgattaaaaactacgattatcccgtgcaactttgtgtatgctagataaaagtataattggatttggtatatatatacaacttctatcatattttattcatagatacaaatgtcttttctatataatatttttatatgtacaacgatttcatgtataactcttagcttctgttttcatgtatatacaccatgccattgaatattctcgacattttggtttttcttatcgcattttcctttcgtatcatatactgcacttcagattctctttttgaaatcaatattcactccctgaaagaaccttcctgaaatatcagtcaaaagaagatgtgcaatgcaggaagtctgatgaattcttctctgcatccactacatgccaacgacacctcactgcctcatcagattcttcctaatctgaactgcttcttctaatcataaaagataaaaagaaaagatcacatgatatatggatcgagatcagggacacagaatcaatatgcatcatgcaatgcaagaatatacatctcaataattggacatgcaagccggcctagctgtagctaggagatccatccaatgcatccatgcaaatccagccgtttaccatgtcgcccctgccacgatctcggccgctaatttcgcgccggagacagtagagaatttcttggggctctaaaaccctgcctctctagaagcacagctaaatgttattcttattccaacgatgcacatagatgatccatatatataccacatatatatatgattaattagattatcaccaagatcagattcgtctttcgatgcttccatggtactatttgattcagaaatagcaatttgcaatacaaaatgtgtggctacgctggctgtacatgttagcctacatacgagaatctgaaagtacatacatgatcagaacataaacattaattactactgctgctaattaatttggttggacttagcagtactgaattttcacacctgtggtactgtgtgagaatagacccagagatcatctgttgtaatgtggatgaacaatatagctacaacctacaaggaaaataagtttacaacagtgtttgaatgcgctttgctgtagcaaattcagtgcagcaacaatgaccaattctaaggcacatcgaaaatattgaggccttcaatattagatctatactaacattcaatctcaatctttacagctaacaaagtgaaattaatgaacattgatcactaactaagtattaaccaaacctagcaactctcgtgagtctgcaggatgatgaagtttgtagatctgtcgtgtacacagtgtgtatactgtatatccagcatgacacgacgaagcagttacgtataattaagcgagatcgacaaaaaatgcagacatgacgcaataacgcatatcccaattaaatatacgcgcacacgcatcagttaaaattaatttaatgcccatcagaaagcaactgcatcatgtgcacactaattaagattcgaaattaatctgcatatatatcactaattgatatgaattgaaatttgagatcgactggcacgtgcgtgccaatgccaattaatggtcctttgcttaattatattagctgtgtacgtacgtacgcacgcactgtacgtataactgtgtattgcccatccagatttttaatttgtcgttcagttttgtgcgaatctcgtggtgtctgtatatgtttgtcgaggtgtcgacactactctgacaaataacagtgtttagcttcagcttgttcctggtccttcccgtgttgtgtgtttggattaattggtaaacagtgatacgcaattatgcattgcgattcaaatccaacggaaacagagtgtttagtggtacgcatcgaaggtagattgatccaaatgtaccgctaattgaaattcttggaagagttcaagggggtcgtagtcgtgcatgtcactgatgacaggcacaccgtacccaatgtttttgtaacttgttcacaaaaatacattggatgataacatagtttatattaaaatatgacgagtaatttgcttttcttgacgagtacatgttcatttgaacaacgattgatcaaaccattatttaaaaaaaccaaaaacaaatcatgaataaaacttttatatttatgttactagcggtttcaaagctaatgctagaaagtggactagcataaatttaattttggttactactgataagctaacaaacggacaaaggcagtggcgttcctagagtatactatctggggttctaggcaaggtttaatttctcgttttcggtgtttctatcgggcggtgccgatatagcgaaatttcagaaatttcaatccgaaatttctaaaatttgaatattaccaaaattcatgaaaaaataaaaaaattgaaaattttgatcaaaataatattgtatcggaggggtcagagaaatttcagtccgaaatgtcaaaccctggtcctaggatctcggctagaattttaatatttagttgttttaacctatatgaactatattattaggtaattaaaaattattgtattatatgtgttatgatatgtatagaatcgccggtaaattttgtcctaggttggccactagacaaaggctaagaactaccaaaataatttacatcagagatatggtagtacagtaaaatcattcaaatatgacatttctttgtaatatttaaaggtcgatacataaaacctctagtcaagagtagagcagctagggctgaagccctattcctaactcaaaataaaaataaatattgcaactgcactatagaattttaaaacttaaaacataaaaaataaaattatgtaaattatactaattgagcttttgtcttggaaacgtaacgtacgttctggttccgtcactgcgtgagcaaattaaatacagtgaatgcaataaggaggacaaaaaaaacgtgtccgtggcaacgtcacgtgtgtagagcaaaacatacatacatggccgttcttttccctttttcccgtaatcccgtgtagcacccgtgcacggctgcatcatcatgcatgcatatccggtggccgggtttgccatataattccccctcccctgcgcgcacgccgcgtggcccacggctcgacggatatcgcggcctcgatcggcagggccacgcgagcgcaacggtggcgcgaggagggcggcgtacgtcctcctcctcgcctcccgctccgccgccccctgcgtggtagcgcgaagcggacggataacgatcggtaaccgcgcgcgcgagcgccccgcggccgcccatgtgacccggccgacgacgtctcacgatcgatcgagtgagtagtagcgcgcgtgcgcgtgtgtgctgtaggcaaatactatcgctgaacggaacgaacgatagacaagaaaatctgagatatccatccaactcgggtacagcgaacacacggtcgatcgtttctctgcccgccctctttcccgtgtgtaggccacatgcagtagttggggttgggcgtccgtccaatcgtccatgcgtacacgtacgcccgggagaaatgcatatgcacagaagtgattgtacataaatggccatctcatcttgtcacacacatgtatatatacgattcttcttttgagaaacatgcattcttatagcctaggtgcttaattatgttgaaatcggactccattttccttaggagggggaggtgcttgtattagaaaagacagacgattaattctctcagcaactctgtattaattaattagcacacactactagaaagggattttactagacagccaaaagagattttcgtatgcgggtctttggctcgtctgcgcccagatgtatgcgaaaattattattttttcatgcaggtagcgcaaccgcatgtgaacgggacagtcaccttagccaaccgcacgagaaaatagtttcggcaaaaaaaaaacaaatccaaaaaagaaataggctaaaaccctagccattgaagtagtcctctctattagtgactcgctcccaccgccatcacagccgatcgttgtcgtcgttgccgccgttgcggggaggatcgccggatcaattgggggggggggggtggggggtgaggagggccgccgcaatttattaattatttgtttatttcaattgtagcaagtcacactttcttacttgatgggtctacatgtcatacacttattttttttaagctaaacattatcatatctgtggccaacaactttacgtggcatatgccaccctaatgacaaattgagttggggtaatatcaggcaagaaccaaacataccctaattaattaccgcgccgccccttgtgcgcaagtagtgcttgctacgattggaacaaatccttgtgcgcatggtgtttgtgctaccccactacagtatatgttagggttagctgcctgttgtgcgagtgtggccgctgccctgtccctgtccctgcgcgatcgatatgatgcagctatgcagctgcaggttgctcgatcgattcgatttcttcctttttctctgcatgctctgcacttccgcaggcccgggatgcatgcagtttcgctgcaaaccgatagagcagcatgggcgtgcacccacgtcgtatatatgtatattcatcattgtttgtttcttcatagatcgaccaattcatagccaaaggttcaatattaattgtgaaaagccaaaataatttcttttaaggggtggttcaaaatcaccgaaatttcagatcaatattttagcccctccccgaaaaattttaaatttgcaaagataggtgtggacaggggcgaatccaggataaatgattgtcggggtcattactaaccagggtctatgttttcaaccaaaacggattgaaaacaacgcaatttcgatgttccaacttgggacaaaagtagattttgagtgaaatttagaatagtttttcaagaattcaaatttgaaattgtaaaattaaaccaaattaataaaaaaacatcaaattttggtaaaaaaaagccatattgctatatttggaatctaattttaaatcgaattggtgaaccctgatacaatctgggtgtgttcagacctagctacgggatctgaacccttccctcccagcacgcaaaatagagtgagattaccatatgattaattaagcattattagcttataaaaaacttgaaagacaatagattaatatggtttttaaaacaatttcctatagaaattatttttctagggaatttgaaaagttacgagccgttggccttatgcatggtctcaaatctcaaaaactcaaagtatatgcatattcggctcacgtataatcataaatgctaggtaattttctatttgctgttgctagtatcgtttctagttgtcaattggaatttaacacaacaatcaataattaatgtcaccggggtctaatatttgttttcaccggggtcatagctggtaaaataaagaggatacgagaggttaaaataaaatcatcggggtctactgaccccggtaattgattgtaccttcgtccctgggtggggacgtacgtgcatgcgttttatccagctgtggggattttacagactcatgtatgatagtgttggggcaacgtatatatcaattaatcaatatatatggctaaacagattgagtgaacgatcgattgtttttaatttccgggttgacctaggtccatcttgtttataacccagaaacagtactccagctccaacaacaacctggccaaatctaattgatttttggatgcatgcatacagggaccgcacctaagatatttataattataatagctggtaattaatcgatggatggaaatcgaatccttgcattgcatcgtgttgaatgtggtgcactagtatgagtatgacactactttgcaaggtggcttcggtgtagctttgctttgggctatgaggtgtggatggttccaaaaagtaggccctgcacttctattcaaaaaaaaagtaggccctgcactgttttgatcggatccttttcctacaatattttttaaaaaaataaaaagccttgattggcattactttttatgagaaaagctaaaatgtgatcttaagaataattttagatatgtactttctgttatatatcttatccatcatgaaaataagactaaacaataaaacaaacaaagtggagaagcagaaggttataaacataatttaaaacaaagactaacatttgaaataatatagtacttttttttaaaaaaaataccacaccaaacagactcttattgcttgtagcgggcttctgcttgtttcagcgccagcttgtaaacctatgcattttaaaccttttgttgagactgatcggcaccatttctttcaaaccgactctagctagctagttgagtgtgtatgtaatggcatgctgcctacggtttcctgtaggggttatttgactatgagattttaaaaaaaacaattgttattaaagaaattatttttaataacacataatttccctctagatttggagccatcagtatctcccatatctccgattcaatattcccttttagtcttcaaaacacaagtttccttttaaaagaacatttttctagttcatttttcaagcagaaattcactacacactgtccacttccatcacaatgggcaacacaaataaaaaaaaagattgtagtatggaccgtttgccgttgcaactcatatcatgtagcctttttggcgccgaaaggctgcgttcactaagcggatagatcttctgtgaatcattctcttgtcagcagatagattgctgctgcggcctgcaaacgcctgaatgcatgcttattgcaggaaacataaagnnnnnnnnnnnnnnnnnnnnnnnnnnnnnnnnnnnnnnnnnnnnnnnnnnnnnnnnnnnnnnnnnnnnnnnnngccattcacaaanaaccac

SEQ ID NO: 30005 - DNA, 24137 bp, Oryza sativa
  unsure (1)..(24137): unsure at all n locations
tggcccaagtgagaacnnnnnnnnnnnnnnnnnnnnnnnnnnnnnnnnnnnnnnnnnnnnnnnnnnnnnnnnnnnnnnnnnntccatatgtcctatagaatataataacttttttatgttagaaacaaatattcaacaaatatatatgtggaattaaatagggaagattaattgcaattggctgagaagagaaaatatgtgaagaaactaaacaggagacggttgtgaacttgtgattaattggttaagatgaatgaatagatagaaaaattgctatatttattttaggacaaattttaatgttaaaagttcctatattattttaggatattttttttaatgttaagagttactaaaaaccgagcgaatatttctcttaagctaaagtgaagtaattttgtataagtggctaggtaacttatgctagtttttttccttctataattgtttgaagtgaaattaagctacatcagtgcattttgaggggaaaagcacatagctagagcaatcatgttgacacttgacagctcaggccctcaatgaaaactacagtagttgatgccgtttcatcccaacttgaaccactgtcactttatatctgtcttttgcttatgtccatagcacttcaactaactcattactcatgggaatcgtgttaattatcaaaagagcttgacccaccagtggaagtctcacataataatgtactttattcgacgagaataaatgggtttcatttacttccgatttttcattgagaaatacataaggtatgtaatcttctcacctgtatgtcggaaaaaattgaccttaacttgtcaaatacaataatcttctgtttcttctgcatattctccaatatctcaattgtgttccatatgggtcttcctagggatgtctaattagatgaggatataaatgaaaattttatatatatagttcaaatttaaactaaatcctacagttttagatccatctttactttcttcggaacaagccccaatgagaaaagaattattggtgagcatggtttacttataaaccttaaacaccccaaattcatgtgattgaatcaagacaaatttcagaataacccaaaagcgatttgcaaatttttccaattcaaacaaatgaagaatcatatccatgcatattttctagaaacgaaattctcatgcagctagctagctagctagctggaagaacaattaaatataaccatcaataagcagttagagtgacagcaacctctgtgcctgcaaacaaaacggttggaaattaacccaacttgcagatagcccactccatcagtgcatgggcagtgtgggtcatgccaactgaaaccaaacctacggcacatgcagttcagtgcacagcatatgggacaatgcatcttagagattgtagctagtataggatgtaaagaagaaaaacaaatctgaaaatggtagcagcttcagaattctcaccaattgggatgcacaaaatgtatggcttgtttgatgttgtaacagatcaaggcactgcagagcagtgactcaacacctacctaacacgcatgtttgttgctccttacagtgtcgttttcctgctggtccagcgcacgcacaaacctgtggctttatttttctttctacttcagtctattggtataaaccgaactaatcgaccatgccatacaagaaatgtgaagctctatttaaaatgtagaagtattaacatatggtgggtgtatttaaagtttgatttggtgtgaaattctaacgaatgacagactcgaaacatgtaacaagttctatgcgagaaatatgaagcttcattcgaaatgtaggagtattgacatgtagtgggtgtatttaaagtttgattagctgtgaaattcttagggatcacatactcgagacatgttacttggaactgttagaactggaacagtagttgattggataaacttggtttgcacatggtgacaacgagaaagtaaagggtaagaaacaataggatgaaatgatactcagccattgaccaacatgatatagattgacatcagattcagatgcaatgaagaggttgtactacatctcagccctggtaagtcaacaagatacagatacaacataaataatctaacttaaccttgtgcaggtcaacaaacctcacaaatgtcattatattgctggtaaaatattcacacatccagatgctctaatccataacactaatgaaaaggttctccttctagttaaagcatcgttaaatgaaaagtaaacaaccatgcttgttcaattcataacattaatggagtgaaagaatctgaagcataagtgaaacataaacagccatattcagtttaattgcaaataatgattactgaaatatgttgtttgaatatgtgaaaataatagaaccaaaagtaactaatgactagcaatgctctttgggtttatgaacttttgagtattaatatgtagtactccctccttgtgaaaatctgagacctatttctttttcatcaaaaccaagaagcaattaactcactcaccatgtggcaaaaccaatgaacatgtaatcaataagtactagaatagcttcttggtttccgatcaacaatttaatttagcacatagtgactacaaataggactcggatttttggagaaaccaaaaatgaaatatgtctcatattttttgaaggagggagtacatctcaacggagtatttttcgttccactggtcataaatatttaataccttatgcatgagaagattcagttaaagttttgaactttaaacgtcgattttttattataataattttatcatcttccagtggtatttttcaaggtgaccgtatgcatgctattttcttttaaacttagcattcgaaaaattttatatggtcaaaattttaaaaatttaaccaaatcttgttatatgatagaagaggagagtagctaaccagcgacaatgagaatgattaaggagaactgtggtatgatgagtaacactcaaccaatatgatatatcaagatcggatcaaaaaccagattcagatgcaatgaagttgaacatctcgattgatcggttctaggtaagtcaacaaggtagacatactatcatacacaatgtcgtttctcgttcagatgatgcacctcgtgcagggcaacaatctcactatgccgtccctggtaaaatattgatacatccagaaactctgatccatacatcctacagttaaaaaaaaaaactgaagcctgcatccagtgagagcagtaaacaatcatgttcattttgactccaagcgatgcctgaaatatgttgtatgaataagcgaaaattaagaataggagcaagagcaagttaccatagttgagctttttttttttcatctttctctaccactaaaacacactgaccaaaatagtttcctttttactcgaaaaactaaaatgtgacgccgaatttgcttggaattatccaaattaaagaactactgattcttaaaaataatacccctgctaccctagcaggagcaatctgtcaccatttttaattaatctaaacatagcactagaagacttaatctaattaaactatagctcgcgattttgtctgatcgatgcagagattagtaacttaattgcaccacggaatgcgggaaacgatcaatgtggccgtggaaatcaagggctttggggctcgaaatcagatggggattctgaggaaagtccatgcgattgctcttggaaaactgttaagaattgtttttgaggcgtctggagaacagtagtaaaacaaacggggacggctaattatgtcggtgaggtactgtcaacagtgaattatatattttctggggattagtcgcttcccgtcgagtacgtgtcactgtgtcagcctaattcacccgtttgactcattaattagaccgggttttttgtgattaattttcagttctgcatttttgctgctgctgatatattagatggaacggcaatggcaggtctgctatgttgcgttgtgcaactaaaactctcttttaactctcttttcttttaatatactaacgtgcaattcttttgcgcgtttgaaaaaaaatattttttttagataatggaatacatatcccggcctttacttaaaagagctacagccaattattataaagaagcgtttgaagaacatagtgtaattagatggaatctaattaaggtggtgtgcaatttcataatttcattggatatatatatttcttgcaattttaacggtgtcctactctctttgtccataacaatgaagcataattctgaacggaggttgatcaaatctttttaactttaaccatttataataaaaaataataacaaaaaaaataaagattgacagtataaaacgatgttacgtgaaacaaatcatcataataacatacatctctttctatttaaaataatttatctttaagatattatatatcaaagtagtatattgagcatcatatttatgtcatgaattgcttatattcgtggaggcacgcagcagataatatcacacaaaatggctgccgtaacggtcgtgcaagctgaaaagttatcactaaattagtggctttatggccctatttgtcagcttttgtagtggatttatttttttttcgctctaggtcatacgagtacatcctagagatctgctaacgcaccaattttctggttttgataattacttgtaccacaaatactccctccgtattttaatttatgacgcctttgacttttcgatcaacgtttgaccattcattttattcaaaatttttgtgcaaatatgaaaatatttatgtcatgcttaaagaatatttgatgatgaatcaagtcacaataaaataaatgttaattacataaattttttgaataagacgaagggtcaaacgtttgacaaaaaaatcaacagtatcatacattaaaatatggaggtagtatataatggggtcactaatcatcattaccattgcttcctttatgtgatgtactaatatgcatttcttttccatcattttatcactaccctccttttttagtggtagtggtacaccatcaccatccctctctaatccaatacatacaaaagcactaattaaatgactgctggtactacataacaacagaacaacgatcagattaactggacagattatcacatcaaccaaatccaaatcacccatcacaagttgcagttattgagccgttgagggagttaaaaaatagtgttaaccctgtcgcaaaacaaaaaataaaaagttgttatctcttggtgggcactgcagtgcatttgcagctgctttgtctgcttctaccaaccggaatctccaacccagagatgcagagcacgctccctggccctatccactacaccatcaccttttgttcagccaacaaatcaataattaactaacaattaacaacagtaattaaagagacgtgtagtcttcagagaaacaatattcagagacataaaattgttcacatgatcatttttagtcccggttctttttaagtaccagaactattgtggttttgggttgaccgaacaaagatagttttccagtagtgtgatgtagttcatttgaagaaataatttaggaacttcagagagactgaatttgtggatgtgcagaggtaggtataggaaggcgtcagttcgcatggcagtagttagtactcgattacacgatcggagatacgttagttgtgggcatgaatcggatcgtgtaggatggggatagggagggggatgaacaagataagatgagatggaagatggccaaaatctcaataatttccctcagcagcgcctatctggggcacatgttagtgttagtgctgcccctctcctgcactcttttttttattttttatttttttggttctaagatgcttctctccctgttctaatactattactaccacacacatggttcctccttccctttgactccaccatgctgcccctgcacaaactgaaaaaacatagagagaaaaccaaacattggaaaaaaatataatttatccataaatgtacatatatatgtttttcttccaacagtcatgatatagttttgcttgtcccctcaacggctagtagattattattgttgttattgttagcaagataatacaccacctgtcagtcatagctgtccccaggtccaggtgaacccaaaaaaaaaaaagaaaaaaaaaaccactaagcaagcaaggcatgtgtgccatgtcttttgctatgcttcccatcaaagccaccttaacaacaaacctcccacacctccattctccatgtaccctcccataccataccatactcctccatagcccatagcccatccacaaacaaatagagagagaaatatgttagagagagagagagagaggaattgtttattaaggggttcattagtggacataattagtaccaccttgtaagtagtaaaccatgtgccctactatataacaatcccctaagcagcactgcttttagttgtcccctcctcatttgcttcttcttcttcttcctcctctttgtttcacacttgtggtttgtggttgccaactttgtgagcgaccatggagatgaggagggtggcggtgctggggttggtgtggctggcggcggcggcgacggtggccatggcggatccgctgccgtcgtactacaacgcgatattcagcttcggcgactccttctccgacacgggcaacttcgtcatcatcaactccggcaagctccccaacatgcccaagttccctccgccgtacgcccgctgctccaacggccgcctcgtcatcgacttcctcggtacgtcgccggtttaccggccatgatcatcatcatcatcatcatctcctcgatcgaatgcgagtggtttgattcggttggatttgcagctgaggcgttcgggctgccgctgctgccgccgtcggcgaacaagggcaccaacttcagccagggcgccaacttcgccgtcatgggcgccaccgccctcgacctcaaatacttcaaggacaacaatgtctggagcatccctcctttcaacacctccatgaacgtccagctccagtggttcgacgaggtcaagcaaaccatctgctcctcccctcaaggtccgtccatctccaattctccgcatcgccattgccatcgccgccgtcgatctaattgaattcaagaacatgtaaataaatacagagtgcagggagttcttctccaaggcgctgttcgtgttcggcgagttcggaggcaacgactacagcttcgcgtggaaggcggagtggagcctggagaaggtgaagacgatggtgcccagcgtggtggcctccatggcggggggcatcgagcggctgctcgacgagggcgcgcgccacgtcgtcgtgccggggaacctccccgccggctgcatcccgatcacgctcaccatgtacgccaccgaggaccgcagcgagtacgacccccgcaccggctgcctcaagaagtacaacagcgtcgcgctctaccacaacgccatgctccgcatcgccctcgaccagctccagcgccgccaccccgactcccgcatcgtctatgccgactactacaccccctacatccagtttgcccgcacccctcacctctacggtaagtctatcttaacttctggctatgtatctggacatatctacgttcttttttttttcttttgccgtgcaactctgctttcctctgcaatgcgatgttcaagacagaaatggtagtttgagggttggtcagtatggggccgggggaccatgccaggcagcattgcaatacagcaagagctagcactggatgatggttgggggtactgtgtgtgcagggcggccagccactgacactaacctgacggttacatctcacaaaaccgtacccatcatctcacccacactcccacacagaccgtgtcgggttggtttggtggtgctcgttgctccgtgcgtgcgccacaacattccatttctattgtttttctgttcaaccatggcagccaaccaaacagcccccgtaatcttcttgacgtaccgacggcgaggattttctagagttacttcgctataacagtacggtgtcattttgctgtcttaaggtatcaacccttgggaggggagatggtcctgaactcatcattgtcgtcggcgagttagaggcagagcagagtagatacgccggtgtcagcggccagagcaacggtgtctgtgagttcacctaccaacacgtacgcgcagtggcacagctgttggcgtatctgctgcagtgaccgtccatggccaggtcaccttgttttggcttgatccggcaccattactggggacaaacatcttctctcatctcccacaattattcctcccaacatctgattaactctgcacaataatcaatcaaatccctcattggaagcaatcactaggttggtgtgtctgatcatcgccaggtgtatgaagtctgaacaaagaatctcagcagtagcaggatacatcagagcatcagagttgcagaacagagtctgcattgcatcttacaagctgttaatctcactcgacctgtggattcattcaagaaccgattgagagttgacatgagaaatgtgtttgatgatctttgatgcaggatacaagaggggcgcgctgagggcgtgctgcggcggcggtgggccgtacaactacaacatgagcgcgtcgtgcgggctccccggcgcgacgacgtgcgaggatcccgacgctcacgtcagctgggacggcatccacctcaccgaggcgccctaccgcttcatcgccaacacctggatcaggggcccctacgcccacccttccctcgccagcgttgtccgcgacgacatggtctattagattacaggtgatgatgacctccatgtttttttttcaatttttggatcaccagagatgaagaagaaggatatggcgtatggacttgccttgagtcgagttgggttggactganagagagagagagagagagagagagagagagagagagagagagagagagagagagagagagagagctaacgtgcattccattttgttgttggtgtatattggcataagtaaatcgattagatttttaaatttcttttttgttttattttgttttttaaaaaattgggcggttttggtgccatgtaatactgcctactacttggtcataaattaatggtggatggatgaactgtttggtgtaaagcttggcagattggagtagtttattgtcagaaaagggaaaaaaaacagaattgcttgtgatgatcatgatcatgttttataccttacgtttgagtgggagtagcatccaaactccaaaagagaagaaatcatcaccgatcagctcgaaaggcactacacgcatcacatatttggcttgtttataactgaacataggtaggacggtgagggccggagagataggaaaataataaacatggaaactcaggttacccgctttattgattacacttgacactttcctctcatgagcttagtgacaaagcacacacacatgctttggtagtttgattgcaattacctcaactaaagatcatatgcaattatgtattgcacaattttcttttttgccacaaattgacgagcaaaagcaataagcaaacccatatgtggttagaggagaggaccagagtgctgtagttgcagaaaaccaacaagctggctggcagaggccgcaaaagcacttttggcgaaaggcctaatgacttcttccactgcaagctagccagcatcattgtcgccttttggcatcgaatgcgatgaatcgtgcagaagaaaaccgatcgatccccaaccggatccatcctccatgactcgtttctcttcctagcggtacatcttccctgttgtcaccgatgagggcttttgttttgcgccctgttttccaaagtttttttttcaaacttccaacttttccatcacatcaaaactttcctacacacaatcttccaacttttccatcacatcgttccaatttcaaccaaacttccaattttaggtgaaataaacacagccttggtcaaaccaaaccaaaaaaaaaaaatcctactcatggccggtttcgatgtgttgattgatgatagctaaaattgaatttatggcagttgttaatgggcataaacgaataaattgaccatttgaaaattgaacaaaaatgttaacaaaagttatttccagaaaatgttgataaaataagattatgtagaaatcacatcatttgaaagattgaaaatcatgtccatgataatctatcatcttaagtactccctccgtttcaggttataagacgttttgactttggtcaaactgatttaagtttgaccaagtttatagaaaaaagtaataacatttttaacccaagacaaatttattatgaaaatatattcaattattaatttaactaggaaggtagcccgcgcatacgcgcgggcatgttgtttaatcttgtttgaacttttattacaaatgtttatgtgtggatgatatttttgaaatattttttgactctattttaaacgtatgctcgttaataactggtttcggcgtattacttgaaattgtatatcttcaaatttattagaaaaaaatatgtcaccataacgaagttagttcatatctatttgtattatgtgtgattcttttttaaaaatttttggagtttccaaactttatataacattttttattttatacgccatagactactttaagtagcattttaattttattatatattactgaaatatattgtctattaaaaatatagctagtgatactacttcatctaattaaagatgacttatattacttatattccctctgtcacataaatcgaaggagttgaattttatcccaaaacaatagaaaaatttatatgtaaccgggacaaagtgattttttttaaaataacaccacattaatctccaaagtaacgtatcatattttggcaaatatctataatatctatagtgtagtgcatgttagttcagtgtccagattgttttcaacacctattgtttctaatcatatgagacgccattggtaatttggagaatacatatgtacatttaaatcagcgttgtgtattcctcaagtgttctttacacctaaaatatgatgtgaaattattatcataacattaattattacatgtcggctccatatttgtgatgtattttgggctatagatatttagtagtttatttatttaaaggaatacaaccggatcacaaattggatatataattttaaaataatttaaaagataaaacgcttaaaagcattgattgggtatttcatatttacatttgcgtaaatttgaagattataatattttatccttaaattgtagaaaattcttttttaaggactgccattttttggctttatcataagtatattttctgttcttccagcaaatgatatgtaagcaatattgttcttttcaatcatatctatatacggagtactttttctggtcaacagttacatatttctcatgtatccgtatataggagaaatgtattattttttaaacaataaatctaatctaatggtgtaaaatgaaacaactaaattgtgttgttttcatttatgcaaatgtagatttaaattagcgttgtgtattcgtcgagacactctagaatatgatgtaaaataaaaaattatcatagcattaaatattatatatatcagcctcgtatgttaagatagaacgaataaaaatcattgatgggatatttcatatttataatataaatttagtttaactacgtatatttatgcaaatttgtagagtaatatatttatctttaaatagtagataatactattcataagaccatcgatcctttccgaatgatacacatttttttgttttattgtttttatagtaaggattttgaaaatagtatttcaatagaccaccgtgcatagatttttctttgttccgatggacagtaggtaagcttcatttctttttttcaagtcgtatgtacgtacggactacttatgtattttttagcttaacagttatataggtctcccgtatacctacatggggtattagtttttaaaataaaatacatctaatataatggtctaaaatattagattcaccaatttaaatgaaaatcgatggtgacatttacttaaatttatattgaggaatagattttatctttaaatagtagaaaggataatcaattttttaatggtcctacgtatgttttgttcgctttattgttttttatagtactaagtctgtgcgtaatttttttctttcgataaacagtaggtaagattcattgttttttagtcttacgaatgaacatacttgtgtttttgttttctttttccggtgaacaataagataaacggtaataagattcattgttttttaagtctcacgtacgtacatacctacggagtacttgtgtgtttttttttctttttccggtgaacaggaaggtattagtttcctcttaaataaaatacatctaatctaatctaatggtctaaattatcaggtccaccgatttaagtgaaaattgacggtgagattaggtattgccacgtggcggtatatgagcgtttgcagaagtgtcatgtggtggcttgagagcgtttataggaagtttaatagacttttagtatataatagatagatagatgacactaatttagtattataaatattaatatttttatctataaatttagtcaaacttaaaacagtttgactttgatcaaaatcaaaacaccgtctcaatccatatttatggatacataggccccattctttttttattaatttacagatttcacctcggtttctgtttacacgttttccaaacaaccgttgaatggtatatttcgttcgaaaactgctgatacagaagatgttttaaaatatcagataaattcatttttaggtttgaagtaattaaaacttttgatacagaggtggctaatagcttttcctattttgtgtgtacgtactaaatctttgtgtcatcggcaggtccaaacggggccatattcttgcttacgaaagcaagcaagcagcgtgcggttttccggccgagcggcaaggggatagccatgaaaaagaagaggagattgagttgagttggagctaggcgcccgagcttttagctatctgcctagctttgtttgtgctttgcttgattgccgcgcgcaggaggaggtagaggtagtagaagccgccagcgcgcgcgcgcgcgggggcgcatgtgcgcgcgtcgcgtcgcgtcgcgcgtcgctcggggacaaatcacgtggacggggtggggcgggcggctgcgacgtcgtgcgcggcgcggcgtggcgtggcgcggaggcttcgcgccgttcgttcgcggtctctgagttaaatgtgcgggtcgcggcacatcagatgctgcctgctctgctcgccgccgcccacacacaccggccgtcacggtgttgtccctcccagctcccagatgtggcctgaaatctgaacgtttgaatgtcttaatcgctcgaaacgagtaaataataaatgcgtgaacattcaattgtgggattttctaagggtagagattttctaagggagtatggcatggtttagttcccaactttttcttcaaactttcaactttttcatcacatcgaaactttcctgcatacaaatttctaacttttctgttatatcgtttcaatttcaatcaaactttcaattttgacatgaaattaaacacaccctatgtgtgtcctatgtgtggagaggtgtgtgtatttgtctttccatccaatcgtaacaaagaaacaaaacaatagggtcttttttttttgtctaagtaaaaagactagtgcaaacaaaacaaccacggatcaaaatgtacatttgtggcgtaaggttcattcttctatgctttttcaaagtagtgtgttgttgaaacttttcttttgcagtagtgttactttcagtgctttattttcttctctctcttaggatgaaaacaatcggaaacggtatttatttttctattattacagaaacggtactgatacggtcggagctctctatttttacaactttaatacgacacaaacaaaaattagaaaaaccaaattttactatcatagacacttagaaagaatatttttcattatcttttatgaaaacggtatatatacggtgagaaaatttatgtaccgttttttcatcccttctctctctccttttgcacagataataaaaagtaaattcctggcaaccactggttgtttgggctaatcggtgctttgttggtcaatgtaagatcaccattgctcttgctccaatttcgtcctgtagtgggctttttcaacgagcccaacccatagaacccggcctggatcacgaaagaatctaggcccatctaagcactagcaaactgcaaacagctgccagcgatcactcgagagcgctcatggcaggttgacgttcgctgcatcggcgacaaattaagcagctacccgacatgccgacacgaactaatctgcaattggaattttggaagaatactggcaccactgatggactcaaccaatgtagtttgtaaatcttcaattcttttttcgtaatttttagaaagatttacaatggattaagaagacaaacctagtgctcaagccctaattacctagactcgtctctgccctgactaccaccgcgtaaactaatcacaaagaatcagagctcgaaaagatgcagagaattgaagtccatgcaagagatgaaaggagaggacaccttctctattctcacgatatgaattcacattatttcccaatcatattcatgtacatcgcatacagattaggcactcttatgaaatttggagtacaactcagaacaaaagaatcgaccaaaacacagctaaaaacacaagagcaattgctactgaaaggctactgatcacagtgtctcttccatgacccaaaaacatactgaaaggcgctactgatcgcctcatctcatggcctcaaaactagggagtaatatattgctccagctctctccctctccagcttcgtcagcagccgcagcgacttgccggcgacggtcggtctcgggccgccgtcgttgctcttcgacttggtgggatgcggcggcggcggcggcgcggcagcgttggtgacggcggcggtgggcgtgatcaccttaacttggtccctggatacgcgcacggggcggaagggatcgtggggcgggaacccgacgttgtagacgacgtcgaggaagccgtcgtcctcgtcggcgtcggacacgacgacggcgccgagccggagcacgaggtggcggttgagccccgcgccgatcttgccgacccgggtgcgcacgctcaccggcgtgcccttcttgatgatcggctcgtcgacgccggcggcgccggccaggaatggtgaggatgcccgtgaaaacttcttggcgacacgcccagtgatcggcgcgaggtgatccgccggcgtcctcctgctctcgatgtcgcggagaagcctcttcatgccggccgattgcaccgtcatggatggcatggtgctggaattgtttgatcgagcgagagaaaatcaggtgagatgggatgagagtcgagacgaggaggcggcaaaattatataggcggttgttgaatatgaaacggagtctacacgcgcagtcggagtcggagatcgacgcgttcacaggcgcagtcggagtcggagatcgacgtgttttcatttcccgccatctttcaaaattttgtattcgtaatgttggacgtgtgtggcggaaattgggctgggcgggttgaggagaagaggcccaggctgacatttgtacagcagggtaactgggcttggtttgaaagaggaataagttcatccgaggtcccttaacttatcaacgaaccgattttcgtccttcaaccgaaaaaccagatacaacgggtccctcagctgtcaaaactaatgcacatgaggtccctcggcagttttggctgatgtggcacctatgttattaatttgacttagtcttcatctgatatggcatggacgtgacgcttatgtggcaatgtgacccgaaaaaataaaacctcatgggacccacatgttagtttcacacataaactaatcaaaaatggtggggcccacatggccccacatgtcattctcagccccctcttcctcctttatcccgatctccctctcttttctcttcactctctctgccctctcatctcccaatgcttgatgcctcactgtcgtcgccgtccatatgctcccgcaggccgtagctcattggcgtccggcccaaagagatgagagagcaaaatagacttatttctaaccatataagacatggcccaaagagttgagggactcaaaataaacttattccaaggacgagcacgatgcaatgatcgtgccttcggatcgacacggcatgacccgagtcttattgagtcatgtctgggccgtaggcgcagtggctgcacaaagcaccatatggcatgtcgactgggcgtgccttgatgtaatgccccgctttcagcgagacgttaaaaactagtttaataaaatcctaattgcgaaaattccgttctttgagtgagagtctaagtcgtgccatggatctcaattcatatcccttgttccctctcgtcgacatcaaaatcctccaccccaagatttcaattccgattcaacttccgaagtcaaataccgaattcaatcgcatcctttgaatcctcaccaaatacttgtccctgttttcgcaaatatcaaattctcattttgaatctctctcttgacatctccttgactccaccttgtgttcctagaccaaatatcaaagttaaatccaattccaaacttcttttccttccaaaccagttctcacagcagaagttcaaaatccgtccctctacttttgtgggccgaattccctccctcggcccatctcctctctcagcccgtttccccctccccttcccacgtgcgccgcacgtgagccgctcgggagagctccctccctccctctctctctttgttctctctccctctctttgatcttccggctgccgcgattcgattttcgccgccgcccgtggtatcccgcgcgctcccctgccgtggccgaccggaaggacatcggtgtcactccctctggtcatcgcctgcgccgacgaccgtcctgtccccgctccactccacactgcccaccgccgtcaccatggggttgctggcgtcacctcggcttccatgtcccgggctgcccgcgtgcgtccaaggccgaaagcccgagagaatgcgcctttctcacgcgctctcccttctccctctgctcgcccaaatcggcaaggagcaaagctcctttccttccccttttcgcttttcccctgaccacagccgccaccatcacctgccacccctttggccgctagcgccggaaccagccaccgctccttgaccgcccttgatgtcggttccctctcccaaaccgcctctcctcgtgcctataaagctcgagccatccttctctatctctcccattttcgctccccaccgccaccgcgccattgccacctgagcgtcaagtttgccgccgggtgccgccgctcgacaaacgcactccgtctccttgtcctccgtcgaccgaacaacggtcgtcgccgcctcatcgcgaccctgtccgtgccgccccggtgccgtgatcatgacccacgcccccgtgcgccaccgactcccactcaccaccggatcaccgccgccaaattcgtggccgttggtgaaccctcgtccccttccccttatcgcgttaaacgttgtcaccaccctcgctttctctcttctccatcgtcctaccaccctcgatgctgcgtgtgccatgcgtcgtcatcggcctttctctctctaaccaactcgtcgtcaccctcccggagttccttgcgccaactctttgcttccccaaccgtgccatctcggagctgtgccgccccgccgtcgcgactgccatgaccacaactccatccccatcgacgccgttccctgtcatcgtggcccgccgtggctctatttttgtcgccgctgttggtccccctcccttcgaacccgctcaccaccacctttctcgagcccctctcgacctcccccttgctgttgcgtggccgccaaccgcccctcttgctaccgcgccgtgccgccctttccgccgccgcgggagcatccccgaagaccattgggccccgtgccacttcgcctcgcgtcgcaatcgtgtaatggttcgtctaagcccgatcccgcactctcttttccctccttgcgctcggccacatcacccatttggcgagcctcgccgtcgtcgccggccgccgtcacacctctcctctcaaatccaagccgtggaatgagttccccttgacctcctctagctgccggtgatagacgcccttcccggctcgccgccgttcgccggcgcccctcggctgccgtgcgccgtccgatctgggcaagcccgggctccctctctcttgcgcttgcatggcagtccacatgggctcgaccaagtccgcgcctgccccgtcagcctccttctctccctccctcgcccgtgggctcggcccaccagccggcctcctcctcggcctatcaatacaatcaaagtccaattttactccctcctccaagtccagtgaccccaatcatgagctaaagtccataattgttccctccaaattgctcctccctcaccctttgattggccccacatgtcaatgagcgataaaagaatattcttttccatagaattcaataaatcatttctcctattccagaaattccatttaagcttccaaaattcatatctattgatccgtagctccgattgactccgttccacttccaataattccgtaaatttgagatctatataatggcactattaattagtctaaatagggtctttcttttggtcttgagcaaggcaagtcaccctttgaccaattgctcccttaattccaaaataattattattttgtttgcaacctgcattattagaaatacttaactcgcttggcctcggtctgcgtgccaaaccgatggacctacccagtagtcgcactaattcctgtaggccgttctaccctgattccttgtcgctccacctttgtggtacttcggtatccgtgctctctgagcgcgtataccaactattccacatacaccgttgtttgtcgataattgaggaaatgggttcgagaagccttgaaaacccgacatgtggtgtcagtgtgtttgaaaataaaataaattgtgaaaactcgcgatacaggggttgtgcctgtgtggcgttgtcccgtatttgcatataaggaccaattcatgtgggaaattcatccgagcatataacaagtgcgaccacacgggtagaatgagacgctcttggttgagtaaatagcaaaccagggaagccttgatgccaagagacaagtggattcaccggggtggtgtcgaggagaaccactgggcttcctggcacggtatggtctaggacctaacctgttgttggtttgggacccctctcgttggcatatggcgactctgtatcggttttcgaaatgccttgtcatgaaagccttaaggtctcccgacgtggctgatctccacgggctgggtgatccgagttagtaatgttgtgtgggtaaagtgtaccccatctgcagaggttaactaactgttcgagcagccgtgcccacggtcatgtgctgatttgaggtgtttcccgttgcgtagttttgtttgcatgtgctttctgaaaagttgttgtggatgggaatcgttaccagaatcaacctatgtggcagatggatgacctgaatggtcagaaacggatctatatgattcagatgtctacgggcattatagactaggcttcccgagtggaagcagattgttgtgctgctgggcaacatgactctgggagtccgagaaaatgaaaaggctctaggagccgattaataagagaaatggctctgggagccaagaagtaatgatacgacccgggaggtcagtacattaccatttgagttgttgaaaagcatctcttaagtcgaatcgagacgcaagtctcttttcgacccaaacctgaaaagaaataaatcacctaatgatttcaaataaaaaatttgcataacaaccttgcctctcttccaagctgaagttgaagaagaagtaaagtgaagattagggttacgtcttggttcccagccatcgcctgtggtgttgggtgttagtccattggttccactgctgctactgttgttggtgtttgcctcgtatgtcgtcggttctattctcgggctgtcctgagctataatctaagttaaggaaaataagtcctctatttattttaagaattacaattattcatatttgtcaccgtgggtaccagcgctattgtcgtgggattgctattgagatcgcggtttcgtaggaagcggttcgcgccgtttttcctacggcatgctcctgttaggtgccgttgtacggcggtgccggatcgggatgtgacacttgattgtacccggacggggtccatttggtcatctatacctcaatgttcagaccgcaagcaaattacccactcccattttgcttcagttacctcatgaatccgctgctgacggccgccgccgccgtcgtcttgtgcttcctcctccatggcgcggccgcctccggcgacccgttccctccacggttcaactccatcttcagcttcgggagctcctactccgacaccggcaacttcgtcctccagtccgccggcctcccgtccatccccttcaaccactccccctacggcgacaccttcttccgccgccccaccggccgcccctccgacggccgcctccccatcgacttcatcggtacgtgttctacgcagttgccgtcgccgtcgccgccgttgttgattaatttctcgttgctgtgtgattgatgctgttttggcaatggcgcgcggcagcggaggcgctagggctcccactcgtgccgccgttcctggcgaaggaggcgaacgacttcggcggcggcggcggcgccaacttcgccatcgtcggcggcacggcgctggacgtcgggttcttcatccggcgcaacaacgcgagcgtgccgccgttccagagctccctccgcgtgcagatcgggtggctccggagcctcctgaggcgcgccggcaacgccaccgcggcggagcgcctcgcgacggcgctgttcgtcgtcggcgagttcggcggcagcgactacaggtacctcctctccggcggcaagagcctcgagcaggccaagtccttcgtgccggaggtcgtgcgagccatctgccgaggcgtcgaggtaactaaaacagtaaaaacacaaacaccattgcccaatgtccattgcatttgctcgcatttgtcgccgccggcgccgacgaagacgacgagtgtgtctgtgtgtgtgcagaggctagtggaggaaggagcgaggtacgtggtggtgacggggacgccgccggcggggtgcatgccgatggagctgaccaagtacgcggcagccaacgcgtcgtcggcggcggcggcgtatgatcgtcggacggggtgcctccggcggctcaacgggctggctcagtaccacaactggctgctccgggaggctgtggagcgcatgcgcggcaagtatccgacgacgaagctcgtctacgccgacttctacaagccggtggcgagcctcgtccggcgaccggcaaagttcggtaagtcgccgcgccgagattttttttcctgctttaattacccagtttcatattgtaagtcgtttgactttttttctagtcaaacttctttaaatttgatcaaatttatagaaaaatatactaacatttttaatacaaaacaaacatattatcaaaatatattcaatattaaatttattaaacctaatttaatgttgtaaatattgctattttttctataaacttggtaaaatctaaataattttcactaagaaaaaagtcaaacaacttatagtatgaaacggatggagtattttctactagaaggaaaaacaaaaaggaaaattgtaattatttgtttcgagtacaaatcggatgcactgacatggttacacccacacacatggacatatcctagctagcacaaatctaaagagactgaaggcctaacataaagacgcgaatattagagaatgaccttatattagataattagaaggggtgagacttcgaatccaggtcgtctagtctaccatcttgtggaagtggccgaaagacccctgtacgtttctcattgaaggcctaacatcgtgtagcgggtacatactttgtcaagcccaaaataatttgaacctttaacaaaatttgaacaaatttgaccaaatcagaaaaaaaatatataatacttccctcgaaataatttcaaaattttcggtcaggaattttaaaccatggtcagccgtaccacctgaaacttgaattgggtcgttagattgcaccacaggtaatctgattagctgagctcggaaaacaaatcctaataggctcaaattttgatgaattgtaatttgatttatcttttatagatcgacatcgatcagccatcgtcgtagctatagctcataaatgcgagtgtgcgacagtagccatgtacacacgtaaagagatataagagcaggtacaatagcaggctataaactagctgcaaacatattttaaggagataaataaggagagagaagagtagcgggctacaaatttatagccagctgtagcacggactccaagacacagtgtgtatatgacaagtgggaccatatattaatggtgtagtatgtaactattgtatgaataagctattagattggctatagataaattggagctagtagttggctatactattaaacttgctctaatgcctgattagtgaagtcaaattggttgatgaaacctaaagcgatagaacaattaactgcgctagcttgagtacttgagcacttccaagagctttgcaacttacgaaattttagaatctttaggtacgttaagccatgaactatgtcgggaaggcaaagccgaagaagttacaagattattgtggcttgtggatcgagaaactagctataaagtctacaatcacagtatctttttatgaaaacaatctggcatgcagctgtaattttgttgggtgtcacacaaaataatctaccagccagcttgggtcaactctgctagcatataaaattacaaaacacttgtagaaacccaatgaaccctgttaggtttgttgacataagggctggtttggttttaggcctaaattagacttatcaatatttggcaaatttaatagtgtttagtatctatttggtttgaagccaaattttgacatgcctaagaaaataggccatttcaatagtgaacttaggctattttagcttcaatccaaacacaactttacctttccaaaattagtcatgccaaaacttaccaaaatttggcactgacaaaatttggtaagacctatttaggccacaaaccaaaccaaccctaattctcgctcatttcaatctaaaccaggttagtccttttggtcatatatatttaacgtctaaattaatatttctagtaaattcgtcaatcttaaaatattcttgccgtctttcagaaatgcttatagagatatggtatacatatgtgcgttcatatgggagagtgcatgtgcgttatcatcactaacgtttataatgtgtttcttaaaaaagattaaaatattattgaccaccgataacttctcagatagttagtaaaagaaaagaagaagtgattacatagatttttgtttcttgaaaagcacattctatatacttactagattttgaaaatcttataatataaacataaaagtcaaagttnnnnnnnnnnnnnnnnnnnnnnnnnnnnnnnnnnnnnnnnnnnnnnnnnnnnnnnnnnnnnnnnnngtgaatcatggccg

SEQ ID NO: 30006 - DNA, 1400 bp, Oryza sativa
  unsure (1)..(1400): unsure at all n locations
agtgctaccgcctaaaataatatatattaacggaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattcaaacctaaattaatcatcaagggcataacagacatttgcaaccaaacgcaacaatgaaaagaaggaaaatataatggcaggggtatggaagggatcaaattaaaatttcaagggtatagaagggttaggtaaatttcagaggtatgaaagggattgagtgagtttttataggtacacatggaatttactcaaactgcatgtgttatgttggtctgaatgtttgggttgcggtaatacaggattccattaagaattttccacagctttttcgttaccccaaatcctctttcaattgtatttcgccgcgagacatgcacctagttgaatatttcactagtacagaagagctttttccatacgggcgaaatggatctttccatgcagctagcctgcccgcatggaacaagaggtctgtaaaaatcgatatttctccatgcgggcaacacaaccgcatgcaaaaaggggattttcacatgtggtccacaaagccaaccgcatgcaaagatatttttcagccaaaaaaaataaaattccaaaaaccccccgaaaccctaacccgtcgcccgccgcccaccgccggacaccacgtgaccggcgccagatccacgccgctgcggccgccggccgtcgcggggcagcgccgtgcctgctgccctcgccgcctgccgtcatcgtcgccgagcgtcgtgctcctccgtagggcggcggatccggccctcccgaggacggcgccgccgactcgccgtgcccgctgctcactgccgagagcccctaggacggcggatccggccttcccgaggacggcgccgccggatccgccgccgtaggccgtcgccgtgcccgccgctcgccgccgagaccccctagggcggtttttttttcctcccccattntattcacacgtactccccagatttttctttctttgtatgtcttctttgtacttcatctacacatttcttgtattgctcactcctatctctccatcttcaacctccactgtgtttcaccattcattatcgcgcccgcatcctaaagtttacg

SEQ ID NO: 30007 - DNA, 1373 bp, Oryza sativa
  unsure (1)..(1373): unsure at all n locations
ccggaatcgccccccgtgggcggtcccagtgcccgccgctggcttcttataccccctaggagggcggatccgcccttcctatggagggcacagccggatcaaccgcggtagtcggtctccgtgccccccgctcgccgccgagccccatagggcgccggatccggccttccccccgccggatccgccgccgttcccgctgtctcgccgcaggcggtcgccacagcggctccttgctgtggtcgcccgctccctcctagcggcagccgccgcgcctccttgcttccgccgctgctcccgccgtctcgccatcgcccgccgcctccttgatgtcgccgcccgttccctcatagctgccgccgccgccacgcctccttgaggccgccgccgtcgcttgcgtcgtctcgctgtcgcccaccgcctcctgccgcggcccaagtgaggggggagagagagagggaggactccacggcggtgaggaggggggagcggtgaggagggggagctgcggtgaggagggatggcggtggcgtcgccgctcgagggagtcgccggcgacggagggatggccgaggagtgagaaagtgagagactgagagagatagagagagacgagagatctacagagagagaggagataataagtgagaggagaggaagagaagataaggttaggtgtgaaattttgaacaggtagagagggaaggaagagggaccatttttacaagcgggccatttaaccgtccgcatgcaaaaattgattttttgcttgtggctttttagattttaaattaatttttatgtcactatattaactcatatgaaaaagtttgccaaaaacaaagttgtagaactcatcaagatctacaacttttgttttggtcatttttctatatgactttgtttgaacagtttgaaattgaatttcaaaatatgacaatttcaaataaaattttcaaataataaatgatttcaaatagaaatgtcattaacaacaaagtggtataacttatcaagatctataacttttgtattggtcatttttctatatgactttgtttcgacagtttgaatttgaatttaaaattatgataatttcaaacaatattttcaagtactaaatgatttcaaatgaaaaagtcataaataacaaagtggtataactcatcaatatctataacttttattttggttatttcttcatacgacaaagttatttgtaacactgttcacaagatgtacatctcttatatagttttataaactatagagagatatgtaaatttnnnnnnnnnnnnnnnnnnnnnnnnnnnnnnnnnnnnnnnnnnnnnnnnnnnnnnnnnnnnnnnnactggcgattcagcaatcaatnccca

SEQ ID NO: 30008 - DNA, 906 bp, Oryza sativa
  unsure (1)..(906): unsure at all n locations
agcgggcaaaccaacggtgtttttgagttcccctccaaatacgttcggacatggcacactcttttggtgtatttgctcaagtgcccgtcaatggccaggtccccttgttttggcttgatccggctccattactggggacaaactcttctctcatctcccccattatttcctcccaacatttgattaacctttgcccaataatcaatcaaatccctcattgaaagcaatcactaggttggtgtgtctgatcatcgccaggtgtatgaagtctgaccaaagaatctcagcagtagcaggatacatcagagcatcagagttgcagaacagagtctgcattgcatcttacaagctgttaatctcactcgacctgtggattcattcaagaaccgattgagagttgacatgagaaatgtgtttgatgatctttgatgcaggatacaagaggggcgcgctgagggcgtgcttcgtcggcggtggtccgtacaactacaacatgagcgcgtcgtgcgggctccccggcgcgacgacgtgcgaggatcccgacgctcacgtcagctgggacggcatccacctcaccgaggcgccctaccgcttcatcgccaacacctggatcaggggcccctacgcccaccctcccctcgccagcgttgtccgcgacgacatggtctattagattacaggtgatgatgacctccatgtttttttttcaatttttggatcaccagagatgaagaagaaggatatggcgtatggacttgccttgagtcgagttgggttggnctgagagagagagagagagagagagagagagagagnnnnnnnnnnnnnnnnnnnnnnnnnnnnnnnnnnnnnnnnnnnnnnnnnnnnnnnnnnnnnnnnnnnnnnnnngtcattcaaaggggacag

SEQ ID NO: 30009 - DNA, 861 bp, Oryza sativa
  unsure (1)..(861): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtagctcttttaagtaaaggccgggatatgtattccattatctaaaaaaaatattttttttcaaacgcgcaaaagaattgcacgttagtatattaaaagaaaagagagttaaaagagagttttagttgcacaacgcaacatagcagacctgccattgccgttccatctaatatatcagcagcagcaaaaatgcagaactgaaaattaatcacaaaaaacccggtctaattaatgagtcaaacgggtgaattaggctgacacagtgacacgtactcgacgggaagcgactaatccccagaaaatatataattcactgttgacagtacctcaccgacataattagccgtccccgtttgttttactactgttctccagacgcctcaaaaacaattcttaacagttttccaagagcaatcgcatggactttcctcagaatccccatctgatttcgagccccaaagcccttgatttccacggccacattgatcgtttcccgcattccgtggtgcaattaagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgcggtataacgaagaac

SEQ ID NO: 30010 - DNA, 835 bp, Oryza sativa
  unsure (1)..(835): unsure at all n locations
ngccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcaggtacctcagagacacagctaatgcttgcttgaagtttggcaggactaataaggggcttattggatatgtggattctgattttgctgcagatttagataagagaaggtcactcacaggttatgtgtttaccattggtagttgtgctgtgagttggaaggcaacattgcggcatgttgttgcccagtctaccactgaagcagaatacatggctattgctgaagcatgtaaagaatcagtttggttgaaaggattgtttgctgagctttgtggagtttattcttgcattaacttgttttgtgacagtcaaagtgctatatgccttactaaagatcagatgtttcatgagaggacaaagcacattgatatcaagtaccattatgttcgcgatgtagtcgcgcaaggtaagctgaaggtatgcaagataagtactcatgataatcctgttgatatgatgacaaagcatgttcctgttgctaagtttgagctttgctcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgc

SEQ ID NO: 30011 - DNA, 1759 bp, Oryza sativa
  unsure (1)..(1759): unsure at all n locations
cgggcnnnnnnnnnnnnnnnnnnnnnnnnnnnnnnnnnnnnnnnnnnnnnnnnnnnnnnnnnnnnnnnnnnnnnnnnnnnnnnnnnaaattcgtcaatcttaaaatattcttgccgtctttcagaaatgcttatagagatatggtatacatatgtgcgttcatatgggagagtgcatgtgcgttatcatcactaacgtttataatgtgtttcttaaaaaagattaaaatattattgaccaccgataacttctcagatagttagtaaaagaaaagaagaagtgattacatagatttttgtttcttgaaaagcacattctatatacttactagattttgaaaatcttataatataaacataaaagtcaaagttttaaaattttgactgaattttatcttaaacataatcggagggactaacttgtttcaaacatacttgccaaaatttttttgtccgacgatataaaatttacatatctctcgtcccatgtcaatacactccatatgtatagcaacgtaacaatgtaatatgtcattacacttcatatctaataatacgagtcttaagtgctcttgtattattttgaaaaatccattatcttagaaaaaagaaaaaggtaacttatctgacttggccttgcaggtttcacgcagcaaccactgaaagcttgctgcggcgggggcgggccgtacaactacaaccctggagcggcatgcggctcaccgggcgcgtcaacctgcggcgacccgtcggcctacgtcaactgggacggcatccatctcaccgaggccgcatacaagtacgtcgccggcggctggctcaacggcgtctacgcttacccgtccattcttagcctcttggcccaataaccaaggtagctagtgcggatgattttgtacgtcagtagtatgtacgtgcattttgtatgtcaatagtctgctattgagcttgactttgaaatgaccggataatttggacagcgagtatatctaaattcatagtaataaaatacatgatatattcttggacggagcgagtacgatgtaacaaggtaagagcacttgtttgaactatttgttaggtctaaatatataatatcttcagtcataaatattaagaaaaaattactagacaaaagtaaaaacaaaaaactgcctaaatattatgcaatatgcaccatgttagttaacggaaagctacaaaagctgcctatgtctgatcaaaactacatgtcttatgagacattttacctcacaacagcttggtgcttcaatttactgaaacaagacacgaaacaacaggttgtcttcttcataattcaaaacccaatcagctatttaaattaagctaaataagaaccatcggattcttgaataaatacgaatgataaataagaaagtgtttccttacatccgtcagtccatcacacgactatgtacatttgctactatcgcaatgctgcatgttactgcgataactgacaatacccacgtgctaccaccaaacctgaaggggttagcctgaagctgcatctgatacttccatttaattgtctcaacaaaatggccatgtaatggttggtgaattctggcagtgggaggtggatctggatctcagtcgttttggtcttttgaacccttgcttgaatcttgggggggggggggggggggcttatctattattcttaattatttccgtcattttatatctattgcattctttgtacttttacgtctttagtcattttcccttatgtttct

SEQ ID NO: 30012 - DNA, 5438 bp, Oryza sativa
  unsure (1)..(5438): unsure at all n locations
tgtgccatgaatgacagttnnnnnnnnnnnnnnnnnnnnnnnnnnnnnnnnnnnnnnnnnnnnnnnnnnnnnnnnnnnnnnntagcagatcatccatttctatctatccctttaacgacaactacttaaacctctgggcaattaatcatcatcatcatcaattaccaacttgtgtcttcttttcagaccaggcttttgatcagcaaaagagctttccatgtccccagattcggtgatatttatatcatcgattaccctttgctcagtattttcaacgttatctagctcaggctcaatgaagtcatccaaaagttctgtttcaccagcaccgccactgttattagacgaatttaatccatggtgcagattatccctgaaaagagaagttatttacagttgaatcagtgtatcaaataataaggtactcttactgttatttatattctagctacttagttttcactaggcataagtgcataatatgatatgggtaacaatagaggaacaaccaaatatgcagcacccttcaatattgaacagcttcagtttcctcagcttaatagttctgcttcacttaagtgcaagtttactggcaaacaatatttggggatgccatgtaaaaaaaaaaaaaaaaacagttcatgagaagcatagaaacattcaagaatctatcactggttaggggaaaccattcttccaactgatgtattttccaaagcatcagtctacaacttcgagaatccaccacttgtgatgcatgaaagaactaacaaatatattttatgtgcaaagacaaaagtagcaggatcaccataattcacagcagtctattctggtgaataagtttcacacagcctagagcccgtaaaataacatctgaatcattcctgttttttttatgaagcttatgatatgacactgataacactacagaagtagttcacacatttgctaacaagtatgaagagaacagatcagacagtttgaagaatttttgtgccaagatgaacgaacttacttagaactgatagtttcatcgtcttgacctatgtttttcaaaggctcttcatgttcttgtgtatttgctgcaaaacctgacttcaataacctcttctttttcccacttctgttaaaagcagaacaaatttacttagccaaatgtgtgggacagaagaaaagcaagaatttatagaatcagtaaggtttaacaattggcataagaagatttatatggtcattttattgatgagtgtaaagctgtatgagctcacctatgcatagagtctatgatctcatcaccagaataagtgtcttgcagggcttcttgtttttgagatatttccggtgaataattactggtgtttgtactgtctggtgactcctgatgtttctctatattcattgcattgtccggcgtcaacagcctcttcttttttccacttctgttaaaggaaggacttacatgatttagtttagttaaacatattattattaggaaataaagatggtaacacacagaattaatgagggataacacttcctttgtgtaaaaagcggaaggagctcacctgagcatagatcctatggtctcatcatcagaatccgggtctgccaaaccatcttgatgctgtgatgtactaggtgagaaacccacaagtggtaccttcttattttttgttctgcgaggaaaacactcaaaatatcaacatataaaggataacaaaaattaatttcatcttagtagtccatgacattttgatgcccagtacttgaagagggaaatgtaacctagattagttgcatactaagtattaatcatcatattctctgataactcaaggagacaaacttggcatacaggctatatcctgaatataaaggctgtacagcacatagtttgactacaaaattgattgatctgcaggaccatataaaaattactattgcatcactctgttttgcagaaacatttggtattttcagtgcaaattacccaaacagaaataaaatatacttctacctcacgatttaaatgtagcggcaatatttcagatcacattcatactttctgaaatacaggcttcttaacagtaaaatgatttcagattcatttatctcgtcaacaaagttacttcgttgaaagcaacttacagggtaactcacctgcttttaattgcttgtaatgtttcttcatcagatgattttccatcggtagtgttgtcctcatagctagcatgcgacacattttgccttttccttctgcgcctaaaaatgcaggttatgtttagtaacaagtaccaatgaagtgaaatgtgaaaccaagaaagcatgcatattatgtttgatagaaacgcttgtccagtaaaagaataagggtcagttgcacttatccatacaattggtaagcacaaaattgattatcgagcattttttagaaggaaccacacattaggaattaggctgacttgaacttgtataataatgtcaacagagttcatttgcttgtgcataactgtctactaaacatgtcaatagaagtcagataccattacaaagtgaatgtcacagctgatcatttataataggggcaattgcagatttaccactattttgaatcgttattgtaaaactgccactagaaaattgaaaaaataccactagaactatcattcgagtggcatccttacaaaattgaaaaaaaacgatggcaaatttgcaaatgcccctttataatactcaccgggtcgtttctggcttgggatcacagttgtgttcacctagcatctggtccgtctgtgtagccaattcttgagctgaaagaggtgcctctggaacttttgtcctcctcttcatggcattcctcaggcctagctgtgtgagctttcgataaacttgaacagaagaaatctttccactggggtctaaagcttcagcaatgagatgagtgcatttgcggtcatctttgtatctgcaatacgaaggaaataaaccccacatgatccctacctaaatgactaagccttacatactaatgaatacaaaattgtcctttttggggagggggtgttggtgcttcctcacacagattatgtggctacactagagactaagttttgttcaattgtatgattctatcattttttttgcttgatacaaattgaatacttacttttcataaagatctctcataagcttctcttgctcttcactaaaaatggaacgacctcgccttttgggggcttcagaattctgagaacctcttgatacagtgttcctatttttttcaatttgaattgaactgaggattaaagaagcaatcacaaattcaaatgtagaaccatgtataaagcaaacctatcattatcgtcagcttcactgtctgaaaatgacaatatcctgttacttttatttgtggcacccatgcttctcttagaaacatcttcatgttcgccagacgatgaatcatcatccctgcttgtatgcacataaatcatatcgtcactcatgtgtttcctagttgccgctatattaatggacataaacagaacaaacttacttatcagcattatatggttcatgtggtataaccaagtccacttcgtcatcaccaagagaatctgctatgtttattgaacctctccatcccttacttgaaccaatttcgccacccttgtttgtagcatcttttgtgatatcactcagaagagcatcagcatcaatgcaatggcactccttgcgtgttttccaaaagagtacatcaacaaatagcaatggttgtttcttcattaccctcagcatctttcttacaattttagaaagaaaatttacaatgttcgtatactcctttgaatttgatgatttctcgtcagctaatatatcatagaaggtagttagaagggacagctgcaaaagacagcacaatgttagatcccaaggaaatatagctccttacataaatatatatcagcgtatttttacctgatagagcattggtgccaattccaggtcttcgcaaaatctccgcagcatgcatattatgtagtgatttgttcgaaaggagttactcttgtaatgcttcaacaaccaacatatattttggacaacagaattgttcgcaagagtagatattagtcgggatacattgaaatcaacttcactagtagcagggggttgatcatcaagtgaagagtctgaagtcccatcctcttcatcaattagatttcctttcagttcaccattgtctgcacgagatggctcgccttcacaatgcgaggtgctatccagattaactgatgtgccagcaagttcatctggtgcatccatgccgttggagacaactttttcttgctctgtgagaggaggctctgctacagaatccacatttttcaaatctggaagtgattcaagtgcagatttagtcccatctgttgaatcaacattgctctgttccattttctctgcattgagatttgtgttctcaattttgttctttgaagccttcttttttcttccttttcttgtcctttttgcaacctatagcggtgatcaatagtcagctcatagagaaaagggaggggcaaaaaatctcagcataaaatttctcatcttcacttgaacaaataaaaattgatagaaaccatagttgcttaaaaggagatgcagacagatcatagtgtaacttggtggccaagaaagcaaggcatacccttaatgcaccacgtgcttgaagcttctccatgagctgtagcatgatatggattgttcctagtaaatctgcaagatcactgataaaacaatagatatgttcatcaactatttgtaaaaatgtattattagattgctatatagttgattaaaggaaaaaaaaaaagactcgtatgattgtctagaaaccaagtgcaacccaaaccatgcaatgccctttcacaagaacaagtgtttgcagaatgtagcagcttgcacacagtatcccatagtaattttggaccttttcctaatataaatatccaaaaagaatcacttgtacaaacctttttggttgcttatgagtatcaaatgatctgaataagttcagcagaaattgagtgagcccttgttctgtctgatcataaaacagcttatacagtaaaacacgagctgtttgagattctcttgaatcatcaggaagtactttaagcaccaaatataccatgtcaatctgcaaggtaaggttcttcagcacgtagattttgaatgtacataaagtcataactggacaagccattaagacagtagaactaactgaactaggcaggttcaagcctttctttctaaagtatataagattctctttttcaagttaataataaactnnnnnnnnnnnnnnnnnnnnnnnnnnnnnnnnnnnnnnnnnnnnnnnnnnnnnnnnnnnnnnnnnnaggtgatccacctnnggccac

SEQ ID NO: 30013 - DNA, 12005 bp, Oryza sativa
  unsure (1)..(12005): unsure at all n locations
atgtccaatgatatcgcttgttnnnnnnnnnnnnnnnnnnnnnnnnnnnnnnnnnnnnnnnnnnnnnnnnnnnnnnnnnnnnnnataatcttgtcaggaaaagtaaagccttcctccctcttgctgctacagcgccacaggtgctgtccatggtccacaccagtcatacgtgattgttttgggcctttattgcttgctctaggtaatattcatgattacgtgttgtttgaagttgaaaatactataaaataattaggatagtgttttacccttttttttacgctgagacatgaataaataccagctcatagagcaagtcatgttatttccagaactgttcttttaacaccgatagacaatacagtaccacaggtcaaaaccagtgagtcactgaccataaaaatgcagcacaaatggcccatgagtttaattcaatacctgagcatttgatgccttctcgtgttgaaaagctaagacaaagcgagcaactttgaagaatgtagtgatgtcagatttctggatagaatgatgctcctttacgatatcatcacagacagactgcatgaggactggcaagcactgtgttatcccaagctttacatgaaaatggaaaatagtagttctggttggcaaaaatgaaatggctaagtaactcactcaccattgtatcctccagataaaaattgttccaggaaatttcttatcatctccattgtgccctctctcggtgtgtagagaagctcattatcccaggcaatccttttctggggccctctttggacattacgtattttccttaggctatttgcagatgcggagttggggttccctttgcacaaggatttagatccgtcctgttagttcaagtgaaacaaagtaaacaaacagataattatctgcttatggtgcaggattcaatttgtagcatttgataacatatggtaccactgccgtgcatgtaaaaattccactgattgagtgatgctctgagtttcgttgcctgaacatcctctttttcctctcttcctcctccatcattaatctcaatgaatgtactgatgtatcgatatttccttcaacatgttcctatggaatatgactagagtaagcatgagtgtttcaattaagaactaaaggagtgtctcaggtgatctacataattaatgaaacttggggaaaggttcagagaaaataaatacctttgaacctgcagtagaagctctagcaatcaattctggatcccggcctaagaaaaggtaatgaaagatttccaaaagaagaaggttttcctgctggagataaccagatggctcatccatatgttgagtcagcactaatattagatccatcacattctcttgaaacatgagctctaaaaagctgtcagctagacagagcaactgggtagcttctccagatgccttctgacccaatgtgatttcttgaatagccaagatgttgcggaacaaagtaagcaccaactgaactagtttccagtcatcttctgtgaatgaagctctggttgccattgtaaagtaaatcataactactcaagttgcaagagcagagaaaatacagcaaactaaataactgaagaacagaaagaatatataagagaaataaataaagctcatttcaagtaggagaggatagacaggggtgacatgcagtaaattgactaattgtgtatcctggtaagtgtgctccactctttcagtaccaaagaatcatgagttactttatggctttatgctatgaaatatgtaagttagaagattatctcttcttgacagagtgggtttcctgatagaaaaggaataataccatctcttgttaataagaacagtaaaatataatttacctttccaaatggtccagtggatcttcaagaagagacacaatgacagccatagcaacattgcgcgtcagtgctgccttcagatcccaaagatactctatctgttgtgcaacattctctgatgacggctccacaggcattgtaaggaataccagcactttcacttcaaaacagaagggagagggaaaacatttaatctcatagtgctgcatcgaagtattaatccaaataaaggcatgatacttaattatttgaatgagaaaaaagcatataatgaggatatagctgaatgcaaactccatgtctgcaattataactttgaacaacaagataatactagagttttccatacacacaaccataacattctcacgagatgcaagcaggaagaaaggtggtatgcattcttatgccaattatcagtctctctagttaaatctaaaggatagacctaaagtatcattaaaagattcaattacggaagttgtaactagcaacaattgtgaaaaacggattgtcaaagtaggcaggtaggtgctgctgctgcttaggaaaaaaatagcatataatctagcagaacttagctgttccttatatgtaagaatagaagccatcaattatgtaggatacctaatattattagagatgttacagccatataaaaaatgcattgtattctcactttctcagcaacagacacaagatatatattgagtacaacacaaatgtaacaaaaaaaaacatgcattaacaattagtacctagccacgcaactgtgcagggaatttgcctagtttctgataaattggtaagcgaagttgaattggggacagaatcagtatccaaaacagcgtgtgagtcctgactcattcatacatttgcttccacacatcacattcgttatttcgcaaagttcaaaagtacaaattggtttcataaggaagaaacctatggactgaaaagaaagactctggatcatcagactatgatttaacaaatgggcacagaatgtgagcaatgtttgtttaatgatatcaattctaaacactactacactggcacgaagacaacgaggaacaatactttgtttgttgacatcatttcgtcaaatcaagacaaaaaaaaataagtgcacatataagctatccattttcaatcaacatatgtgacaaactccccgggagattgttcgaaccaaactcattatgtgacctttcggaaatgctggaagcgaaaacgaaaaaaaaaaaaagaaaaccagtttacctgccgtgatcaccaggttgcgatcagcctggtaattctcaatgatgggcaccagatctctagatgcgattttccacttgcaaacctgcttgaaaacctcccgccgctgcgggtcatcccgccgcaggaatctctgcagatccttcagattatctgaagaagaagaaaagaaaaacgcaaaaacagatttagcgaccactgcgtggcggaatcgaaatggagccggaaccaaagcagcttgcggggagaggcgcggaggcgatagataccgaggcagtgctcgcccttggcgtagcccacgacggcgccgccgtcgtcctcctcggcgccaccgaggccggcgcaggtgagcgagagcgccgccgagtccatggcggcgctagggtttaggcgaccgagcggtggtggggaaatcggatcttggaagggagttgggtgcggattgcggaggagaaccggggaatcgctcgaggggagggggaatggatggatcgctcggggtggggagagaacgggaagatgagatggcggcgcggggaagacgaagggattgggggatttttcccgccgatgcgcgccatttcgggaggattttcccgcgcttttttccactttgggcctttggcccatgggccggaaactgtgaaacattttgggctatgtccatactttacatctgaaaacccgagattgattatttcttcgtaataacatacggagcagtacttaattttttaaggcaaaatttgctataggacacttaaaaaatacgtaattagctgtgggacaccacaaagacgtgaatttgtctaaggacattataaaaatatagtaatttgctgcaggacactgaacacattaaaatataatatccattcaattgatgagagagaaatcacataaaatgacaagtttgcccttatcttcctttccctttcagtttgttccgagtttcgacgctcacttgtggcaagctctattggcttgcccatggtggacaggcgctcgcgcatagtcgacggtgtggtcatgtggcatgcctccggtaccggccttatccccaccccaatccccccgctgaccgcgtgcgcgcgtcgccgagacgttcctaggtggcggagctcccatggatttcggcgacaaaagccgagctaaaaagtagtcagagagtaaatgatactaatgaacaactagatgaccaaagattcaaaattatagtttcagagaacataagctaggcttccatagaactcttttatatagtactgatctgtgatcactagtcactacacacaccaagggaaggagagaaaaagaaagattagaagcagagacatattgctatgtcgaagaaggtaaaattaaaagcagcaagaaagcagaggaaggcggctggctaagcttggatccaaaagttcagagatttgctgcaagcccgcaagagcaaggggtgtcttccgccgctagcggcgttggccgcgagcttgatggacgacggcagcgggctgcgcaacaacgcgcgcggcggtgcggctgctccaggtgcctccctgcgacgtcatagtagatcatgccagaaaaatccagcgactggcaccgctcctccatcagtatctcctttctccacacaccgtccttcatgcggaagctcagctccggcctggcctttctccttctcgacaacgacgagatagccttcttgccgttgccgcctccgccgcctaggaaaggcacgatggcgcgcgacgagaaggacaccgcgatccccacccgtggccgcaagtgctaccgtcgcgccgcccgcccaggaaacccggggccgcgcccctcctagcctccacctgcccttctgcgtgctgcgcgtccgctctaggctccaaacagtcgccgtctggtaatggggtgatggattgggggaatcaatgaaggattgggtagaagaagataatggcaaaaatatcattttttatgatttctctctcatcagttgggtggatattatattttaatacgtttagtgtccagcagcaaattatcggaattttggaatgttcttgggcaaattcatgtctttataatgtcccatagctaattacgcattttttgagtgtcatgtagcaaattttgccattttttaatacacagttgacttttgatataacatttgaccactcacttattcccactaaatcctatagcttaacatgcaaagataccacatcatcatccactaataattattacatttaaacatcatgcaagcatgtatattatttataattttataatttattagattttatagctttttaaatgtaagcatgtagtataatatttcaatatgtctcttcatctttattttaaaatatcttatatatccatatagttaatcctaactcataatttagttaatatgctctatctcttctctcattaagtcatatcacatcatctatggtctaaattatctccctctctttcttctcttattaagtcatatcattttaattatttttagcccttagatgattaatctatgattcaaactatcttactccttttcttctctcataaagccgcatcaacttacttttacatttaaatcatcattcaatatactattcaaatttaaattattataaaccacattaacttacgtagatttatattatctagctatcttacatattacttttacttagtgctattatactaaactatcgcagcaacgcgcggggtttcacctagttaataaagaaaatatattacttaaatttttttaataagatgaatggtgaaacatgatgtaaaaagttcaaagcatcatgtataaatgaatggatatagtactaattggcttgtgttattttgcgatcatagttggtttcattttaatctaggaaaaagggttacattccaagttgttaagaaaatgcttgacattggaaaatttatccaataaagagtgtcttttcatattagggtcaccactagacctccatcctaaaagaatattgttttggttattttgttcagtaaagattgtatttctgttcatcattttttttccttattttaacccccgaaccaattgttctcctcctcctctttgttttcttctctcagattctctctcaacattaataaagatactaatcttttaactcctaaactttatctttaactgctccctcagtttaatattataggttgcattgactttttttagtcaaactaaattgattaaatttgaaaaaatagcaacatctaacacaacaaaatagtttcattaaatatattttggtgatacgtttgttttgtgttaaaaatattattacatttttctataaacttcatcaaacttgttaaaagatttgaatagtcaaaacaatgtatgacatggaacagagtgagtagaagatagtttcttacggatggagtacttccaccatcccatattgttaggtattttccatttgtaagccaaacatctacaaatttgaccgtgttaattggataatgtgttaatatctgtaacacaaaattagttttgttaaatccaccatctagtatatttttctagtatatttattttctattgaaaatattgttacaattttctaagtttggtcagactttacaaattttgatgtttgataaatctaagatgtaatgtaatatggaataaagtagtactattctttttttaataaatgatggtgttgactttataatagtatttggtgattcgtcttattaaaaattagtgtaaatatgctaaagtataagccatacataaagtttctttaatgataaaacatatcaaaacaaaataaataacatttttataatttttaaataaaataattagtgtcaaaaaggttaacggttttattattttaaaaaaacttttaaaatttaaaagtaaacacttcctaaacttatgtccaagatacgaaccttttggtcatgtcagctaggctaacatgcaaaaccatactgccacatcggtctcgctcatgtggcaacgttatttggtcacaccggtttggttagcgtggcaacattatttggtcacgtcattgttaacatcaaaatttgttatgtttttttagtgaattcggttaagaaaagaaaccgattggatatgaaaatttatatagataaggttgaatttaagtaggagtcctgaaaaccacagcaagacagttttatatttcttttagtatatctcttaaataggtagaactaattatttccttttcttgttatgaaatcttatctcatgttcaatatggacatgtacaaacccaagagtataaatatgtacacccatggtctctgtaatctctcatatcaatatataaattttggcgcatcgcctacttttaattttggcgagttcttagtttcaagcggagctgcattatttcattcgctgatgaggaactacgctatgccaactttgattgtaacaatttagttagaactttctcgatttagtccaatattctaattagttgctacaatcgctgcctatcttgatataccggctttaatttggctaaggattcatcggttcgacctcttggtccaatctgatatatccatcgcatttgtgtagatctatcggctaaatagttttttcttattatcgtcaatcttatatgtttcggttaggtctgatctattatattatattgctgctaattagtttaattctactaagtcgataggtctttatgcaacatttatcggagttcgtagtgatgagttatctacaatttctgagtgttacatcggctcatgtttaattcagtatactcactagttagatatctctttattaactttaatcttgtgctgtctcggtttgatccgatctatcgaggttgtttttaataaggaacgacttattagtgattatacattgcttagttcttagccgatggtagcataagttttgatatttatctattcaagtttacatcggacccatagtcgttgatctaaactttgttggcatcggttgcccttgctatatcacattgaattaactgacgcgccctgaacctcaaatttagaatctgcactggagttaaacagatatcctaggtctctgtgtgttggataaattttgagccggcaaccatccttgctagcgtggcaggataaaattatcacgcccgttacgggtagcatgtgagtgtttttttccataccagatgggtagacaagacaaagggttcaatttttttgaaaataagttttgaaatgttatttttaaaatttaaaattaaaagtttaaaaaataataaaaaaaaaagttaacatcatcgtctatcaaaagaagggatgttgcttatgtcactacagcctatcagaagaaaaagaaactcagttatcgtagtaaagtattccctacattctaaattgatctacatatagtttttttagtttattcctaaacgatctacatatttgtgttcatttattaggtttgttcgttatttgtgcattgaagtaaatggacattgatgcatgcatctatgcacacatgtatttaataacccacatgcaatatcttgatttgctattggttaggaaatagtggggatggtgcatgtattgagtttgttgctagaataaatatagtatgagagagttattagtttttcttggtctttgtgtacctatgaaatatgtagatcaatttagaatggagggattacgaagtagtaggagtgacactcttgtcaaagtaaacagtaaacagtaaacgccactgggagtcggtgacgccactcttgtcaaagtgcttaacactttaacagttggattagcaaagtacaagtagcgccaccgaatctagcatagcaaccatcccccttccttcccttccttgcttcttcctcctcccccctcccttttcatcctcaaccaccaccaccaccccgcgcgcgacgccatgctccgccgctagcccacaccctccccccacccaggcgctcggcgaaatgtcccaccgggcgccaatgccggggggctcctcctccctctccgacgccctcgccgccgccgcgctccgcgacaagcccgactcgctcccgccgggccgcctctcccccgtctcccccctcgtccactccaggctccccactcccacctcctcctccggctcctccggctccgctccgccgaggcccgcgcggcgtggtggtggtgactaccacggcgtcggcgaggggttcggcccgctcatctacacgtcgtgctcgtcgagcgcgggtggtggtggcggcggcgtcggcgcgagcacggccacctcggcgctcgccgccggcgcgttccccgcggggaacatctgcccctccggccgcctccccaccacgccgccggttccgcctccccgtgccgcccgccgcgacgtgcttggctccggcaccggcaactacggccacggaagcgtcgtccgcgcgcgatgtgccgctccagtctcctcctccgaggaccacgcgtcggcggtcaggatgtccgcggcggcgagcgcccaggcggaggaggttaggcgcgccgggaacgagcagtacaagaacgggtgcttcgaggaggcgctccggctgtacgaccgcgcgctcgcgctgtgccccgacagcgccgcgtgccgtgccaaccgcgccgcggcgctcatcgggctcacccgcctcggcgaggccgtcgaggagtgcaaggaggccatccggctcgatccgtcctacggccgcgcgcaccagcgcctcgcgtcgctgcaaataaggtgatcactgtaccgtgaaagttgctttcatgttgcgtgctggcaattcttcgtgttgcattgtcggtggaaacagtttatctcctgtgccaacgcataactgcctaaatcgattagttctaatcgaagttgaatcgcttaatattatatttttattgggtaatcaaagttaactgatcaatatggggagggaaattgtaatctaatctcacatttagtgtgtgaggacatttcttctgagtaatatatttcccccttcccaaaaaaaaaaaaaaactgatcaatatggatattgtgctgctgaaatttggttgtacttggtggcacgatttcgtggagtggagatctctgcttcttatagcttaatttggaacatttcgcatcggaatgattgaatgtttcgtggaatgtagtttcggattgcaaagaatgagaagaaagggaaatttaccttttatagtagtgactataaaagctaacctggtgacatacccgttgctattgtatttgctgatgcctatcactccatttttgtttttccagtgatagtgggtgttgggggtgggcaggatgtcatggtcattctattgctttagtccctacatttgtgatatttgcttcttatccatgtgcatttttggatattgtcttactaaatatttcaggcttgggcgcactgctgatgctcggaagcaaattggcatgggtggcctgcagccggacattgtagagttgcacaaattagaagcagtggataaacacttggggagattcgctgatgcgcgcaagattggcaactggaaaagcgcgctgagggaatgcaacgctgcaatcgcggcaggagcagactcttgtgcaatggtcaagtatcctccgttttatttgttattgcctagtcatgctctgcttgaagaatgttatttatatattgtaccaactgcagctctttgcttctagagcggaagctcttctccagatcaatcaacttgatgaggctgatttggcaatctctagagcatccaagcttgattgttcatcctcatgctcccaggacatgatgttctgtggatttcagtccaactcatatctctactatgtacatgcccaagttgacatagcttttggaaggtaatttggcaaacatagaagtccatattcctgcttgaatatagattacatctatcatatgatgtctggacattacttttattttcaacttatggtcaccgtggcaaatacaaatgcataacaaactagattgtaaaaatcattaagagaatttattctaaaaataattgttctttgcaggtttgatagtgcgatgtcatcaatggagaaagctaggaaaatagattctggaaacgttgaagtgatggccatgcataagagtgtgagaactgttgcccaagcacgaaccttagggaatgaactttttcattctggaaaatttgcagaagctttcctagcatacggcgaagggctcaagcatcaccctgcaaattcagtcctctactgcaatagggctgcttgcatgttcaagttagggcaatgggagaagtctattgaggactgcaatgaagcccttaagattcaacccaactattggaaggctctcctaaggcgtgcagcttcctatggcaaggtaatactttgctcaatcaagatgcttttatgcacatgatgattgatgctggaagacttatgttgtgcacactatttgcttctttggtgattagattgaacaatgggcagattccgtgaaagattatgaggttcttaggagggaacttcctggtgacactgaggtagcagaggggcatttccatgcccttgttgctcttaggtcatcacgaggtgaggatgtatccaatatgaagtttggaggagaggttgaagcacttgtaggagcagaacaattccagatggctacaaccttgccaggtctttgctctggtcatcatcgtatctttcttccatatcatcagcatcgaannnnnnnnnnnnnnnnnnnnnnnnnnnnnnnnnnnnnnnnnnnnnnnnnnnnnnnnnnnnnnagacttgagtagtcaatccaatggggagcgg

SEQ ID NO: 30014 - DNA, 3442 bp, Oryza sativa
  unsure (1)..(3442): unsure at all n locations
gtgtccattgatgaccgcccgtctnnnnnnnnnnnnnnnnnnnnnnnnnnnnnnnnnnnnnnnnnnnnnnnnnnnnnnnnnnnnnnaaataaaaaagcttatgctccttgacttgatgcacattcagaggggctttttcttgagagaattttccatttcataatattaggcacaatattattgaagatcttcccatttcattgtttccatgtgcaccatgctgcaaaaccacaatccagaccatggaccaatgaagtcataggacagcaggtatgttagattttatagcaaactttaacaattaatagagtattacatttttgcaggtgtttctgttgttcatttcatggcacctttaaatcagcaatgctctgatatcgccccatttgtggatgcactgtgtaccagatatccatctgttaatttcctcaaggtaactagcatcttctaatgaattatgtgcttctgatttcttattatgatctctgtcaacgtgcttctttgattttgacataggtggatataactgagaaccccacagtgacacaattagaaaatgtcaagacagttccaaccttcaaaatttacaaggatgggacacgagtgatggagatgatctgccccagccatcagctgctggagtcctcactgagacaatacgaggtctagaccatgacttcaattatttaatattacctgcaagttcaacatccccaaaattgacacatgatagccacagctaagaaggcaatatttgtttgccctctgcgaaggcgagtgaatataagcgagtgatgtgaaaatttaccccatttcggccaaccacattcttctgtgcatttttaccatccccattgttatttatgtatcttatttattctttccatatataatgtatatgcttgcactgttcttctaaaacataaacaatgtcttacattcttgtatagaataggtgtaaattcttgttttcattaaactcgtatatttaagttactcagtttatattctgtgtatccacaaacctttagctgcgtctgtaagcttttgttgcagttcttttatacagatctgtatgtaaattatatgtaaccatattgcccataacctgatttgctcaatgaaagcataccaactttacgtttagggttcaacattttattgtcttgtgatttggcagatcagttttatcataatagatatagtttttagccgatgagtgggtggactgtcaatgatgctgacacgccaacatctggctggctggtactgtgtcatgttaagaccgacgattttggcccgtcctatcgtccaggtcggcgtgcattgttatcttgtcactgtccatccgtggagctatcactggatagtggtctggttttggattcgagtgcttgttagctgttgctttcttcccccacagtgggcaaataatgtgatgtgtacatgcgttgttatcatgtaactttccaggactctcaatgggcagccgactgggttttggatttttcatactatgttttctttcttttcagtgcaaataacatgaagttttcatgcaagtttatgtgccgtgttggtttgcttatacattatcttaaaaaacgtgtggtttgctcacaatgtggatggtaagcctgcttttctggtgagatttcatgctcctttggacagtcattgatgtcaagaacggcaagttatatgcattttcagaagcaaggtaggttgatgtcgaaggggctagctctagtgaatttcacatgggacagtccaattaccccaagatacagttttctgcctgacaagaaacagaggtcgagtcctgtaactctacaggaagatgatttgatgacacagtggctgttctttctgtttaatgttaactacagcaaagagttagtttgctctgttttatcttgatgctaactgctaatcatgtgaccttgcattaagggcaggtacaaccacgtttccttctttatgctggaactgctggtagtggccctcctaactgctgaaggtgaccaatcaacctgaaacctgcatgtgtatataccttttccctttacatttagaacgcaacatgacgtgggctcaattggacttataaacactggattaaaaacaggttagtgtaggccttctgttaccccattttatcagtaattcttttcttttttatatttttagattaaacaccagttttattaatctggaataggatccgacacaagtgcctgttcaatgaacgagtaagtagttcttgtttgatgacatgggggcatatccggagctgcaaattgctgctaatagcaggctggagctaacctgtccatgaactcatggttgtcatgggttcagtgcttgagctacaactacctgaaattacattaacaaaaaaaaaatgtctcgctctctctcaaaacacattctcaaaagacaaatgcttcattgttagattggcattcctacatacataacaacccaatatatccatctcagttagaattcagagcatatatccatctcaattggaattcagctccaaactaaccactactcatcgtcgtcatcttcctcaacgtcaatgccagtgaaatctatcttggcccattgctcatcaaacaatgcccgggacgcagctctttggacgaagaagtccattccaacctcgtaataccccttctccacctctttgcggacctgtttctggaactcctcgaacgagtcatccgctttcttcaagagatttgccgtctttatcacggacttgctgttcttctcgacccattcctccgagaggccatccaccttgacggggttgttggtcctcaggagagggtagtcctcggggctctcgtagtatgcctccctcttctgggcgagcacccagtcgacgtactcctgcggcatctgaatcatccgtggtggacgctcgccgccgtcgtctccatctgtcgccgccgcagcagcagcacacgcctgctctgcccccttgcctgcttcggaggtggccatcgccagagaaatcgatgctggccgtgtcgctcccccgcaacctaaatacacttgtgcgaaccctcgaagcagtcggactcggggttagaagaggcctcggacacggtcaaccttgtttcatgctggatgggcctagcccaacctgtgcaacaggattatgagcagttttttttttcttctcttattagaatgaggaataagttctcctgaggtacctcaacttaacaacgtgatttttttaaggtcccttagccacaaaaccataaatgtgtactcctaaactcacacaaaccgtgcaatcaaggttctataacagtatatatgggtggtttcgctaacgtggcatcctagttagcaatctgggaccacatgtaagtgttattatgtntgntgcgtaccgagctggtctaccntnggacgcaca

SEQ ID NO: 30015 - DNA, 6295 bp, Oryza sativa
  unsure (1)..(6295): unsure at all n locations
ccaccggtggcaaagcaaggcggcgggtggcgaaattcttgcacaagaatccataggtggacgtagatgtgttttgccgcggcgctgcttctgcctgcatgggactgggtggtagaaggttcaataaaaatgccccgaggaggaggggatgcggcagtgatgaagtggttccggcggggagcaccagggcgttgggcggccgccaaactagtccggaggtcggcgaggaagggcgacgactgcccatgaaggccgtggagcgggcccgcgacggactgagtgggtggggagttggagtggactagccggaagctcggcatggtggggagctcatctgtcaaggttgggnggggggnngggcgtgggggtgccgatgagggagcagaaggcgagtagtcagagcaggcgagtgagcgtgcgaccgccggagtggagcggcaacgactggcgagcggagtgtcagtggcaagaagcgagcggccggcgaagcggagcagcggcgtgcaaccggggcaggcccgcgagcacgcggccgacaaagcggagcgggtgacggcgagaaggttggaaaggagaagagaagagaagagaagagacaaaagaaaagggaaaaaaagagagaagaataagatatgtgggccacatatttttttcttcaccctatatttgttttggttgactaggatgccacgtcagggaaaccacccatatatattgccataggaccttgattgcacggtttgtgtgagtttaggggtacacatttctagttttgtggttaaggaatctaaaaacaatctcgctgttaagttgagggacctgtggtgaacttattcttagaatgagtattattactgggccggattattggacagatatccagaggcctatctaaatttgcagggagatgttttgcaattttcaaagaaaaaaaagtccattttgagtccctaatatatagtacaactgaaaggaaacagaacagagagatcaactactatagtagaagtgtacaacctataaaatggaagaggctggatagtttaatgtgcacaatttcacctctatcttcctttttcttttcaaatttttgcagtggaattttgtcttgggacaggggagtagggtagcagccctatttatcccttttccatcgatttaattcatctcaactacttcattcttcttttttctcttttgagggaacatgcacgttgttatttccttcgtttttttggttcatgatacatttggctctgttgttcaaacttcaaataagagtcctcactacttaaaaaatgatctttccagacacccgctttatttttgcaaacggacctaaagaatatctgcatattaaatgattttagaggtgtaatagggaagatttgttttgcaacaattgcttttcacacgcggaccccttaagagacttgcatgtgaaaatagagttatttccgtagacggggctcttatgagacccgtatgtgaaaaatatagcaccggcctccctcttctttaatttctctcctactcttcgtgtcctctctctaagtcctcccccttctctccactcctctctgcctttctctccattcctctccgaatggccatgatgagaggaggaggcagtggcggtggacttgtggaggcggtgacagcgagcttctagcggcggcaacagcaagtgcagagttgggagctcaccaatgaagagcttttgggggatggcgatggcgggtgaggtgctgggagctcgagaggcagcgaatccaacgtttaggacgtcagaggcggcggatctggcactcgggacctaggaggcagcgaattcaccgctcgagacctcaacggtggcggatccggcactcggaacctctgcgtcagtcgatctggcaccactggcctcgatatttacgacgcctcaacaacgacgacaacaacggtagatctagtgctcgggagtttgggaggggttaaggggtgacgagaaaggtattagagagatggccggggaggtggaaccctagcaataaggacaaagacaggtggacggtgagccagtggaggtgaaacaagagcagttatgcaacaatggcggttctggtggtgcgaaaccatcggaggtggctttatgtcgccggagttgtagaagaagaacaacaaagaggagagagaggatgcctattggacgaggctcactggcgtcattggcgacttctggtatagcgaagccacgaagccaggggccgacgcggattgggatgtaaggagacacatcacgaggagaaggggaattggtaatataaggttaatttgtttacggaatcttggtactatataagccatcggaaaagtgacttaaatttgtgagtatttttagttgaccaaaacttcacatccatttatttatatgctaagcatgcatgcgctcgagttctaaatccattccattttctcaaattcaataaagtatgaaacaacttagatgcatccaaacaatgctagcaatgctcttaatggaggagcagcaacctgaagggtagagtcacacctatgttttatggtatattttttataatggagatgtgttacgtgtaccagacctttagataattctgtaccatttgcctgcacaatgcaaatcctggaaattttgctgtaatttttatcacttgcctttcaagaatttaggatgagttcagcaagtcataagattgatcagaattactaccacttatgccattgggcttttagtttatatggaagaggtgtggactggcagcatgcgttgaataattcctcctaaggccacaaaacaattggccttcccagtttgattgattagtggctcaaggatgaaaggcaattagaattttgtgtatggagctttttctttgacttttcagtatttaccatttttgtcattgatgagtgaattgaatgatagtatcagatatcagtgatagtgagattcaaataccgcgcgctagcaatctcaacatgtgttcctcgattcgaggagcgacctcgatcattgtctgtgttttcactgtcttattgacctggcaatggatcaacaatgtatcaaaagtactttgtatgataaatattttattaatccttataggttatgaactaccagaacttacatataccatattctagacaaggatgatatttacacaatgcatgtagataaacagattctgtgcttataatatgctcaattcaatttatattgatcacagcatgcatttcacgtgcacgattactagtcagatgaaacgacatagttatgttctccgatgcaggatggcctggttcagtgcatgaacagcgagttttagctgctgggtacccatatatacaattttcctaggccatcacagggttagtaatattttctaacacatcgctttttggttatagtattattgaaactaggaagaaagcccgcgcagatgcgtaggtaatttatttattgtttataaaatgtacaaaaaagccctatctcaccatattcactgtatgaaataggccatagatttttgacatactaaattataataatgtccatcatatcccaaaaaaaatctttttgtactcatctatcaccactacttattatcatgtcttgaaatatggatatatagttagaattgcatctttgcacaaataaacccaatacataattaataccataaaaaatcatccctacttcatacccaagtactcatgtctcataggtatccaaatctacatgtaaataattaaaaataccacttctaccaattaattaatagaataagatcattaaacttatatatgaatgcccctttaacaaccggtgaagccaaatgtagccgctaaggcttttttctccaatgccttgattcatgggtcccgtattgatatagtcgtgatcctcaagacaagctcttagagcacaattttataaaggattgtatcggtaagtaggcaagttgagctctattgtcaatggtgacctcttacacggaccacttcagctcaataataaatactcctaccatagttattacaatgtagcctattgagatccatgcttggcacccttttagggtatgagtgagagaaaatggagatgatgaaaatagttttttttaatgtcttgagtcgatttattgtatagagtgtacataatttgtttacggtgttaatcgatactactaaattttagtggtacatatataattttaaaaattagcagggttcatcattggactctacttcgaaaaatctaatagctttagtggtgaggaccatgcaaaaaaaatatttgttcaaattgtaatcctttgctaacatacaagttaatataggttttgatctttttttcttgtgttatacatctaattcacctatgcatgttcgtgggattaatattcgatggaattttttaaaattatttttgctaactgttaacactatttggattagaacgacctgaaaagagatataatgtagttacatgtatgttttttttactagcgaatagtactatctcatatgtatttatgttttttttcttttttttctttcgaacgaatatttgcctatcatagtaatagggtatatgtgtttgtattcataacatgcgtctgcacacatttatatgagatcttgtgattgccttttacattgttagttaaaaaagtatgggtggctgaggcggcggcatggtgtggcttcttttaccatccatctcattaagagtggtcactacgtatatgctcaatttagaaaaaccttagagcctggaaagaaagagaaaactaccatatggggcataccatatacacactcttctttttttctttttatatttcttgcgtatgtatgtacataggagttgtgtatgtacataaggagatattagacggtttttagacggagggattactgttatagatctaatttaatggttgaaaataatggatcattgattttgagtgtaaatcgatgaataattgtttttattttattttatagtttttcttagtttctctctaattagagcatcacatgacatctaatgagcgtttgtaggagtatagaaatgctattactcatagtcacaatctacttgtagtcaactattgtttgtggtggattggttgcatcctctacctatcatttgttgatcattgcacacttagtatttccctttattttcggtgcctgatgatatatatgctcattagatatcaactaaccattaggtgcattgtgcatggatacctcgtgagtaatatgacttggcgatcaataaatagtgacttgtatataaaacctacatatagggggatcaatgaggacatatgattgatattttaggctaggattgtccaagtatattgcatactacatattgagtttttataatgcctaagtaataaatttaaggcagcattgtaaagttcttatagcattagctactccctatttataacgagtacgtttctcaaactactatacggtgcattacacggtatgtgttctacaaatactttttatataaaagtttttaaataaatcaaatagattcattatttttaatatttaatacacagttaatcctatgctaatacctgtatcattttgcatgtcatggataagcacacctaatgagctaaatcgaacgaagcctaagcaggagataaaagacatcgacacgatgtcaaaagaatatatttgatccttaacttataataatatataaataaagaaacatcacaatacatgaaaatacattcataataaatttagtatttggatatatcaatattttttgatagtagggagtgaatatttttttatagtagggagtgagtaattttgggaaattttactcacaactggagttattttatttttgaaaatgcaagtctaatcttgctatacaatatacatttatacaatgcatactattcatttatttagatcttttataagtttcgattacatgtatattgtagagtgcaactcgaaataatatatatttttacaactattggctgaaattattagtttgatttttttatctcatgagagtgaaaaagaaaaaggaaaaagaaaagaagtgaaagggggcacgtacaaagtatgtactacctccgttttttaatagatgacgccgttgactttttctcacatgtttgaccattcgtcttattcaaaaaatttacgtaattataatttattttgttataaagggttttatcactcaagggaacgagtgatctaagggcgc

SEQ ID NO: 30016 - DNA, 2156 bp, Oryza sativa
  unsure (1)..(2156): unsure at all n locations
ttaaaaaacggagggagtacgtgcatgcacatacactgatacacgtattgggccgatcaacatgatgcggctttctaaacataaattaaatctatttggtatttttagatctacccaacaaaaatataggtcccccagattaaataaaaatcaatggttagatatgttttgttttttcttagaatttgtctaatttataaactggagttgttcatttgtttttgaaaatgcaagtaaaattttactatacaacatacaattatatagtgcatattatttatttatttagaattttttatggggaagggggatagttacaaagtatgtacgtgcatgcgtacatatatgggagcaatcgacgtagatgttctaatgataaattaaatctatttgttatttttagatctaacggttaaaaatatggtgtccactacattaagtgaaaattaatagctagatattttgctttattttttcttagaatttctctaatttattagagcgccacttggcagcctaggagcgtttgtagagatgtcatgtgacggcttaggagcatttgtagaaagttttataaacttttagtattatttttttcttagaatttttctaatttattagagcgccacttgacagtctaggagcgtttgtagagatgtcatgtggcggcttaggtgcatctgtagaaaatttctaatagatagatagatagatgcactgacctgactgaattgaaatatttgcaactaaatattttctcatggactcggaatatccgagtaggatgggctccatacccatgtgttaggttataaagggatcaatttgtagacgaacaagcaccgcaggtccgctgcccggggaaagagaagaaacactactacaaaagtgatttttctgtacgagagccggcccatgatttttacaaacggaccgtaactagtggcgtctgcaaaaatcgagggtcattttcccatacggctccttaagtggcccgtatggaaaaatcgattttcccatacgggcctcttaagagggtcacttaagcgcccgcatgaaaaaatcgatttttccatgcggctcgcttaagcgcccgcatgcgaaaataaaatttgaaatttgaaactagtgtatctcactcatacgaactccaaattagatgattctttttcctaaatgtttctaaaatcatgctatatcatgttattgtattcttactgctattatttttgtcattttttcttgagactttgttttatcaattaaaaatttgaatttcaaaacttcaaataatattttgaagcaataaatgattttagctgaaaaagtcaacaacaacaaagttgtataactcatcaagatctataacttctattttggtcatttcttcattctacaaagtggttgtaacattttcacaaaatttacatatctctctatagtttataaaactatataagagatgtacatcttgtgaacagtgttacaaataactttgtcgtatgaagaaataaccaaaataaaagttatagatattgatgagttataccactttgttatttatgactttttcatttgaaatcatttagtacttgaaaatattgtttgaaattatcataattttaaattcaaattcaaactgtcgaaacaaagtcatatagaaaaatgaccaatacaaaagttatagatcttgataagttataccactttgttgttaatgacatttctatttgaaatcatttattatttgaaaattttatttgaaattgtcatattttgaaattcaatttcaaactgttcaaacaaagtcatatagaaaaatgaccaaaacaaaagttgtagatcttgatgagttctacaactttgtttttggcaaactttttcatatgagttaatataaaaacataaaaattaatttaaaatnnnnnnnnnnnnnnnnnnnnnnnnnnnnnnnnnnnnnnnnnnnnnnnnnnnnnngcncgttggcaactgcagatccatcaatnacacgggggngngggggggagagaataaaaataggttanatcacgaacagaccgcgagcccccgcgagtgtcaganantgtgttgaaggnttagatgttgtaacgggagacncactgatacnntacgcccaggcaggttgagtgacgggt

SEQ ID NO: 30017 - DNA, 758 bp, Oryza sativa
  unsure (1)..(758): unsure at all n locations
cgaggggcattcttctaataggctccgagggacttaccttctctctgagggcccaacagcccccgtcaagttggagtgccctctcgaaagaatggttcgagaagaacaggcaagtcggtgataaaaccggcaaatctcttaagaaaagggaatgactcgttcgagaagttccagaacaggtccgcaaagaggtgaagaaggggtattacgaggttggaatgacttcttcgtccaaaaagctgcgtcccgggcattgtttgatgagcaatgggccaagatagatttcactggcattgacgttgaggaagatgacgacgatgagtagtggttagtttggagctgaattccaattgagatggatatatgctctgaattctaactgagatggatatattgggttgttatgtatgtaggaatgccaatctaacaatgaagcatttgtcttttgagaatgtgttttgagagagagcgagacattttttttttgttaatgtaatttcaggtagttgtagctcaagcactgaacccatgacaaccatgagttcatggacaggttagctccagcctgctattagcagcaatttgcagctccggatatgcccccatgtcatcaaacaagaactacttactcgttcattgaacaggcacttgtgtcggatcctattccagattnnnnnnnnnnnnnnnnnnnnnnnnnnnnnnnnnnnnnnnnnnnnnnnnnnnnnnnnnnnnnnaagatgngtttcacctngaacatc

SEQ ID NO: 30018 - DNA, 899 bp, Oryza sativa
  unsure (1)..(899): unsure at all n locations
acacgctcctctactgtgaacgatagaggcgataagaacgatagtgaaaaggaatcgtaaacgcatcgacatccgatcgtgagggnatatatcaggaaggaaggntgatcgcacttcttatnncancctcncnccgccaggggnaatgaatgcacctcccacnnnnnnnnnnnnnnnnnnnnnnnnnnnnnnnnnnnnnnnnnnnnnnnnnnnnnnnnnaaacataccaccaccaccacatgttagcaattccaaacatacccctagacaaaagaactagcaccaagccagccgccactatccgtgactgaatgccgctagtcttgcaaacgccctggcgaacactagctccaaaacagaagatcgtcaacgggctcccggtcatcctcacggagaaagcttggggagggagaggacaagagagaagaacacccacttgtccctcacgccaacctggtgacgacaactgacaaaacgccaaaaaccaaattgagagaagcctgtgacggcgggaagatgagatctcaaagacgatgccttcaaggagcatgatgctcaagacgccaccgacatccgtccaggaggtatgatgctcaagacaccaccgtcatccgtccaaaggactaggttttctcccggagaatctcccaaggaggaagagggtgtcagcttgacagcgccccaaaggggtgaaacgctgctagatgccgacactgccagcctagagaactccaagcaaggcgttcgcctacagatcactctattcaacatatcatcaacaacctaacacaaagccacccaagcggactacgatagcacgcagtcttgctgcgtcagctatcttgcgtcagggcaaccaccttaggcaccttcgggtgtgccctgctagccccaacgcg

SEQ ID NO: 30019 - DNA, 12702 bp, Oryza sativa
  unsure (1)..(12702): unsure at all n locations
gatggtgccnaaagtgagtacnnnnnnnnnnnnnnnnnnnnnnnnnnnnnnnnnnnnnnnnnnnnnnnnnnnnnnnnnnnnnnnnnnnnacatatataatatttctgtcatatagatcattagtgggttaattcttttgggtggcagagaataaagaggatgatttagttaattcatcgatatgaccaatgttatgatcactgatctttattccctaatattgcgattatgcatctccatgtggaaaaacataacaatcatactagctactattcaccatcaattttggtccagccaagaacatgcaaagtctagctagctataaggccagtgatgaaccacaccactatgcctaacacgattgcatgcatgcctgaatacacgcatgcaattcagtgagaccaaaaaaaagaagatgatgtgaacttgcaactgactatgcgatggaaagatgtaaagagatatcaagatcacaccggcatctttcactctattttgttgtttatctccatgtccatggacactccatgtgtgatgcagaatatgctacatcttcggatatatatcatgatgatacataattggtttcatctgtcgtttcttcagagaagagaaaagaagaagaaagaaaaggaagaaaaatagctgtctactgcatgattgtttgattgatcaagtgaaggcgactccgattctgaatttctcatcaagtgtgcttttgcaagttggctacatgaaatggatggatggatcgatcgatgattgagtttgcagggaaggttcggcagtacagattggtcagagttgtttctgcagaaatggaagacttgttccgttatgcgccatgcactgcagatgttttggtttttctatgtcattgcagaattgttgagctgtcagatgagatataaactaaaacagtgacggaataagatactgtaccagcacttgcgcatgagaaaataacaatattagcttttgattggacttcctctgcatcacctccgcgaaaattgggcagggaatttcagaaggagaaagaacaagttctggacagagtaaatgaaattctagttcgaaagatatggctttataaattcctttttttaataatgaaacgagtagtagctagcaaacatttctatgaaaattgaaaagttataggttggaagctataaggtagagccgatttcatgctcacgtcgttttctctcatcttttcagaaaattaatgcatcgacatagtgtcatctacatgcactggccatagtttaggcttatccaaaatctgtagagagatcggccagaatgtattattcctcacaccgtttttgccatctatttccaaagcaatgatgtgaaattatgaatccttgcaagaatggagctggcagtcaccagcgatccctgaaaaaggtgaagtattaatatgcttgcttttttttagataatccattatataccattcagtttactctagttaaacaattcgctatcgactttgtctccctttataatatggactttgtttttttttctaaaacacaccattgggtggatatttttcacagaatacctaaaaatacccttcaatgcttacaagaggttacaattgattgacctactataagtttttaaaaaatatgatttttttatgtagcctacttacataaaatggaagtgtgtatatttcaagatttttattttatatgtattaatttaaaaaaaatatcattcgtattttatatgctaatagagtttttttatgtacatagtattcacatgctatataatttattttgatgcggcaatcttttatgtatgtgattcctccttcatagttatataaaaatagttttctaaaaaaatatgaaagataattttgaaatatacacacaaacttaaatattttgtaagaaggctaaggacacgaaactttcatatatttttttaaaaaaccttctagtaggtcaaacagttgtcaactcttgtatgaattgaaggacattttagaaatttcttaaaaattattcaccccaatggcatattgtaggaaaactaataataaatttagtagtacattatagaggaagacaaattcgatgataaattgttaaaatataataaagtgtcataactaatcagaggggaatctttttcggtttttgatagggtgccagaccgtaaaactatttgtagaaaaagtggactagtagttggtaccatcttggaccaaacaaataaaaatgtccagagatgccactgtcaggattaattacatatactagtaaaatgtcattaccatttcaaatattaatcaagaattaatcttcctattaaatgtcattaccatttcaaatattaatccagctaacaaactttgttcagttctgttcattacatactattgagtgtacaaactttgaactttaatttacctatgtattctactaaaaaaaatactccctccgtttcatattataagttgtttgattttttcttagttaaaattctttaggtttgaccaagtttataaaaaaattagtagtaacatttataaccctaaattagtttcattaaatttaacattgaatttattttgataatatgtttgttttatattaaaaatattagtatttcttttataaacttattaaacttgaagaagtttgactaagagaaaaatctatcgatttataatataaaacggggaagaactcccccatctataaaagttacacctatttcacatttaagtttttccaaataaattgtccctatttgtagtccttatgtattcaagacttaaataaagagataaattaatgttttattagaacccaaggagtcatctaaatactcatcggttgtatgcttgcattcacttcttgattttataaatcaaaggtgatttaatttcttcttgatcttggttaaaagtaatatgtgtaacttttgtgggtgaaggcagtatctctgtattattaatgcaaggtaagggcatgcatgcagtttcttactgcatttgtatatgctgcaacctcgaaataatatggacacagatggcccagaaaacaacacacatgcatggccggcgaacatcaaagtcgccaactactcaggtttgacccctgcattgcacagacaggctagctctcaacgctggcggctcgcacctcacctcttcacacattagcttttcccaaatccaagctgttctaggctagctagctctggctacttcttctcttcccatgaaattattaacgactttgacacatgcatgtgcgtactatatacctctaattaaacaattcataacattgtatatatatctgctcacatatatatggagattcgatcatgataacagtcgttttccagggacctattttaaactctccggagcatctcgattgttaaatgtgatttcaaatagttaattaataaaaaaatctggaaaattaggtaatgtgggttatagtgacatataagtatgcaaggttaaatacgatctatacgccttttttttatccaaattgcttgtgtttagtttgaatttgacctggcatgtttttacctgttagaggcacatgtgacaatatataatatgcctagtctagctagtttttttttaaaaaaaaatttacataaatgtttagagagactatatatacaaaaaaaacaagggcatatggacttgagggtttaaaatccacttcctttaccaccttttgggctcaaatatgctatgattatcgagcgtgcaccagtgaaaccaagtgtcgatggcgattctgtgtttgccttcatagctttgtttgcgcgcaattttttcagacattgactgtgcttatggtgggacgatgcacacaggactggacaaggagacatgcaaagtctttgacacataagtaattttggtgtcttggaatcttggatgctttgaaaggaacgaaaagcgcacgtatttgacattataagcggaatggtgatggatgttgtcgaggcggtgtctgaggagtactggatatggcaagttgctagtctagcgggtccactccctactatagagtaattgcggtgtttgatggggaaagtatagtttattgatagaatgccgcattactagaatctttttttccctatagtgaccacaccacaagttgccgatggccccttagccaagaatgactgacggttttgtatatctccccatcacaaatgctactgctttcgggatgtatgtcttcatagttgtagctctcacacctcatatgaaaaatgctgagctccaaaatcataattgtagcgtaacaatgtaaaatttttccttccatgtaaataaagtttggctagcgttcctccgccagaccggcggaaaaaagtttcgacattgactcttggatcgggcattagtgtcttgtcatgctatcataggatgcatggttctattgttgggatacgcgtaggctacgatagcattaatcaaaattttatatcgcataaaccaggaaccatgcaagtattagatcatagatcgttaccactcgacgcgctgcgcagcggaagaagatgctaagaaatcgaaggaactctcgcgaagtagcgtgcgtcgatatagaggaagtagtcgatcgcaccggctcgaccttctcctcctcgtgcgttctcctcgccgtactcccacgccgatcagcaccgcaaaccagcggcgcctctatcggtatccacacgaacagggacggaacgccacgcgcagatgtgctagcacccgcgcgcggctagggttttgctcgaggtgggatcggtgacggctagggtttctcacgtgatacaatacctccaccggtcatacccctcacgaatatataggatccatcactcgggcctccaaggcccgtaggactcctattcggatccctatatgaattaagctcatattgtatctccatccaatccccttattccggcccattaagcgtgcgaccctgtaggttcatgtatactcggctgtaatccgaaaaccccttttcggtccacgcgtcaacagcggcccctaacagaacgtattgacccaccgggcatacataaagatcatatcggctgaatctctagtgtatacttgtatgaacccctttgcctcacgatatcgattaagctcaaggctagatatgtgccatcctctaatagctcaatcattcacttgaacctgttgatagattatataacttgtgattgactcctcaatcacctttggcatggctatgcacttctataatctacaacatcgaggggcccagagatatctctccataggtggggtaaatctcatcttgattattcatatcctattacatgtttcatagcatacccgaaaactacttttataactacccaattacggagttagcatttagcagtccctaagtaagctactacacatgttgggaaccatgataatctcaagtctaaggattcaacactaacactaaataagatcactgatgacacaacacatatggttcttgcagtgtctcatgttggatctatccaacaacatgttcactaacatgtacccacattattaatttggtatctctataccatgatccatgagacatgatcatcaattaatacatgtgctgatcatctaaacatatttgttccacatatgatatttgatcagggatcctttagaaatagcaacacataacataaagagtctcataaaagaatcacacattcattaaccaataattagtttatctattttaaggagcaaagtcggataaatatgtaaacatagtgtgtgatataatcatctctatgattgcctctagggcatatcactaacatctgtgactacggacatgtatggtatagggttctaactcttaaatttactctaggagcgaagtctggagtgaaaatatagctagagtctatatatagttttttagcaatgatgaatgcattgtaatttgcaaagcagcagcacccatgcatcatatcgaaaacaaaaggaacagaaaagaaaacaacaataacagtatccatcacatccaaaacaaaaggaacagaaaataaacaaacaccgaaaactcaacagaaaaagctgtatgttactgccgtagctttatgacgataaagaatcacgcttacgtgagtgtgcagaggacgacgtcgtggttgcagtggtgatcagtgaagcaaagaagaatatggaaacgcagtagcccgccgcgacagcgacccaccaaccgacggctgccgagacgagacgaactagcgctaagcctataaaatcgcatcaacccacacgagctacctatccatcgtcctagctatctcacgtagtctccctctcccggtcttcgcgacgacgctagctttacacgttcgtgataatggcggcgctgctgctgctggcggcggcgatggtggtggtggtgttcgcgcacgcggcggcggcgcagcggtacaatgctatctacagcttcggcgactccatctccgacaccggcaacctctgcgtcggcggctgcccgtcgtggctcaccaccggccagcccccctacggcaagaccttcttcggccgccccaccggccgctgctccgacggccgcgtcgtcgtcgacttcctcggtaggacgacgtcctgatcgatcgatcgatcgagctagtagtggagaaaatgacatgtgaatttcatgcatatatgcagctgagcactttgggctgccgctgccgccggcgtcgaagggcggcggcgacttcaagaagggggcgaacatggcgatcatcggcgccacctccatggacgccgccttcttcaagtccatcggcctcagcgacaagatttggaacaatggccccctcgacacccagatccagtggttccgtcagctcctcccctccgtctgcggcaacggtaactaactaattattcaacatcttattatttaccacagtaactaccactgtaattaatgatccaattcattgattagtcgtctcaccaacaactaccagtatatatgtgcatgtggagtaattaattaattaattaattaacggacgaattgatggatcgatcggatcacgggtgtgtgtagattgcaggagctacctgtccaagtcgctgttcgtggtgggcgagttcggcggcaacgactacaacgcgccgctcttcgccggccgcgccatgacggaggtcagggactacgtgccacaggtcgtcagcaagatcatccgtggcctcgaggtaactaaccaactaacctgatcatttcacgctctccacctgatcaactcacgagagttggatcacggatgactccaaaatggaaaaaaaaacaaattgtccgccaaacagtctatttcctccttcctacagtatcagattaatttcacacaaactatttttttatatagaaattgccctataatatcaaatatatcttttttcaagttaatttgtaataattaaaactcaattgatcattcgctaatggctttcctgttttaaatgcccttacgtacttaatcttaatctttatctatcttaaattaagcctaaattactatattttaggatagataaagtactttttttatcgtaactcgtataggcaacaaaacaatcatgtaaattttgcgcgcgacttgtgaacagacattgatcaggatgggcgcggtggacgtggtggtgccaggggttctacccatcgggtgcttcccgatctacctgacgctctatggcacatccaacggtgcagactacgatcgcaatggttgcctcaagagctacaatagcctctcctcctaccacaacacgttgctcaagagaagcctctccaacctccagaggacgtacccacatgccagggtcatgtacgctgatttctactcgcaggtcactgctatggtccgctctccccaaaacttcggtgagttgatcatactatttctcatctcataaccgcactaaaacatactacctccgtttgataaaaaaaactgtatttttgattatgcacctggacagatcaatatgtgattttttagaacggcgcattatattagtaaatcttgacttacctgtcgttttcttgtttatttgagggtcatggacttatcaatgatatgaaacctatcgctattttttctgttaggcttgattttttttttttttgcaaaatggaatttaatccagccttgttatggttgataggagataaccgttttataaaattttacaagctatttcgtaggaactaggaagcataatatttagatcagcctataaattctattttgtatagtagttaacagatcagccctgaacattactgcccagagctgcaaggcaccatcgttgtccggtagcacacatcacccttttatgtgctaaaaatcaaaagcgtcccagaatccagttgccgtgacagagttgaagttttcagtggtcacggcatgtttagtgtaggttagctaggggtacatggcccacacgtcagatctaggtaaaggatatatccaaaggttgttagagataagtataaattaatacactgtacgtgcataacaacaagctttacatctccaaatagtccaattacttgttggattcttagctcacttgtcctgttagtgtggcaaatgatttgtgccttccctgtgtggaccattcatgacctctgtccatatactagctagtacagtataatttaggaattgataccttgtaatccaattggaatggcatctatcatactatatcaaatactccctccgttttaaaatgtttgacaccgttgactttttagcacgtgtttgaccgttcgtcttattaaaaaaatttgtgaaatatgtaaaactatatgtgtacatgaaagtatatttaacaatgaatcaaatgatatgaaaagaataaataattatttaaataagacgaatggttaaacacgtattaaaaagtcaacggtgtcaaatattttgaaatggagggagtattatgaaataataacaactggcatgatttatgtaatactagtgctaaagcatgcatgcatgtatcacagctagctagctcttctttgcatgcgacatcgtccaattgaaaacaaagataccctttggccaaaagctcatggccacaaattaaaacaaaacaaaggaacatgttcatatctttgcatgatcttgaaagttcaaaccctctcagccttgctctgcttgcaccactgcaaaagaacagagcacacattacaaagcaaaccgaaaaaacgacaaaaaaaaaaaacaacggcactatttgaaacatagaaatattattttatcaaagatagatttaaaaccgagcctctacatctaaactagatatacacagccaaataaataatgcaaaaatctgacactacatatttctgccattgtaaaactatttctagtgaaacatccgaaacacgtatatatgacatcaatttctaagataagtgaaaaattgtttacatctccggtatccaccgatcaatatatttatttggagagtgatattggttgctcaccttgttaatataatatggcagggctgaaatacgggctgaaggtgtgctgcggggcgggagggcaggggacgtacaactacaacaacaaagcgcggtgcggcatgtccgggtccagcgcctgcgccgacccggccaactacctcatctgggacggcatccaccttaccgaggccgcctaccgctccatcgccgatggctggctcaagggcccctactgcaaccctcccatcctccactgatttattaatcctacatgtataatatctgcagagagatgagatgtgacccaattaattgtgcactgtttgcttaattaggccgaagtgtgtgtttgtatttgtgtgtgggttaattaatatttgttcatggggtttacttaattagagtttggttgtgatttggagagggtgattttaagcctgatgatgtatttagttggggatcgaatcaaactgatccaagtgaataatgaagctcaaacaagggcttttccattttagtttcacaagttgttatgggctggctctcaatgaggtcctgaggggctttcgtttgcgtggccttgcaactgcaattccggcccctctagtcggaactttacgggccaaattttgtaacccttttgtagtagtagagccagaaatgctaaaaagaatttggtcgaaaggagccactataacactattgttagttttctttttcaaaatttcctgaatctatagtaaatccctccttcctcctaacaaagccactgcctcccatctttctctaagaaaaccgcatagaaccaaacaaccgtaaaaaaaccggcatagaaataaactaaaacaatatttttatcacccaatcccattacaacctacgggcatataactagttcggtctaaaatttaacgttatggagaaggctaagttaactaataaattattactggtagtccatttctggcatgggctaggaaatagcccatgctaaaagagtcatggaaacagaatggaggagaaagttcactttgactccttcaaaacattaggttggatcttattcgtatccttcaattcaatcataaaacaaggtataatgattcctctaactattgaaaccgacacaaaatgactaggtgatatttgacgtgacaatctattaatcatagaaatagagtggggcccatgtatcataccctctccttcctttctctccaacataactcctcttattggcagtagggtgatggcagggatgcagcagggtggccggtgcgcggaggttgaggagaggcaacatggcagtgatgggggcgacaacagggtagctcacaaatcggcgacaaaggggttgaggtggagcgtgctccggtggggagtggcggtggcagcgacggggagcggccgtgtgctcgcgcggcgcggcgacggcggtggggagcggcggtggcggcagcggggagcggctgcgtgcttgcgcggcgcggcggcgatagcagcggtggcggtggcggaaacctctttggcctcgccacggcctcctccttggagctcgtcgccaggaacgtgagccaccttcttctactgggtcgccttctcgtcgctgtcgtcatcgaccccccactccctccgcgccaactgcctcctcgtccgcctcctctcctgcgctgccctcatcggagctcgagctatggcggcggtttcacctgcatcctgaggatccaggcctcgggctgcggccgggtctgcgtgaccctagatgatctcagatgcttgggcttcatggcgacaacggtgagtgggagacggagtcccggaggcgccccgccgccggtgagcctagatggccccagcacatcctcgatgtcctccatctccatctctggctgctgctgcggaggcgacggtgcgccaaggcgagtggtgggctggtcattggtggcttccccgaccgagtagggtttgggaaaaagtatactttcccacaatacttttttttgtgtgaataacatatgggtctcacatatttttttatttttgttttcattctattgacacgtaagcgccacgtaggacaaagacttggtcaagactgccacctcagccaaaaccacctccaaaaccatcgagggacattgtttgcaccagttttgatagttggaggagtcgatgaacccggttttgtggttggaggatatgaatcttactcgggcgatacttgagcgagtcaaagtataccttttccttcccattttacttgttaagctaagcccatcaatcactctgtaattcattccccctctctccactccaccatgttaccttctaagtttcaaacagtatacgctcctctatatcgccgccgtcaccggcagcggccgacggccgtgaattggaccagctagctggtggagttgacaccataaattcccgccggttttcacaagagcgccatggcggacgtgctccggcgagaggcaggcggcgtcaccacaatcatcttggtgtgctccacggtggcggcggcagcggcggcggctgggacgctggcggtggctgacgcgggcgctgcggctggcggtggcgtgggaggcggcgctcgacgccaacctcgtcaagcagaagtgcgcactccgccaggcggagcgcacactattcagagaaaagtgttgaaccaactaggagcaacaattgaattggcaggggatggagctaaggctgtggatatattcaaagatgctattgagagagtaagtgtttcaggagagcataatgtgccattgccctatgatgtcatattcatggattgccaggtttgtttctccttctagttgttaggaaacgataagcgaacaaacgataaagaacaatagatcaatcacagaagacacgagatttaacgtggaaaaccctcccaaaacaggagagaaaaaaccacgggtgccagccagcaaaatatcttcactatatctagggtgaggttacatcaccgcacggcggcttacaagaggtatatatatggttgaaccctaaaagggatgacgatccgnnnnnnnnnnnnnnnnnnnnnnnnnnnnnnnnnnnnnnnnnnnnnnnnnnnnnnnnnnnnnnnnnnnnnnnnnntccatcaattcaatgngcacag

SEQ ID NO: 30020 - DNA, 1491 bp, Oryza sativa
  unsure (1)..(1491): unsure at all n locations
cggagtagaattagagagagaaagcgaagtattcnncgatgaagaaagtgtcacaggcgaagcagagaaggggtgaatttgtttgnagtacacctgatgaaaggagggatcatatattaatttagattaccctgaaagaacactcatatgataagacgggctagccaacaatggatagaggggataggacaacaaaggggacttatagaagaggaatatacagagcgacaagaccatcacttaagataaatgaagggggaagaacaaaagtagaaaaggatgtcagggtctgattagaaaaggagcagcacagaagcgggggaatttttaataggagggcagagtgagagtatttaaaagcacgcacccccccgggcgtccccaggtgcacgatccatcctttaccctgaacacaacaaagacaaaaacactttcggcgccaaatagcctcttgggctaaaccactataccaactaagcttgagcaaagctcaaacttagcaacaggaacatgctttgtcatcatatcaacaggattatcatgagtacttatcttgcataccttcagcttaccttgcgcgactacatcgcgaacataatggtacttgatatcaatgtgctttgtcctctcatgaaacatctgatctttagtaaggcatatagcactttgactgtcacaaaacaagttaatgcaagaataaactccacaaagctcagcaaacaatcctttcaaccaaactgattctttacatgcttcagcaatagccatgtattctgcttcagtggtagactgggcaacaacatgccgcaatgttgccttccaactcacagcacaactaccaatggtaaacacataacctgtgagtgaccttctcttatctaaatctgcagcaaaatcagaatccacatatccaataagccccttattagtcctgccaaacttcaagcaagcattagctgtgtctctgaggtacctgaaaatccactgaatagctttccagtgttctttaccaggattagccatgtatctactaaccaaactcatagcatgagataaatctagacgggagcaaaccatggcatacatcaaagaaccaacaacactagaatatggaactctagacatgtattctacatcctcatcagtactagcacattgtaaagctgataatttaaaatgaggtgcaatatgagtactaacaggctttgtatcatgcatgttaaaacgctgaagaaccttcttaatgtagctttgctgactaagaaataaccaaccggaatttctgtctctagtgatttccatacctagaattttcttagcagcatcaagatccttcatatcaaactcactactcaactgtttcttcaatgtagtgatttgttccttgctcttggcagcannnnnnnnnnnnnnnnnnnnnnnnnnnnnnnnnnnnnnnnnnnnnnnnnnnnnnnnnnnnnnagctgaggtagcactacaatnnggagcggc

SEQ ID NO: 30021 - DNA, 2045 bp, Oryza sativa
  unsure (1)..(2045): unsure at all n locations
ccgctgcccattgttattccgactcgctactctactattttccattntcatgtaaagcttgggataacacagtgcttgccagtcctcatgcagtctgtctgtgatgatatcgtaaaggagcatcattctatccagaaatctgacatcactacattcttcaaagttgctcgctttgtcttagcttttcaacacgagaaggcatcaaatgctcaggtattgaattaaactcatgggccatttgtgctgcatttttatggtcagtgactcactggttttgacctgtggtactgtattgtctatcggtgttaaaagaacagttctggaaataacatgacttgctctatgagctggtatttattcatgtctcagcgtaaaaaaaagggtaaaacactatcctaattattttatagtattttcaacttcaaacaacacgtaatcatgaatattacctagagcaagcaataaaggcccaaaacaatcacgtatgactggtgtggaccatggacagcacctgtggcgctgtagcagcaagagggaggaaggctttacttttcctgacaagattatatatttttctgaataattagctgacttgccagaaggatttgttgtttagtaattacctactagttactaaatttgttatcagttcaattaagaaaagaaagagaaaaactaaatctactgcacccatctgttctctatattattggttaaagagtcttgttgcatgaccggagaagagccctgctgtgcaagatctgcccatggtcctcggacctgtataaaatcatgttttcacattacttttataaaaccatgtgtaattgcatttacttatatcggccagctgtttcatattcctatcacacaaggaattttttcccggtataatctgttggagcagcaatctgaaattgtcaagagttccatccgtttttcctagtgcaacctaagttgtagattagtgatgtcttcattgcctcgccttgtttgcattgaatactatacttgcaaaatttgtaactagtgctgatatgtatcatctttttttccatgatgttttatgacattgctaacctctttttgtcagaaatctaatgctgcggtccaactgcctgaggcttctcctagcgatcatcttgatgataatctgccgtttcttggtgacatatgcggacctgttgcagccacattgaatgaaggtatgtttaacttggtcatctccaggtggcgtgaggcctatgatagcctgaaggaaacacatgattacaagactctttcagcagctgggtctctaatgaagaacatggtaagaaaatatgtatactaacatttcaggctagtaactctgctcaactttatactagtctagtactctgatgaatctcatcaactcctttgttatctgagaattagagtttattattaacttgaaaaagagaatcttatatactttagaaagaaaggcttgaacctgcctagttcagttagttctactgtcttaatggcttgtccagttatgactttatgtacattcaaaatctacgtgctgaagaaccttaccttgcagattgacatggtatatttggtgcttaaagtacttcctgatgattcaagagaatctcaaacagctcgtgttttactgtataagctgttttatgatcagacagaacaagggctcactcaatttctgctgaacttattcagatcatttgatactcataagcaaccaaaaaggtttgtacaagtgattctttttggatatttatattaggaaaaggtccaaaattactatgggatactgtgtgcaagctgctacattctgcaaacacttgttcttgtgaaagggcattgcatggtttgggttgcacttggtttctagacaatcatacgagtctttttttttttcctttaatcanctatatagcaatctaataatacatttttacaaatagttgatgaacatatctattgttttatcagtgatcttgcagatttctaggnnncnatccgggtgcccaatgatattcaaatggcacgct

SEQ ID NO: 30022 - DNA, 1649 bp, Oryza sativa
  unsure (1)..(1649): unsure at all n locations
actggttccaaagtgnacatctgctttcacnnnnnnnnnnnnnnnnnnnnnnnnnnnnnnnnnnnnnnnnnnnnnnnnnnnnnnnnnattctatggagattttggaggaaaataaatatgaagttctatctcatgtttccttattcatatgactctaattcttgtgttctttctttgtgtcaactaaataaacagtttttaggactttcttgtgttttcaattcctatagaaattcaatgagcatgacattctattctattttgatgttttttctattcatgcgtcttcacaaacatttcaaatggaccctctaatttctcaaaatgagccacatctaagtaattatcctttacaagtaaagtccaatatatataggtttgtacttttagaagttaatttatgccttgcttggttgtgcattggattgaaatacaaagaaattttgattttttttaagaatagaaattataaaaatagagttgtgcaacaaaagctataaagaggaatcctaaaatcaaattctaaaattcaaaatcatctacgcgactatgcattcgaatgatattatatgagtacgactttacctttcgttactgaaaatgctacaatttaacgcatgcattgatcaattttgtgaaataaatatgaattaattctactcgaagatttggatatgcaaaaacacgtgctatatatctacctaaacaacaatttgtggcacaaatcctcgccatttccaagaatcgatcagcttgtgagagtgactctgtgtgtgccactaggtgtttccccatcctgccatatccatgtaccagacgcatgaaaggctgtgttggtactactctgagctatcgcagtaatagctctcggtttgcttcaccagaaggaagaatcatgccttgcctactttccaaggttgcccgctttacgaatggccaatgggatgcaattgattgcaatgcacgtccgcatccatatgacgacgagtcgatgatcaattccaccatccttttagctgcatcgacatcaactttgctatgttctagttgctacgatttttatcagagaaattaaggggagaaagtgtgatatgatttgattggccaaacaattaacctccaaaagatataatctttaatttacaatgactagcttgagttagtcaagatgacgctagaccagcgtactccatatgtcctatagaatataataacttttttatgttagaaacaaatattcaacaaatatatatgtggaattaaatagggaagattaattgcaattggctgagaagagaaaatatgtgaagaaactaaacaggagacggttgtgaacttgtgattaattggttaagatgaatgaatagatagaaaaattgctatatttattttaggacaaattttaatgttaaaagttcctatattattttaggatattttttttaatgttaagagttactaaaaaccgagcgaatatttctcttaagctaaagtgaagtaattttgtataagtggctaagtaacttatgctagtttttttccttctataaattgttgaagtgaaattaagctacatcagtgcattttgaggggaaaagcacataactagagcaatcatgttgacacttgacagctcacgccctcaatga

SEQ ID NO: 30023 - DNA, 752 bp, Oryza sativa
  unsure (1)..(752): unsure at all n locations
naaagcttctccaattttgtgtgtacggactaaatctttgtgtcatcggcaggtccaaacggggccatattcttgcttacgaaagcaagcaagcagcgtgcggttttccggccgagcggcaaggggatagccatgaaaaagaagaggagattgagttgagttggagctaggcgcccgagcttttagctatctgcctagctttgtttgtgctttgcttgattcccgcgcgcaggaggaggtagaggtagtagaagccgccagcgcgcgcgcgcgcgggggcgcatgtgcgcgcgtcgcgtcgcgtcgcgcgtcgctcggggacaaatcacgtggacggggtggggcgggcggctgcgacgtcgtgcacggcgcggcgtggcgtggcgcggaggcttcgcgccgttcgttcgcggtctctgagttaaatgtgcgggtcgcggcacatcagatgctgcctgctctgctcgccgccgcccacacacaccggccgtcacggtgttgtccctcccagctcccagatgtggcctgaaatctgaacgtttgaatgtcttaatcgctcgaaacgagtaaataataaatgcgtgaacattcaattgtgggattttctaagggtagagattttctaagggagtatggcatggtttagttcccaactttttcttcaaannnnnnnnnnnnnnnnnnnnnnnnnnnnnnnnnnnnnnnnnnnnnnnnnnnnnnnnnnnnnnnaacgtggcgtccattnnnaccag

SEQ ID NO: 30024 - DNA, 1594 bp, Oryza sativa
  unsure (1)..(1594): unsure at all n locations
gaaacgagtaaaaaagggggagcggacaagcggcgcggctaaaaaggagagcgacaaaaaagccgcgcgcgcagaaggcgggcaataaaacaccacccccaaacaccagcgaganattggattggatgggcactcgcacccnacaaaacanaaaagggcncaannngagaaaaagagggnccaaccgaaaagggcgcgaagacgcacgaanagaaaaaacaccaaaacagaacagaacgccaggcgcaggggaannccaaaggaagggaaaacacaagaaagccccaaaaaccgggnaaanagggggcacaaagaaagaacacaagaacnagaggcacaagaaaaaggaaacaagagaaagaaccccanaacgaanngcccccaaaaaccccaaaaaaccgggcaatgcaaaaaaaacgaganaacccgagcctttgttttagaaacccatttaggaaactttcttataggactaaaatcctctaggcttagtttttttttctcatattatttatcacattgttgaacatattatttgctccacgcttcggaaaatgcattttttgaaaaaaaatctattgtattatttagacccacttgttttgagttatttttcaattttatttattaaagtatttaatttatccctataattaagtagataatccccgaaaataaatttattcaataatacgtttcaaactgaggctaagttttctatgttattcccacatatcaaaaggtgccttagcatactccctctttttggtaatctcttatattttcttcgaaagcatacatttcaaaatattgttattatagagagttcacgacacaattattgcattttttttcgatacctgcttctaattaaatgtttcgaaagagataattaagctggtcacgttatgagtttatgcatccaggttcttttctatttaattttattaataccttaatttgtattttgttgatctaacatatgggcggtgagctaaagacagataatgtgaagagataatatctatttttactttcctcaggctttatgtttcctgcaataagcatgcattcaggcgtttgcaggccgcagcagcaatctatctgctgacaagagaatgattcacagaagatctatccgcttagtgaacgcagcctttcggcgccaaaaaggctacatgatatgagttgcaacggcaaacggtccatactacaatctttttttttatttgtgttgcccattgtgatggaagtggacagtgtgtagtgaatttctgcttgaaaaatgaactagaaaaatgttcttttaaaaggaaacttgtgttttgaagactaaaagggaatattgaatcggagatatgggagatactgatggctccaaatctagagggaaattatgtgttattaaaaataatttctttaataacaattgttttttttaaaatctcatagtcaaataacccctacaggaaaccgtaggcagcatgccattacatacacactcaactagctagctagagtccgtttgaaagaaatggtgcccgtcagtctcaacaaaaagttttaaaagcataagtttacaaactggcgctga

SEQ ID NO: 30025 - DNA, 723 bp, Oryza sativa
  unsure (1)..(723): unsure at all n locations
tggtncnaatgcnnnnnnnnnnnnnnnnnnnnnnnnnnnnnnnnnnnnnnnnnnnnnnnnnnnnnnnnnnnnnnnnnnnnnnnncaataaaaatataatattaagcgattcaacttcgattagaactaatcgatttaggcagttatgcgttggcacaggagataaactgtttccaccgacaatgcaacacgaagaattgccagcacgcaacatgaaagcaactttcacggtacagtgatcaccttatttgcagcgacgcgaggcgctggtgcgcgcggccgtaggacggatcgagccggatggcctcctcgcactcctcgacggcctcgccgaggcgggtgagcccgatgagcgccgcggcgcggttggcacggcacgcggcgctgtcggggcacagcgcgagcgcgcggtcgtacagccgcagcgcctcctcgaagcacccgttcttgtactgctcgttcccggcgcgcctaacctcctccgcctcggcgctcgccgccgcggacattctgaccgcccgacgcgtggtccttggaggaggagactggagcggcacatcgcgcgcggacgacgcttccgtggccgtagttgccggtgccggagccaagcacgtcgcggcgggcggcacggggaggccgaaccggcggcgtggtggggaggcggccggaagggcaaatgttccccgcggggaacgcgccggcggcgagcgccgaggtggccgtg

SEQ ID NO: 30026 - DNA, 732 bp, Oryza sativa
  unsure (1)..(732): unsure at all n locations
atggtgtannttttgaatagcactcggtaccgtataatatctgcagagagatgagatgtgacccaattaattgtgcactgtttgcttaattaggccgaagtgtgtgtttgtatttgtgtgtgggttaattaatatttgttcatggggtttacttaattagagtttggttgtgatttggagagggtgattttaagcctgatgatgtatttagttggggatcgaatcaaactgatccaagtgaataatgaagctcaaacaagggcttttccattttagtttcacaagttgttatgggctggctctcaatgaggtcctgaggggctttcgtttgcgtggccttgcaactgcaattccggcccctctagtcggaactttacgggccaaattttgtaacccttttgtagtagtagagccagaaatgctaaaaagaatttggtcgaaaggagccactataacactattgttagttttctttttcaaaatttcctgaatctatagtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagg

SEQ ID NO: 30027 - DNA, 16723 bp, Oryza sativa
  unsure (1)..(16723): unsure at all n locations
nttcagggcacccggcccagtggtccatcatccagtcatctctatatcacgtcattaataagaatgcgtgagccacgcaagctttaccaactgccaagcctgtcctcctctccgtttttagagaaatcggttgagagcaagtgctataatatctcatatgttgcccctaaaaatgccacattagattgggtgatgaggtagagtagaaaagtggagagagagaatatgagccacccctaaatcaagagataacctccacacaaatttcaagaagtgtgtgagagtattagagatattggtatttgtgtgttagaggtgatacattgtatgtgttgcctcttaattcatgagtgaataaaatagataaatttagaggtgatagtcacatctaccatagcacttgcccttagaacagcgacacggtcttcaaaatataactttgacttcttgattctataaaaaaatatttattaaaaagatataacttttgacttcttgcttctataaaaaaacatttattaaaaagtaatatatgtatatttttatgaaagtatttttcaagacaaatctatttactcaacaacttaagagttatttataatttatatttttcaaggtttgacttgaaaattgtgctataggactttctttgagtagtggagtacgtaagatcgctatcacatttaggaatccgacccgcaagctctcatacggcgagctcatcgtgcataattaatcacgtcgatttgttgtgaaagctagtagcattaacacattctgttggcagttggcggctgtacggtcacgactcatgacacagtactcctagtcaaaccctctgttcaccagtccgtcggttcgatcggcgatcaaactacggttttgcttaaagataatactccgaaaatttatttctcgcctaaaaagatatttccatctttattttaatgaagttctaaagcctattcagatttgtgacattgaaccatatcattttttttaaaaaaaaaatcacaaacacgtggatgcatgatgtttgttaccaaatattaataatacctaacgaattttggtacaacatatttagcttatcctatcaaactttagcagtgtatagtcgacttgctaattttaacattggcaaattctaaaaaatatttatattttagcagtaatctgaatatgcccatagtctatcattataaagcctataattcaaacaactaaatattacatattcacaatttgatgcataaaagaaatcaattggagcacgcaaggtatattgtatatttctactctacaataacaaagagctctatttccggcggagacaagatgccgcttcctcatgggagccctgtttttttccccctggttgaaccgtcggccaggtccagtattttcaacacccagtacccacatgaataccctgcactaccaccagaaatgagacggaccgataacgcccagtcccccacatgaataccctgcactaccaccaacacaccactcgtctcatttctggcctatatatcggaacatgtgtttcggtctagctaggcggtggacgcgcgcatgcccatgcaaaaccagctcagctcactacactacactttctctagctagctagcgcgcgacgggcgacgcagttaagccgcggcccacacgagatgaacgcggcgggtgcagacaccgacaccgtcctgcggaagcggcaactcaccgtccgcacgacgagcagcaacggcggcaatgggttccgggtcggcggcggcaagggggcggcggcggcgacgccgccggagcccgtcagcccctccgcgcggctcctggaggactttttcatcgtcgtggtgatcggcattgccacgccggtgaacgaccccgtcgcccgcgccggcatcgccgcccagttcgcgcgctacccacgcttccgcagcatccaggtcggtccgtgcacctgccttgccgcgcgcggcgcgcccatgagctcgccgctggtgcttgagctgacgaacggcacgagtgtgtgtgtgcgcgcgtgtgcaggtgacggatgaggacggcggcaacccgcggtgggtgcggacgacgctgaacgtggacgaccacatcatctacccggagctggacatggacgcggtggcggccgacccggacaaggcggtggaggactacgtggcgtcgctgtccaccaagcccatggacgagtcgcggccgctgtggaagttccacgtgctggacttcccgacgtcggaggcggcggccaccacggcgatccgcgtgcaccactccttcggggacggcatgtcgctgctcacgctcctcatggcatgcacccgcagcgccgccgacccggcgaggctgcccgccatgccgccgcagccgacgcgcaccggcgcgatctacgcgcggcccaggccgccggcgtcggcgggcgcgctggcgttcactgcgtggctctggtcgttcgtcgcgctggcgtggcacaccgtggtggacgtcgcgagcttcttcgccacgaccatgttcctcaaggacccgcacacgctgttcaagcgggtgaagcacggggagttccagcggaagcgcatcgtgcaccgggggcttagctttgatgacgtcaagctcgtcaagaacgccatgaactgcgtaagcaatgttttctttagttcttagcgagcctgtttgtttgagtatagcggcatataaattgcagaaaactttaaaattaaaatttaagaatttcgtttttggtcactttctagcactactagaaaaatattccatccattccaaaatataaggcataaccacccctaactaaaagaccaagaaataattattatcatcttgtagtttggatcatcctaataaatacaatgcatgaatctaatagaattagggaacatgagagtgcatgattttaaaaaataataatttaatggagaaggggccatagttaattgcctacatgtatgcataccttatattatggaacatttaaaaaaaagtaattgtgctttatattatgaaatggagggagtaatttttagcaacattggtcttttatttttccagacgggtatgaccattggagccaaatagatgcctacaaaaatacaaatcggggtgaaacccactgcccgcctttcacaggcggaccatataagtggtccgcctgcaaaaatatggtccgcctgcgaaaatacatagcgaatacaaatagaggctacataccctagattttttctatgtcctctttccctcacctctcagctctctcccgcacctctccccacccctcacctctcctcctctccctggcgctgacggcggtgtagggcgcgcggcgtctaccattggaggcggcggcggagggcggtggccagcggccggagggcggggtgagggcggtggccaccagtgcggcggcggcggtggcgggaggttggcggcggcgagaggaagggggccgcgacgacgtcagaggaaccgatggcctggtcggcgcgcgcaaggagaggagcagccggcggccgtcggcgcctcgatgcgcgcaaggaggaggcggcggccaagaggagcggcggtggctctgggcaccaacttccttccccccagacgccgacggcggcggcggcgcagacagcaccggccactcccctcccagatctggacggaagaggggagccggccagcagcggcggcaaaggcggcgctcccctcgccctcgggtaacggcaccggacggaggtggagagccatcggccggaggaggatgccggcgccggcgggtagcgccggattttttttgttccctcgctttattttcgcaggcgggccatggacccgcatgcgaaaataacctattttcacaggcgatgggatagccgcggatgactcccccgcctgcgaaaacctttttggccgcctgtgtaaaaactatttttctagtagtgtagccttgatctaagattaggtactccactatattgactaggagtatgatattatctttgaccagtatctttttaaagaaaattacgttgttttgatgaacgtaaatagtatagttatatttagcatctaaaatgctttggtaatacaaatctttttacatatactcttttagaagtcatgtggtcaaagtatcctgctaacaagtgaaaaaagaacaaagggaatgtaaaaatttgagactaatgttttttcgttagtttggtcgagtgtcgctgtcttataaactgtactccgtaggtctttagcagtaaaaatatcttccacataggacctgctctctccgtctctgaaatagatttgtttatatttgtattattagaatatgtatgtcatattgtttattagattttttattttaaaatggataaaatattagtatacaaatatcattaaacacgaattttttttctgtctatcattttcgctccatttctatacttcacctgtttgcaagttgactgtagcaaaggacagagccctcagcaaaagctctggggagatttacgttgtgtttagttccaaaataatagatttacgttgtgtttagttccaaaataatttttcaaatttctaattttttcatcacatcaaaatttttctacacacaaactttcaactttttcatcacatcattctaatttcaattaaactttcaattttagctgcccttatttcattctctttatgtttgcctgcactctcgcagacagtcaatgatgtgctggttgggatcacgtactctgcactgtcacgatattactaccggaagtcaggtgaccaattttggctgatacagcagctgctgattggctgataactttttaagtccctatcacatcggatgtttgaacactaattataaatattaaatgtagactattaataaaacccatccataatcttggactaattcgcgagacgaatctattgagcctaattaatccatgattaacctatatgatgttacagtaaatattctctaattatagattaattaggcttaaaaattttgtctcgcgaattagctttcatttttgtaattagttttgtaagtagtctatatttaatactctaaattagtgtctaaatacagagactaaatttaaatctctggatcaaacaccaccttaaattgcggcctggctgatacagtagtactagttctttactcccatgttgcttgttctcctttgcaccacgttgcttgttctcctttgcaggtgacacggacactgacgaggatatacgtttgagaacgatcctccttgtcaatttgaggccaaccacaagcctgcatgtaataattacacttgggctcaagattggccatttaagctcacaggaccaaacattgttgttgctagtatatttgtagtggtagcaattttggactggtagaatctattatgatttctttcccatttctatggccacaggcatacgtagatatgatcaattctggcagagaggatgaagtgaaatggggaaacgcacttggtttcataatcctcccgttcttcataggcatgcacaaggatccactagactacgttcgtaaagccaagaaggttgttgataggaagaagagctcgttagaagtggtattcactcatttagctgcagaagtgatcctcaaactttttgggctcaaggtaaatttgtcctttatcgtaccatcgcctcatcaggaacttgatccttatattattaacttggcaggcaatgcgataatcactttgtttctattgacaagcactggtttaattcaaaaaacaatcgagaattcaggatactccaagtataactgaatacctgatttagtatttgctgcctaaccatgctaatttagttatcaagaaaatacaattcgtaggtgtacaagattgtgatattcactagaaattgtgtacagtcccagttgttggcagtggctaacttccttgtttcctagaaagagcattacaccgccaaattttgagtcatgcgccaaaaaaacatcccctgtggatttctttgttcctaatatcattgcaacttgtgaatcaaacaggcagcagctgctatcttccatcgtatgatctctcatactaccatatcattctccaacatgatcggcccagttgaacaggtggagttttgtgggcatccagttgtcttcattgcccctagcggctatggacctccagaagtaagttcctgaaatgtatatttgccctagaattaaataattgcattaacttgttagtatgtcagatcctcaaatctatgacagggaagggtttttttgccactaaggaatgatgataccttgtttttgctatgagcatctcacttttgtcactagggctaaaaaacaaatgaatgacgaacgtcagaacatgcgatgatccttggcttagtggcaaaaacagtatgaaaaaaaaaacccaaaaaattcccatgaaatatagcctggtagctgtctaccatatatcattaagtcatcgcgaaaataaggtaatctgactgaaactaattgctttgatccgttgaaaaaagaagtaattaagcccttgtatgacacttttataacaaggataacaagtgcatagtgatgaataatccttcagcgttgtagatggtgaaagtatttttttcactttgtcatggaatctgggtacagatgtgatgagcaagacctaatttacatctaactgtttggtttgcttgtgtaggccttaaccgtgaattttcaaagttacgttaacaccatgatggtaaatcttgccgtggacgaggcacaatttccagattgtcatgagcttttggatgatttttccgaatccctcaggcagataaaggatgcagctttgagcctaggaaagcatcacaccaaggcttaaggcactacttaatcattgcacacatgcatgtattcgtaagaatgattgtaccccctccgtactcgtaaaggaagtcgtttaggataatatttaagtcaaaccttgaaaatataaatcataaataactctcaaattgttgagtttgaaaagtgatataaataactctcaaattgttgagtttgaataaaattatcttgaaaaatactttcataaaagcatacatatatcacttttcaataaatatttttatagaaacaagaagttaaagttgtgctttatagaccgtgtcgctgtcctaaacgacttcctttacgagtacggagggagtaccatccaaatatctaatactactggtaagtggtatctatttgtatgcactgtagcaactaaatctaaagtcaaatgaaaccatcagatgttttatgatcagaagtttccagagaacaagctctggcttttggttaaatattctctgaaaaaataagaataaatggtggtctgctatgctttactttgcttaccatgtgtaacgtacgtgtagcatagtaaagtaaatgcccagatattactcatcttcttcaaagtccataagaaaatcagtcaagttctcagaatctgcaatagcttcttttagtgacagttgatctttcttcgagttttccgtgagttactgagttgtgatcactgacgaatgtatccattacgacagggtacgttacgtgcttggagtgggagttgatacagttacaaactctatgcatgcattagacacttccatgaattttctaaaccatatgcacatgattaggcaagactcatgaataggactggcaagaatgctacacgctcagcatttgttagtgccaaaaggctgcacttttttccattagaacacaactgataataatgaaaaggtacctttggcttttcagaatgtccggcagtctttagaacactccaattacgactgaccttcccttcagcatcctcagcatcatccccatcatcttcatcatcctattggtaaagcagtataatacaaaggaatgacaagctttcaagtaggacaagtatcgataactacgaaagggcatatagcctagtggttacagtgacctgagtagtaccccaaagtcctgagttcaaatctcctatggagcgaatttcagattaggttgtttgcggggctaagttctctatttcaatggccgtatatatccattggatgtagaggccgggtaaaaaaatacccttgagttcaaatctcctatggagcgaaaatttcagattgggtttgcggggctaagttccctgtctcatcaataaatcaactatttccatgtgtactgcaagagaggcattcagcctccaataagcatgtgtatatgaactgaaagatctgttgtcactgccagtaataagaagaaatttgcaaggctaatttgagaaccgcagattgcatgcatttccatcaagtaaacagtacagtattatacctctagtgactcaggctgcgcaacaactttgtcagcatcctcatcatcactatcttcgttgtattatttgaaaagtagagaacatcacagtgaaatgcgcataagtttgtatggagaagcttgtatgtaatctacattactttgcagttatgaacccaaagaaacagactcgttaaacaattctagcatttataagacaaattgggaaggaaggtaaatgatctatacgtcctcgttaaacaaagcagtctttggaagagagagggtggttgagaagtaagatggggagaaatttaaattgacagtagttggagtgagaagtactccctccagtttcaaaaataatcttaacgttttagacatgatctcatatacaaggagggatttatttgggtgcctattctctattatgcccatattaaatacggtagtttgcatattatacttgaaattctaagagcaagtataatagtaggctataagccgactaaatgctgatgttgaggagagaagaagtgggctgtaaacttacaaccgacttggacataagaaccaagaaactctatgagagaatcaagtgagccctatattaattgtaaagagctaactattatatgggtgggtgagagaagaccacaaaaaaccttatagccaaaaggtcggctgtattagagcaggtacaatagcaggctataagccagctataaacatattttaaggagataaataaggagagagaagagcagcggactacagatttatagtcagctgtagcacgaactcgaatgagctattagattgactataaatgaattggagctagtagttggctatactattaaacttaaacttgttcctattagccttgctctaatgtagtctagtggattgagtccaccattgaattttgtgcatgtggggatcgaagcattgccatccctgggaatgtatgtatacatgcaagggctaataagtctttggtgaccaagtaaatctcaaaatgtctaacagttttgaaaccggagggagtagtactttaggatagtatttttaataaaatttaggaaataaagtctatttattccacaaactttttcactagagttcttaacccctgactctttttttgggcttattttatactccctctgtcaaaaaaaacttaacctaggagatgatgtgacagagaagttgtctagattcgttgtactatgagggtcgcatcttctcctaggttgagtatttttgagacggagggagtaagtctcttaaggttcacactttcattgaagggtcaagatgctagtgctaggccagtgatatgacgaatttcataaattttgataaatttcatttgaaattcaattaaaaaaactcaagtggttttggagagctccagatttcgggagacaaatttccaacaaatcccgaggcctccttctaggacgttgagacataagcatgcatggaggccaagcatatagtatgctctgtaaaacacatttgctcttgtactgtactccttgtactcactctagctagtcacaaatatttaatattcagaacaatatttgattaagtttttaaaaattctaatcataaattttaaactagaataaatttataaaaactaataataggtttatgctattagaatagtatttttcaagacaattttttatgacaaattttgctataggacacttcaaattgtgtaatttgttggtagatatcttacccgagaaagaattgaagatgaaatatgatatatgctctagtgatgtatttatggtagtggcagatttagagttccataaattctaaatttttactccaacaccatgtttgaagcaagtgaccctagggggatatattattgtctatttgaagaacttctctctccaatcgagtcagaagtgtcattttcagcaaatcactaattttctaggatgtcttttagccatgacacgtttttacaatatctatcagtaaattatacatatttctgatgtcttgtagcaaaatttgtcgattttcttataccctatttttaaaagctgtaattgagaaattgtagatggctagaatttaaaattaaaatattcaatatttataaccagatggagtacctagtaactccgtatttcgtttgcgcgtagtaacacgaattgtcgttgattctagttgaaaggaacacaatcacaccgcaggcacacgggtgtttgcctgcgaattaattatatatcgttgggccgttcatggatttttcgtgtcccacaatgaagctggcagatatttgcactccaaagatgcactagcaattaattaaggaaacacaagaagcctcacgcctgcggagctacataagccctttagtttagatttataagccaatttataagtcgaaaagtctaaacctaaacaaacaagcagcttttccgtttggcttgtttgaagccacaagccactttaacactattaagccaaaagctaggttggagaagcttttttggcttacgtgaggtagatgtatgactcaaccactaaacttaggacattaaatccattgtcttataaatcatataagccaataagttaacttaaaagtctaggccaataaacctaagcctaaataaagagggccataataaaatctccgtttgccatggcatgaactgtgtacatattaaatcatgtaggtgattggtagcagtatagatcagtctgagagacttgagcatatatggacgatgtacgcgttaattaacattagtacgttcacaaatacgagtacacctggcacacggcacagtggtacatcattcaagtcatttctatactccctctggttctataataagatgttttggaagatcaaacttttataaatttgaccatcaataactttaaaaatatttagtttaaagaaactagaacaacgtatagattgtctttcaaagcaatataataaaagtaaacatgtatttatttattgtgtatattataataggaaaataaggtcaaaaatatattttgtaaaccgtgttattgtctaaaacttcaattaaaatgaaacctgaggagtatatatcacgtcattaataagaaatctcgaaccatctaggcaagttttgaccaactgccattggacaccatcgcctgaatgtaagatcgctatcacatttaggaatccgacccgcaagctcgcatccggcgagctcatcgtgcataattaatcacgtcgatttgtcgtgaaagctagtagcattaacacattccgttggcagttggcggctgtacggtcacgactcatgacacagttctcctagtcaaccctctgtcaccagtccatcggttcgatcggtgatgaaactacggttttgctttaataagataataaaatttatttctcgccgagaaaaatatttccatccttatttcaatgaagttctagagcctattcagatttgtgacattgaaccatatcatttaaaaaaaacacaaacacgtggatgatgaagtttgttaccaaacattaataacgcctaaagaattttgataacaatatatttagcttatcctattaaactttagcaatatagtcaacttgctaattttaacatcggcaaattctaaaaaatatttatattttagcagtaatcggaatatgcccatagtctatcattatagagcatataattcgaacaactaaatattacatattcacaatttgatgcataaaagaaatcaattgggccggtgtttagttacaaatatttttttcaaccttccaacttttcaatcacatcaaaactttcctacacacacaaactttcaacttttctgtcacatcgttctaatttcaactaaactttcaattttggtgtgaactaaacacagactggatcacgcaatgtatattgtatatctctactctacaacaacaaagagctctatttccggcggagacaagatgccgcttcctcacgggagccctgtttttttttcccctggttgaatcgtcggccctggtcacggacggatgacgcgcgcccagtccccacatgaataccctgcactaccaccaacacaacgctcgtctcatttctggcctatatatcggaacaggtttctcggtctagctaggcggtggacgcgcgcattgcccatgcaaaaccagctcactacactacactttctctagctagcgcgacgcagttaagccgcggcccacacgagatggacgcgggtgcaggcgcagccaccgcccttcggaagcggcaactcaccgtccgcacgacgagcagcaacggcggcaatgggttccgggtcggcgacggcggcggcggcggcagcaagggggctgcggcggcgacgccgccggagcccgtcagcccctccgcgcggctcgtggaggacttcttcatcgtcgtggtgatcggcatcgccacgccggtgaacgaccccgtcgcccgcgccggcatcgccgcccagctcgcgcgctacccacgcttccgcagcatccaggtcggtccgtacacctgccgtaccgcgggcggcgcgcccaggagctcgccactggtgcttgggctgatctgacgaacggtacgtacgtgtgtgtgcgtgtgcaggtgacggatgaggacggcggcaacccgcggtgggtgcggacgacggtgaacctggacgaccacatcatctacccggagttggacatggacgccgtggcggccgacccggacaaggcggtggaggactacgtggcgtcgctgtccaccaagcccatggacgagtcgcggccgctgtgggagttccacgtgctggacttcccgacgtcggaggcggcggccaccacggcgatccgcgtgcaccactccctcggggacggcatgtcgctgctcacgctcctcatggcatgcacgcgcagcgccgccgacccggcgaggctgcccgccatgccgccgcagccgacgcgcaccggcgcgatctacgcgcggcccaggccgccggcgtcggcgggcgcgctggcgttccctgcgtggctctggtcgttcgtcgcgctggcgtggcacaccgtggtggacgtcgcgagcttcttcgccacgaccatgttcctcaaggatccgcacacgctgttcaagcgggtgaagcacggggagttccagcggaagcgcatcgtgcaccgggggcttagccttgatgacgtcaagctcgtcaagaacgccatgaactgcgtaagcgatgttttctttagttcttagagagcctgtttgtttgagtatatagcggcatataaattgcagaaaactttaaaattaaaattttagaattgatttacggaatttcgttttttgtcactttctagccttgatctaagattagaagtactccactatattgactagtatgatattatctttgaccagtatctttttaaataaaattacgatgtttttatgaacttaaatagtatagttatatttagcatgcaaaatgctttgataatacaaatttttttacatatactcttttagaagtcatgtagtcaaagtatcctgctaacaagtgaaaaaagaaaaaagagagtataaaatttttaagactaatggtttttcgttagtttggtctagtgttgctgtcttataaactgtcggtctgtagaagtaataatatcttccacataggacctactctctccgtctctataatagatttttttagattcgtattcctagattatgccatatcgattatcagattttttattttaaaatggataaaatattagtatacataatcattaaacacgaatttttttctgtctatcattttccctccatttctatacttcacctgcttgcaaattgaatgtagcaaaggacagaaccctcagcaaaagttctggggagatttatttcctctctttatgtttgcctgcactctcgcagacggtcaatgatgtgctggttgggatcacgtactctgcactgtcgcgctattactaccggaagtcaggtgaccaattgcgtccaataaaatcatgctccagcagctgctgcctggctgatacagtagctcttaaattgcggcctggctgatacagtagttctttactcccacgctgcttgttctcctttgcaggtgacatggacactgacgaggatatacgtttgagatcgatcctccttgtcaatttgaggccaaccacaagcctgcatgtaataattatacttggattcaagattggcaatttaagctcacaggaccgaacattgttgttgctatacttgtagtggtagcaattttggactggtaaaatctattgtgatttctttcccatttcaatggccaggcatacgtagatatgatcaattctggcagagaggatgaagtgaaatggggaaatgcacttggtttcataatcctcccgttcttcataggcgtgcacaaagatccactagactacgttcggaaagcaaagaaggttgttgataggaagaagagctcattagaagtggtattcactcatttagctgcagaagtgatcctcaaactttttgggctcaaggtaaatttgtcctttattgtactatcgcctcatcagcaacttgatccttatattattatcttggcaggcaatgcgataatcactttgtttctattgacaagcactggtttagttcacaaaacaatagatttcaggatactccaagtataactgaatacctgatttagtatttgctgtctaaccatgctaatttagttatcaagaaaatacaatcgtaggtgtacaagattgtgatattcactagaaattgtgtacagtcccagttgttggcagtggttaacttccttgtttcctagaaagagcattacagcgccaaattttgagccatgcgccaaaaaacatcccctgtggatttctttgttcccaatatcattgcaacttgtgaatcaaacaggcagcagctgctatcttccatcgtatgatctctcatactaccatatcattctccaacatgatcggcccagttgaacaggtggagttttgtgggcatccagttgtcttcattgcccctagcggctatggacctccagaagtaagttccctgaaatgcatatttgccatagaattaaataattgcattggcttgttagtatatcagatcctcaaatctatgccagggaagggtttttcnaactccactccagactcaactcctggagcaatatttaggagttagagctgtaccaaacaggcccttagtttacagttgtgccacttatatgtgggctccactttgttatgatccacatctcagtagtacaactacaaactgtacaaagttagaggagtcttttctctagtttgtgtatttgcggttcctcttacaagaaaaacacagccacagagaccatgtggtacattttccattcacaaaaaagaaagagaataaaccataaaaaaagaacgggctttttattacctgaaacaaatatgtgaaagatttccaatcatgtaatctctccgtctcaaaatataacaacttttagctcttatgatttgatgtgaccatggctactacggatacatccgttgctcacctcatggatggacaacaagatatcaagttcgagtcctccaagtctcaaaatccaattcggccacctactaccctgctgacttcaaacggccgccgaagctccatacgacctccgttttcggcccgtgagtacttgatggaaagctctcggagtcctctttccaatgcatcaagcctcattgccaaattccatctcagtcggcagcaactgaagaaacaaggtgctgcgacacctgtaatgggactatgggcttgtaacttcatttgggaccccggcccaggtggggcccatgtggggtgcgccccaagctggtggagcacgaccctaggcacccctaggtcatcctcccacccctatatatagctagttaccccttcagggtttctggggttttgttagaataaagtttagccattgctacttgcttgcagcgcgcgtgtcggctagaccgtccgtctgcttgttcttcggaaccccaacttatcatttgtattgaattcctatttgcaatatcagattgcttttatcgtgttcttgcttgtttcttcgatttgcttgcaggaatagggttgatctgcaccggcaagatcaacaacccacggaaaggtgtatcgatcgctaaggcgcaacacaacgtctcgtacggttgtagtcggatcgtcaacgtttctcccnaatgggtnccgaggtgtntgtaagcattccaaggcgcgg

SEQ ID NO: 30028 - DNA, 1943 bp, Oryza sativa
  unsure (1)..(1943): unsure at all n locations
acttgttagtatgtcagatcttcaaatctatgacagggaagggtttttttggcactaagcaatgataaaaccttgttttgcctatgagtatctcacttttgtcgctagggctaaaaaacaaatgaatgacgaacgtgagatgatccttggcttagtggcaaaaacagtatgaaaaaaaaaattctgctaatgaaaaaaaaacccaaaaatttcccatgaaatatggcctggtagctgtctagcagatatcactaagtcatcgcgaaaataaggtaatctgactgaaactaattgctttgatctgttgaaaaaagaagtaattaagcccttgtatgacacttttataacaaggataacaagtgcatagtgatgaataatccttcagcgttgtagatggtgaaagtattttttttccctttgtcatggaatctcggtacagatgcgattagcaagacgtagtttacatctaaatgtttggtttgcttgtgcaggccttaaccgtgaattttcaaagttacgttaacaccatgatggtaaatcttgccgtggacgaggcacaatttccagattgtcatgagcttttggatgatttttccgaatccctcaggcagataaaggatgcagctttgagcctaggaaagcatcacacgaaggcttaaggcactatttaatcattgcacacaggcatgtattcgtaagaatgattgtaccatccaaatatcaaatactactggcaagtggtatctatttgtatgcactgtagcaactaaacctaaagtcaaatgactagataaaaaccatcagatgctttatgatcagaagtttccagagaacaagctctggcttttggttaaatattctctgaaaaattaagaataaatggtagtctgctatgctttactttgcttaccatgtgtaacgtgcagcatagtaaagtaaatgcccagatattactcatcttcttcgaagtccataagaaaatcagtcaagttctcagaatctgcaatagcttcttttagcgacagttgatctttcttcgacttttcctagaaaaacggaaagaaataagcagtcatccgtgagttactgagttgtgatcactgacgaatgtatcctttacgacagggtacgttacgtgcttggagtgggagttgatacagttacaaactctatgcatgcattagacacttccatgaatttacacaaaattaaaccatatgcacataattaggcaagatagtgaataggactgctggactggcaagaatgctactcgctcagcatttattaatgccaaaaggctgaactttttccattagaacagaactgataataatgaaaaggtacctttggattttcagcctgtccggtagtttttagaacactccaattacgactgaccttcccttcagcatcctcagcatcatcaccatcatcttcatcatcctattggtaaagcagtataatacaaaggaatgacaagctttcaagtaggacaagtatcgataactatctcatcaataaatcaactatttccatgcacagcaagagaggcattcagcttccaataagcatgtatatgaactgaaagatctgttgtcattgccagtaataagaagaaattcgcaaggctacattgagaatcgcagattgcatgcatttccatcaagtaaacagtacagtattatacctctagtgactcaggctgcgcaacaactttgtcagcatcctcctcatcgtcatcactatcttcgttgtactatttgaaaagtagaaaacatcccagtgaaatgcgcgtaagtttgtatggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcgagaagcaattcaatggcgcg

SEQ ID NO: 30029 - DNA, 975 bp, Oryza sativa
  unsure (1)..(975): unsure at all n locations
ccgcgcctttgattnnnnnnnnnnnnnnnnnnnnnnnnnnnnnnnnnnnntttttaacaacatcatcatacgtgaaacgctttgaacttcacaaatatgaaaataggaggggaaaaaaacagtgagtcatatcacagacaaaggaggtatgtcagttattatatgtatgttcaaatattcctggcacatacagctccaaagtgaagtcatcatcttttggattctcaagtaatctgaagtggacaacctgtagataacaacaataaattccacttgtgggaaataataaatgaaatatacagaaaattcagacaggaatctgtttttttgcgaaaaggaattatttgaaagggtagttgttccatgtttcactacagataccataaaccttaatgaagcagcgcccaacaccctacagacacacatatttcttccattgcacaatgtcattgacttttcaggaagaccacatatatatttaaaatcatacagccttgccaacataattcagctttccagaaagggaaaaataactacatggttctgatattctttactctcttcttacagctccaatctagagctctacgctcaaacatgttaaacttagggatgaagtgtgactgagaatagagatccgacaggagctatcggatgtgaatacataaaacatatctatttttaagagagtattttgtaatggatggagcactggagcatgacacaagaaaactgtttgctccatataccagtatgcttacatagtgaacaaaatagacattacagtggctagtggcacaaaccacaacaaatgaattgcataaaaaaaaaggaggaataaaaaaaatcaaaggagctaaaagaaatatagcagtgtatcaagacagagaattannnnnnnnnnnnnnnnnnnnnnnnnnnnnnnnnnnnnnnnnnnnnnnnnnnnnnnnnnnnnnnnnnagtctacaatggcat

SEQ ID NO: 30030 - DNA, 780 bp, Oryza sativa
  unsure (1)..(780): unsure at all n locations
ccgcgaaattangagcacctnnnnnnnnnnnnnnnnnnnnnnnnnnnnnnnnncagctaattttaaggaatgaaatatgtgtaatcacacaaataattatgttaactttatcacttgaacaaagagaattgttgtgaccatatttcagtgcaagcctcctaaatgtgatcaaattctaatatctatagcttctcttttttagctcttttctgctaatacattctctgtcttgatacactgctatatttcttttagctcctttgattttttttattcctcctttttttttatgcaattcatttgttgtggtttgtgccactagccactgtaatgtctattttgttcactatgtaagcatactggtatatggagcaaacagttttcttgtgtcatgctccagtgctccatccattacaaaatactctcttaaaaatagatatgttttatgtattcacatccgatagctcctgtcggatctctattctcagtcacacttcatccctaagtttaacatgtttgagcgtagagctctagattggagctgtaagaagagagttaagaatatcagaaccactgtaggtatttttccctttctggaaagctgaattatgttggcaaggctgtatgattttaaatatatatgtggtcttcctgaaaagtcaatgacattggcaatggaagaaatatgtgtgtctgtagggtggtgggcgctgcttcattaangttatggtatctgtagtgaaacatgtaacaactaccctttcaaataattncttttcg

SEQ ID NO: 30031 - DNA, 795 bp, Oryza sativa
  unsure (1)..(795): unsure at all n locations
naccgttaaaaaaaatgagattaaagaggctttaggtataagtgtgacctactactactccngtnaaggttcacatttccgatgaaaaccgacgaatttgcgaaaacgagnngttttgacgtggctcaaaagtagaagccattggaaatttcgatgggtttcatccaaattaaaatttaaatggataaaaaaggaaaaaaatcaaatcaattcctataaatgatatgatattcatagaacctatatgggtataaattttccaaaaaaattagtgtattccgtgtattcttgaactttactgtagaaaagagaataataacaatatttttaaaaaaatgaatacactttcttggaccgaattccatgtattaggcctacttagtacatagcccagataatgatgtataatagagagaggatgtggtcttgcacctgatttcgctcggaatttcgcccaagccaaccggttttcgtgagcatatcgataaactcagggaatttgtattcaaattttggtttatgaaatttgttcgaaatctaccggcttttcaccggatttcgcgaaaaacgtcatactaccagagcccggaacggaatgtcatctcggaattgtaaaccctgcctctatcccagcaagtcacaaacaaaataaataattattcgataactttttttaataagacgaatgatcaaaggttacaaacaaaaactnnnnnnnnnnnnnnnnnnnnnnnnnnnnnnnnnnnnnnnnnnnnnnnnnnnnnnnnnnnnnnnagctggtcgatcaatgcgcat

SEQ ID NO: 30032 - DNA, 1109 bp, Oryza sativa
  unsure (1)..(1109): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaaatgactacaagcagtattgaaacattaggttctaaatatataaatacctgtttttctatgatgaagtgacagacatgaaccaaacggtctcgcacaccagcatttttctcttcttcaggaacctgaccaacagaaaaggaatatgtggagaaaaggtagctaattatgtacactaattaacaacatgttcagtttgagtgggttattccatggatgatttattccaacatgagatgaccacattttattgtgtcatcttattacaggggatgacgtgttgatgagcccactcattttaacaaagcatgcccaactgtaggtcatttgctttgtagcctgaacttcagattgcttaaaggacagaacatctcaataaagtttccgtataagcaaatgcttacctcttcaacacataacagtccattgaattcattaactgaaattttctccgaaggttgatacacctgaaaaattaacgaggcaagtgattgatcatgcataaaagaggtattttcaaccactattaagtatacgtgtaccttgatgaaagaatagaaaatattgttttctacgatgaaagcagggatgaaactttacatggtaaaatgaaatcatgacgtgagcattatgtgtttttcttaaagagcatatgacgtgatttttggtaaaacttggaagagtcaggcaaaacctgccaggttgactacctttnnnnnnnnnnnnnnnnnnnnnnnnnnnnnnnnnnnnnnnnnnnnnnnnnnnnnnnnnnnnnnnnnnngtcgatcaatggcgca

SEQ ID NO: 30033 - DNA, 784 bp, Oryza sativa
  unsure (1)..(784): unsure at all n locations
atgatatatgtatgctttatgaagtattttccaagataattttatccaaactcaacatttgagagttatttatatcacttttcaaactcaccaatttaagagttatttatgatttatattttcaaggtttgacttaaatattatcctaacggacttcctttacgagtacggagggggtacaatcattcttacgaatacatgcatgtgtgcaatgattaagtagtgccttaagccttggtgtgatgctttcctaggctcaaagctgcatcctttatctgcctgagggattcggaaaaatcatccaaaagctcatgacaatctggaaattgtgcctcgtccacggcaagatttaccatcatggtgttaacgtaactttgaaaattcacggttaaggcctacacaagcaaaccaaacagttagatgtaaattaggtcttgctcatcacatctgtacccagattccatgacaaagtgaaaaaaatactttcaccatctacaacgctgaaggattattcatcactatgcacttgttatccttgttataaaagtgtcatacaagggcttaattacttcttttttcaacggatcaaagcaattagtttcagtcagattaccttattttcgcgatgacttaatgatatatggtagacagctaccaggctatatttcatgggaattttttgggttttttttttcatactgttnnnnnnnnnnnnnnnnnnnnnnnnnnnnnnnnnnnnnnnnnnnnnnnnnnnnnnnnnnnnnnnnnngggcggcaatcaagg

SEQ ID NO: 30034 - DNA, 22327 bp, Oryza sativa
  unsure (1)..(22327): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagcacaatactttatgaatttcaccagtcgttattcatgagtttccttcccctccacagaagcagcacatcatttcagtactcgggaaagtgattggggcttcacttcttttatgcatttaggagatctatatgatccgactaaaggttatattgtgaatgataaatgcattattgaggctgaggttgctgtgcgtaaaatagttgatttctggaattatgattccaaaaaggagactggctatgttggccttaagaatcaaggggctacatgctacatgaattctcttcttcagacgctttaccatattccgtacttccgaaaggtgaggctaaatttgtaaattctcttaaatgaatcctatgatgcgaggctgatacagagaatgatattttaggctgtataccatatgccaactacagagaatgatacaccttgcgggagcatccctttggctttgcaaagtcttttctgcaaacttcagcatagtgacaatagtgtttctacaaaagagcttaccaaatcttttggatgggataccgttgattctttcctgcagcatgatgttcaagaactgaatcgtgttctctgcgaaaaactggaaaacaaaatgaaggttggacatttatttttgttatatgtaagataataaatagtgtttcatcaatgtacaactactctctcgattcagggaactactgtggaagggacaattcaacagctatttgaaggtcatcatatgaattatattgagtgcattaatgttgactacaaatctacaaggaaagaatcattctatggtaggtgacaaggtgaaatctggaccttgtttctttattgtttttatctattcatcatgattgtagatttatcatgtattttcgtaactcttttctagatcttgcacttgatgtcaagggctgttcagatgtttatgcatcatttgataagtatgttgaagtagagagattggaaggtgataataaataccagtctgagaaacatggtttgcaggttggtcccactgacatttgagatctagaaccttcaaatgccacatttaccaatgtttggatttaaatatttctttgcagctgaattcattttaggcaacacttttcctatgttgttatgcacaattccatattgatctttcacatgagctgtgttaaacctattcatatattatctaaggtttgatttggtcccagcccatccatgtgggtaggcctggcttttagttaaattctggcacatccacaaggacaagctaggatgttggttttcccatcctaagggtaacttatgtaaatatcatatgctcatggctcacccactgagttgcacattgttgaatctatgttgagtggttgggtagtattattattcactatccccagcgtgcacggatgtatcaattgaaaaagtgtcatcatatttgaatgtgaccatgccagtgacatagcacatcaatattattttccacctctggttgatctataatttttttaagtatactttaatgctagattcttgataaggaaaatgtgctttgacacatacaaattacttggtaatgaagtgactttttagattgtgtgcttcagaacattttcgtcctctcttttcaggatgccaagaaagggatgctttttattgacttccctccagtcctgcaagttcaattaaagcggtttgaatatgattttgtgcgggataccatggttaaggtctgaaattcactctatattttctctggcttgtttctagatttcatctatgatttatccttttcattgtggcgcttgctaatatttaacataggctacaaacgaacttttcataatgtagtctcacatatcaaggacatggaaaactagattttccaaattgtgttttgcatgataagagccttagctgtcaagatatggagaattcccccttgaaatttagcttcatttccttgacttgcttttaaaattctgaaatataacatgggcagccatgagaggacaaataatgatgtcgcatttgcaatgtccttttgtaacagaagatctttcttaatgcaattatggtttccgcttcttgtattttttttatgtgtgtgtcctcatttcaacataatggtcaatggcttacatgcaccagaacatattttaatttgtctcctgaatatcccatctccacacgaaaaaccttctagatgcgctgtaggctaggagtactttctatatttcttgatgaaagtgtgagcaacaaaacaagcagaaaataaatttgctacagtgctgcacatgccattgacaccttattttgtttatttacttgggtgatcctcaggaagttcctttttttaaggctaaaaattagatagaacctggtgcttcaaatgttgaaaacgagggagttcgcttgcaatatctcggattaatatcttctcactggcttgaaaattccttatttagttgcttaaaagtaggcttgctaaagtttggaggctcaactgtatcttttacttttgagggaaacatgcaaaatactttatacacacaattttttcctgcactggttaaactaaactaatttggacaatgtagataaatgaccgctatgagttcccattacaattagatcttgacaaggatgatggaaaatacctctctccagaagctgacaggagggtgcgtaacctctatactctacacaggtagttccaagctctccatgtgatttatgttttctgttttgctttgtagtatgttatactctgtcagttatcctgtacttgcttgctgttgatgttctaaaattttgattactggcacatgtagaagttgtcacagagaaatatatttttgacaattaaagtaccatgatatcaccatatttttacaccaacatattattaggaaaaaaaaaagactatcaaagacatgtgttcaagactgttgcagtgcatgcatcagctagctgaggcttcagctgcactgctgtttttctcctgtatcctatggcccacagccagcctgctgcgcttaaactctgcaaccaatgttaggaatgaccaccttgttttctttagtaattactttggtctcactcgttccagtttgaagttgtggccagtgtgtatatactgatatggtcccttgtatgtcttgtttgtgcattgacacgcaatttgtgttacatagctgttacaaatgtcagtggtcagtcatgtcacatgctattttcaggcagagaacttagacaatttcttctacaccctttacttgtgaagtttttggattgtgtataggaagcatttctcagtttagcttgtcctggctgagcatacattggagtttctgttgttatcgacaagtgctttggacccttacactagtcttaacaacttgttttgaatgcagcgtacttgttcatagtggtggtggtcatggtggacactactacgcctttatacgcccggcactttcagatatatggtacatctaagtttaaatagtggaagctctatgaactttataacatacttgagatattcctttatagttaatcgtcttattttcatcctagttggctaatcatcaacggataagttgatccatgaaatatgatataaaaacctactccctgcttttcatttttttaaacatggctgcaatgatatcctattttaatgatatcctctctttctcgttgtgaaacagtaatacagtatgctgtgttttatcattcacagcagttcattacttcattttagtcatagtcaaatgttatttatttagaaaaggacttatgctttaatgacattgtgaatcacaacggtatgttctgtagctttagatgttaaactttttgaataggtatattttttgattctcctagcaaataatttcttgtttatttcttcataaaaaacataagaatacaaaatctgatccttttgcattaataggtatacataaatggtcaataattagcatgaacgtattactagaaaataggtatacgctttcctattttctttttcccctgttgacatgactgctgtcgtcttgtattgggtagtaactttttcagaaacaaaaaaatattactcgtacatcaatattataattaatttgttccaatgaagcaagaatacacaatgcacatcaggtactgttttggcaagtcagtgacttgttgctgaatcagttctatggctaatattttttgttgaacatctgattcgcattagagggcaagacctacattactaggcttaaaaagagatatcttatttttgttgtgcttgcaggagttctttttatggattgatgtgatttgcatgaatatccttaatgactttgtaaaggatcattccatttttgttaacattagtttgaagataagcttgttagacgattgctttgttgctaataatgccctgcctttctatcttcaattttttagcattccattggacagtcatttgatgaatttatgtaatgttttgtactttcacaatttaggtacaagtttgatgatgaacgagtgacaaaagaagacatgaagcgggcattagaggagcaatacggtggcgaggaagaggtatatacacacatgaacactggaagccccaagtcggccttttacttctattagttttattaatgtcttttttttctgttacagctcccacataccaatcctggattgaataccaccccgcttaggtttactaagcattcaaatgcttacatgcttgtgtacattcgtgaaagtgacagagaaaaaattatttgcaatttagatgaaaacgacataccagaacaccttaaggtaatacttcttcccttttcttttcttgggtatcacagaacttgttctgatgtcatgaaaacctttaccagattaggttgagaaaagaaaatgaagaaagagagtataagaaaaaggagaaagcagaggcccacatgttcactgcattaaaggtttacctctttatttgatacgttacattatctgaaaatgctatcattctagttgctcctcacttagtgcttcattttctaggttgcccgagattctgattttgcagagcaaattggaaaacatatatattttgatcttgtggattatgacaacatccaaagccttcgggcacctaaacatttgacaataaaccaggccaaggtaactttttgctgagcctcatttgtcatccatgatatatcaaaatgtgtatatctaatgaatatacgatatgcacagaattgtattgcattgatgatgccccataactacgctacaatttattttattttattttccagtactttcttgaattctggtattttagttttccattcttaaatttaaagtgagtaacattatttcattattagcttataagcccgattgtgtagtttggtgaatctttcacaggtgtttagctttgatcgatcttgttgactctgtaaaaatagaccaactaagagtacaacaaacatagtctatggatattctgtgagagcaacacattgtcgaacctacatgtatatgtttgttgcatggaaatgctattcaacaccattcaccaaagataacttgaatatatcaatacaatgatttttttttctcaaatacgcaggagaactgcatatcatttcattaaagaagaaagaaaactggaaacagtacaaacacaaaccccaaaagacaataaacaaacaagttaagtctaattgcatgttgagtttcgctggtttgactatccataggtgaagcaaacagctgtgctttagatttttcatacacacaaatatacgcctcaaatatgattttctaacaaataatgagttatgaagagagttcatactgggttagatcagattcttatattcataagcctaataacatggtcaaagatttctttctttggttgcctatctttgctggctctctggaatacatgtaatctccattattgatctgatacagtgttgaaatcaaaatagtataagaaacagactagctcattttcttttcagttataaccagtctctcggagaaattgtttgaagtcccatgtttggaatatattatttactgaaaacataatgtctacttgattgaatatgtgtatgctgttattattatttctttattgcaagtagaaaactggaacaaattatattgcgctgttgtttgacttcagttgctttgttggggatctgcttggtgtttgttgcatcaaaatctgaacattttgttcatactggaattttatcatgatagcaaaaaatgtggtgttctgattgaaatatgctttcttgacaggtcgatttatcaaaagaatttggtattcctgtacaatcccaacgattttggttatgggctaagcgacagaaccacacatttagacccgtacgcccgttgactctccaggaggaagcatctagtgtaagtgcaatattggcattaattaacatcatattaccttgcttgacagtaactgtccatgctacctacatgaaatcatcagccttgatttcttccattatgtatgaacttactccctgtgtcccaaaataaaagcattcctcgcattgcgatgcaactttagggtattggtgattgggtaggcaaggggtattgaaggagtaaaacttctgtatttgtggaccgagggtaggttacagagtagaaatgaactcattctgtcacaaagtttgaactctggagatctaacttattttgggtcggagggagtatgatcttttaaatcgtctgattgtgatgagtgggcttattttttttttatatatttaccatgtaacacactttagcaatatggtgtactttttaatacctactccctccatttcatattataataagttgttttgacttttttcctagtcaaacttctttatgtttgactaagtttataaaaatttagcaacatctacaacaccaaattagttccattaaatataacattgaatatattttgataatatgtttgttttgtattgggaatgttatgatatttttctacaaatttagtcgaactaaaaaagtttgactaggaaaaaagtcaaagcctcttataatatgaaacagagggagtatagttttctctaccactttaaaagtggagttgttctccactcctttcattctactcccaccgcacgctccgagttcaattgccctcctaacccatccttaattatatgagcctcgccccttacaatggaagggcatattggtactagtatttataaaatgggagtggtcaaactaaaactatgcgaaaccacaattaaagtgttgtgcaacaagggagtactttgttgacttcacaacactatttcatccccacatcaacacttttagccatgtccaaagtgatgactgaagtgagccagatcacaatgcttgccaacttatatcttcaagtttagggatgtatgtggcacttcattaccatttaaagacccatggtctttttaaatgagtatagaatagatgaagtttggttaagtaaggtgtcagtggtgggagtgataaactgggtaagaggatataagagatcaaatatgatttcatatgggaggcaccatagtccagtttgtggataatggatgtgcactgttcctaaccccaaaagtttcttggctgtaggtcatcaagtgttccacatatgcataacttcatagtccagtttattcatagtatggttgaatttgcctgtgaaacttggtatgcgcacataacataatttgcaccataaagttgctttttagggaacttatccagttttcccaattctccaacgttggagttgaggggatgcccctaggagcagcgggcattttctgttcttttaaactgttcaagtaaagaactcttgtgaaatacatggtttgagtgtactgaaacagagattggtaccttgcactcattttgtggaactagtagttatgtatacagaatacacagacagtttctatatgcgaggattcaggtatattattatatcttggttagatttatgagttaatagtgcaaccaaccaaccaggcgtgtggatattgcactttgattaagcttatctacctattaacattacttgattcaatttagagatctactttgtttttgtgtttgtctttagcttccatttatttcatctatcagctctcttgactcgcaattaataaattttgtttctgcagattggacaccttacagatccatcaaataaatcactcaattctgagttgaaactgttcttggaggttgcattgggacaggttaactacttactaaagtgctttttatttgctaagtcatctactcaattgtgttgtgctacttgtttagccaaagttcattgatcttggtttacttgtggacaatttaacccagattatgacatgtgtacaggaaaatcatcctatttctgtgcctccaaagacaaaggatgacatattaatattcttcaagctgtatgatcctgaaaaggaagagctaaggttgttcctatctcttgtatatgcatatagctatttatttatttaatttacttctatgggttacctgaccaagctgcatggatattatccctgttattatgaaatagatatgttggaaaacttcttgtgaaagcatcagggaagccagctgatatagtgcaaaaattgcaagagatggcagggtttcagtcagatgaagatattgaactgtatgaggttagtttttagttactggttctacttgactattttagttaggcaccatttgaggagttgtaaaactgcaatttatttccctaattttttgtaggaagtaatgttcgagccaagtgtaatgtgtgaacctattaacattaatgattccttcctttcaagccaggtttgttctattaatattttgtttttttctaacagatttagtttagctttccaagagttttagttgtcattttacttatcctgtttgactgtctggtgttgatttaagcttgaagatggtgacattatatgctaccaaaaacgttgttctccagaaaagttggaccactatcgctgtgccgatgtgccatctttctttgaatatatccaaaatagacaggtaaatatatctgtcctggggatgaattgatgctttttcatttttctgtggactgttatcttatcttctttttttgtccttcagtcagtaacagttgcaacagacctttgcttgttctgttttccccattatccttatggatgccaataactaaaatctgctaattaagaaaaagaagtcgaataactcgcgaatgggataatgggatagactagagacaaactttccaacagcctcactttcaagtgatcaaggcaccactggtaccagtgggctgaaggctatttcagaattgaaaaaaaaagagtaaagtcaagctacttctaatattaggattgctaaaaggaaaataacggctcagctggtgaggagtaagacctcggtctgattagctagttggtgaggcaagcttaccaaaacgatgatccttctggcaaagcctagccactctgacccaccgagccaaaaggaaagaaaaagaagtaaagaacagtgcagaacagccggttagctcgggtagtcgtattatcattttttttctatgccctgttaaattgttagcataatctttgtttggattgatacgtttgaacatggaattccttacttcttcatggattagaatattaccagtagagtagtctggctttgtttgtcttgtatgtttttccatagggaacatacctttgcccaagttggtggtatggtgctgtcctgtttgcatgttgggtgtgcttgtgggtgacatggtttggggtgtgtacattgccatttgccaatataaccaatatggcctgcttggagaaaccgagaaagaaaggcactttacaccataaccgccagctaattttaaggaatgaaatatgtgtaatcacacaaataattatgttaactttatcacttgaacaaagagaattgttgtgaccatatttcagtgcaagcctcctaaatgtgatcaaattctaatatctatagcttctcttttttagctcttttctgctaatacattctctgtcttgatacactgctatatttcttttagctcctttgattttttttattcctcctttttttttatgcaattcatttgttgtggtttgtgccactagccactgtaatgtctattttgttcactatgtaagcatactggtatatggagcaaacagttttcttgtgtcatgctccagtgctccatccattacaaaatactctcttaaaaatagatatgttttatgtattcacatccgatagctcctgtcggatctctattctcagtcacacttcatccctaagtttaacatgtttgagcgtagagctctagattggagctgtaagaagagagtaaagaatatcagaaccatgtagttatttttccctttctggaaagctgaattatgttggcaaggctgtatgattttaaatatatatgtggtcttcctgaaaagtcaatgacattgtgcaatggaagaaatatgtgtgtctgtagggtgttgggcgctgcttcattaaggtttatggtatctgtagtgaaacatggaacaactaccctttcaaataattccttttcgcaaaaaaacagattcctgtctgaattttctgtatatttcatttattatttcccacaagtggaatttattgttgttatctacaggttgtccacttcagattacttgagaatccaaaagatgatgacttcactttggagctgtatgtgccaggaatatttgaacatacatataataactgacatacctcctttgtctgtgatatgactcactgtttttttcccctcctattttcatatttgtgaagttcaaagcgtttcacgtatgatgatgttgttgaaaaagttgctaatcaacttggactcgatgatccttccaaactccgccttacacaacacctcccgtattcacagatgcccaaatctcactacattaagtatagaggtcttgatcatctttcggacatgctaaggaatggcaatcaggtttggcagctttatggagtattctgagcaacttcttttgtgccttttacatgaaattacttgcgcttcctttggtttggcagatgtctgacatattgtattatgagatactggacatccctttgccagtactgcaagatctgataacattgagagttgccttttatcatgctacaaacaatgaggtttgtttgaactcgttttgtgcttgtaaccacttctatatttctgatcatgtcctgtgctaatgcttacttatcaggtgtcatctcactttatacggttgccaaaaggtagcactatgtctgatttgattgaggacatgaaatccaaggtgaatcaactgctagttttctttcaagtgttgtgtgtgcatggcaatttaatgattttttttcaggttgagttatcttatagtgatgctgaattccggttatttgaggtctacaaaaacaagatacgcaaggtatttcaacagttcttctgtaattcttaaaggcttattcttagggtagagaccattacacacaaaaaaaaaatactgcaaagctcgtttctgaaactggagggttgtattgttgtagaaaatcagttcctgctgtaaaataacaaagatctctctgtttgagttgatagattttttctttcactttgattacgaaaggtagtcaacctggcaggttttgcctgactcttccaagttttaccaaaaatcacgtcatatgctctttaagaaaaacacataatgctcacgtcatgatttcattttaccatgtaaagtttcatccctgctttcatcgtagaaaacaatattttctattctttcatcaaggtacacgtatacttaatagtggttgaaaatacctcttttatgcatgatcaatcacttgcctcgttaatttttcaggtgtatcaaccttcggagaaaatttcagttaatgaattcaatggactgttatgtgttgaagaggtaagcatttgcttatacggaaactttattgagatgttctgtcctttaagcaatctgaagttcaggctacaaagcaaatgacctacagttgggcatgctttgttaaaatgagtgggctcatcaacacgtcatcccctgtaataagatgacacaataaaatgtggtcatctcatgttggaataaatcatccatggaataacccactcaaactgaacatgttgttaattagtgtacataattagctaccttttctccacatattccttttctgttggtcaggttcctgaagaagagaaaaatgctggtgtgcgagaccgtttggttcatgtctgtcacttcatcatagaaaaacaggtatttatatatttagaacctaatgtttcaatactgcttgtagtcatttggtactccctctggtttttaatatacaacacaattgacttcgtcctcaaactatgtccagcaatatttattcaattacttagttaagtcatgtgaagagtaccgcttgatctgtcatcaaagtaatttaagtgtgcctcgaatgtttatctatttgcacagatatttctagaaaagatggataatcaaatgaattagagtcaatggtgtcatatatttaagaccagttttgaggaacatgtcaatgttcacgacatcatgattctggatatagttcagagtaaatcccatttcagccttctttgatctaagcgtgatgaaacagtcatctctaaagtattagctgtcccacttgtcacagtgattaagaacatagtagaaattattgaggtttgctactttacatggtggactgactagtcgttgtactttagcttgtttacatgggaaacgtgtaatgggaaatatggctttggccttggaagggttgagcgtgaacatgctcagtcaatgttggaaatatctatccacgttttaactgtcttcctggataagctcaaactgtttggtactttcttaggcattgtctcgtcaagagatgactgaagcatttattgtgtcatttcatttcattgtaaacaaccaggtcgttgcattttatctgtaataatgggccactatatagtcctccaatggacacaactgaatgctgcctaaaggtgtaacgtcacttactaagctgacctcaatgatcagtgcctctcaattcctatgctggtttatggttctattatgaagcatcgttccatttgcctgagcatgttctgtattttcttcagagtgcatctctgattctcgctccaattctttgttttttgtgacgtttgttttcttgcgtgccatttgagagaagcaacggcgacctgggatttctcttattgaatcatttgtctcaatctttccagcacattgattactacggagaacctttcttctttcttatccgtgatggtgagacattatcagatatcaaagtgcgtattcagaagaaacttctggtttctgatgagcagtttgcgaaggtaattatttcaacctttcatctcatacacgatcgattttgtattactttattactgcttgtttactgttggtgaggctggtgctacagtgtaaacctttagtgatcttttcaattaccttttctgctgtatcatatattggatactatctgacgtgagctactttgatcagtggaaatttgcttatattgctcacaatcgcctggctggtgaatactttcaagattcagatatcgtattgagccgattccaggtgggttaaattctcttttaagagttgagtcggattattctcaaataatttttttctgccttgtttatttaatatagaaagatgtttatggaccatgggaacaatgcctaggacttgagcactcagacgtcaccccaaaaaggtcatgcttgtccaatcaggtatacgcttatgactcctactaactgacatgtgaacagtgggcattttctgacaacaatttgaataaattacagaaccgcaattctttcgataaggctgtgaagattttcaactagaggtggttaaattatcacatttatgtgatgtatccagagctctcacctgccgtagtacaagctaatgagatcatcaagagcaccttaatttattcctcacccggcaaagttcattgtcttcttctagacatatagtcattattttggtctgcgcaagaaggcgttgcacagtctggtgtggtcggttgaaagaaattttccatctggttgggtgtacagggttctttaatgttggaattcttagttgtttttaggtagattctgaaagctgtatattgggcatgggctgatcatcccagtggtttttgtttcaccatggggttttgtgggataactgttgatgcccacataatatgatcgaaatctatttcaggtttaaatcgaaaggggaatctgttttcgtttgtaacgttaaactacacattttgagaaaattgtctccttgggagggtgccaatatggtgaaacaaagtgagcttaaaaggtcggtccatggggtgatcatccaagatctcagccattttgatgacttctagggtttgaagctgaggtgggtttggcgaatatagtagcacacagacatgcgaaaaaaaggtgtttcaaaaaattgtatcttgaccaggggtcaagtttcggttcccctggctttatttctagggtttgaaactgaggtgaaactgaggtgggttcgtcgcgaatatggtagcacacagacttgtgaaagaaagcgtttcaaaaaaattgtatctcgatcttggtttcggttcccttggttttatttttttttattagtagacgattgtaagagtcggtgaatagtttgatgtgttaccctaaaaacacacatgtgattagtctacacaattcagaaacgccgtgtgcgtgcatagtttgcaagcaatattttgttttgcccttgtaggcagtgtgtgttttgctgatggcaaaatgaagtagaaaacgttgtggtagagtacggtattcagagtaggctgtctttccacatttcacctatcttggtagtgctagctacgaattgattatgaagtgctgttattcctaaattaagtgttgttgggcttcatttgcgtgctagctacgaattgattatgaagtgctgttattcctaaattaagtgttgttgggcttcatttgcctgcataagataggttttagcgacgactgcaaaataagagtatacatgagttaccattgcaatttttgtgcagggctaatccatggcatcaagatctataaacttggtttattgtattaattctggtccagagtctcgtttgactgtggcttgcctacgtggcatcctatgtgaacgatgacacgaacaaattttccttttcctgttcttattctcccattcttcttctcttcttccttcactgctggatgtaccaacggcggctgtgatgatgagcaacgaccgcattgacgacaacagcaaagggagagggaggcagcgagagagacgacgccgaccaccgaaggtagatgcgctagcaacggggttggcccaacggcagagcggtggctggggatgatgacttcggataggttgtggcttgatccgacatgatttaagctgggaggagtgacgggcttgagctaatggaggagctcgcgaccggagagatgggtgtcggcggatgcctgcactggcgggcaccatggtgatgctactagcatgttacttcttcttgggatgctgcttctactccctcctctgcgagcgttgccgctccaacttggctaagatctctttcccttcgattcggtttaggtggcggcatggatggcacggatgaggacacgacgcagagcaatgtggagcctcacatcggagcgcttgtggctgacagcaacgtcggtcccgtccgaccctggtgctgccatatctgtcatcccttcatgttagcggaacaacaacataggatatgtcatttccttgtgtcacctgcgtcggatcctccctccttgagggacggaggctacaaatccactagggacgataggagataggagcacctccatttggaaccgagcccccatgccttagcgccttcggcttggtccgcgcaacgtgttgactggctgacgccggatccactcatgccgaacactgccgctgcagaatccgttgtcctgccgaatccatccgtcgttggcctacgggcaaagccgaccggcgactcgacatgcatagtgaaggcagagcaggtaaaaaaaggagggaaaatttcgccatgtcatcaccatccatgtagcatgccacgtaagtaaaacccaatgttcgcctaaacggccgcctagcctgtctaaacggtgattaatcgctagtcggcgacaatttgtccagtttacaccttaggcagtgaattagtcgatttaccgcctagacggttctaggcggcctggacaggacggtgcctgagcgcaattagacaaagggacagtgcgtctaggcggcgactaggcgatagaaatcaaaatttgggcgtgataaaatttagaagcgccacgcgggaccgactcggtatagaaggggatttaggttgccttatttgagagcctggagagagagcgcaatccctgcctacccccttttttcacaccgccacgagcgacggctccgtcgccgtgcccatcgatcttccaccgcgccgctatgttcttccctctcctcctctgctgctccacgttcttccccctcctctgctgctcctgctctccatctcatccttcatccttgctgtcaatggaaggtggcaaacacaccgattgaagcagtcaagcacggaaccactcaagcagcctacgccaaccctagatcaggccatcaggggatcaggctcccctccaccacctcaccttctctgttcttccagttctagataaatttttcttcctctctcctagctccagcccctcagatctataaagttatgatttatgaattatgatgtgcatgtacagtggctatactgatgtgttcgctatccctatagatttgtactaaacccaatgcttcgtgtgcagtgtcagtgcgttgtatggacttgatgatttctgaacttaactatgatttatgctatttgcctaaatgcctatatttaccgagtaccgaatatctagaatcagtatttttgcgtgaaagaaatagaaaaaaatgtctaattcgcctaatccgtctagtcgccgcctaatcagcctagtcgctagtcagtaggtggccgtccgactagcgtttagcgactaggtgaacactggtaaaaccacggtcaaacaggactttggaccgagatgatacaataaactacatttagggatctcgatgcacgctttgcaggttcgtgtacctaggtgaaatctgcttacaagtttaaggaccgctggtacaatttactctattattattatcatgttttcttatagaatagctacatataatttatacaactattaaattaaactgaaaaaatctcataggatctctttcctacaatctaacatagtatcctagcagctcatggggcctccttttcgaattcatcaatttgtgccaactgattatcccagacatagcagcagacatagcagcagccaaagttttgttgcaagcgcaatgcgtgccccaaacatgcccccccccctttgctaagtcgagttgcttggttgctatcttttttgggcaattttttctcacttcagaataaaagtaaacccgatgatacttcacgctttactacaggaattcatataaaaccgtaagaatgaatgtggtgacaataactcgtgtgatgttgctgccgacttgtctagcgtcacgtaaagatgggtgaaaatacagaactatatagcgacaattgaatttagctattttggattactaccaaaatgtgtccaaccaatttattggcagcttgaatagtaatgttaggtgtttggattgtagcaaacaaatcggtaatgcctcaagtaaatttggcactaatctaaattttctcctctgtaatattaaatctctataaccgatttaagggccaaatatctagcctcctattgagccacgtgcacactaaatcatcgtcgtcgtcgtcgtcgtcgtcgtcatcatacaatgaacgtaaaatgtttattcgcattttgatttgagccaggtatgcttttaagatgtgccgttggatttggaaaggattggttagaaatatagagggcaggagaagattcatgacacttccaatggaaggatcggaagaaaacatgggaataataaaagcatagtcattttactttgatcagaaaaggggagcatctggagttaagctcgaaaaagaatgttagaaaaaaaaactaatgctttttccaagcgtggtgtgttcccttccaacaatacagaacacggttcttcgaatgttcagaaattaatgctttaatataaatgtttaaaaattacttggactaataattaaaatataatacctgctaataatatacaaagttgagaacatatgctaatattaatatttacgacaaattttacatgctaggcatgttaattatttatgatcacaaatattgtttataatagataaacttcctagttcctacaaaatatgttctttaagaacttatttacaatataattataatcaatatattgcatttaataggtgggaaggcatagtcatgcgaacgcacgactttactggctagtatttagtaaaggcttctttagaaaactgccatgtgttcatttaaaggtaaagaggtgcagtatatgtgtgttggaaagtatgtctcctgtgcacatatacctataataaatctctagaaaactcaatacattgcctggtcatttgagagattacctggcttttaaagaagatgaaaggtaaccctcccgtgtgcgtgatggtaaatacttcatccgtcctaaaatataacaacttttaacccttaggatttgtttcaaaatataataacttctcaaccgacattttcttcccaacaaatcacaatcctccaccattcacttttcccacctacctccattattcatccaatcacaaccctccaccaatcacttctacctactttcttaataaccgggcccaactctaaaacttattatattctggaacagagggagtaagtgtttatggcacaaaatctatacgattgtaacttttcatgtggtactagaaaaaatgatgagtacggtagctcctttagaacacctttacaaaaaatatcaatgatcaattttatcatttaatagaaaactcaactataattttacaaaaagaaagaaaccctaaataatgtggttagaaaaaacagaaatttaaggatttccgtaataatgtgatttgctactttttttaaggacaattgctcatttgaccctattttaaagtctaactactaatatgaccgtactttttcaactttacttatttgaccctacttttagaaatcggaactgccgtttggccctattttcactgtacagttagggtttacttagtgcaccgaaaaaaaatattttataatctgaactgactaaaatgcccctgactaccaaatcaattatatccccaaatttctcaccagtctacttcaccccagccggccgggccttctcggcggcgcgcgtgggggctacagaggcgctgcgcggcggggctgtggcggcggcgcgcgataggagctacgaaggcggcgctcggtgggggctgcggtggcggcacgcagagaggacttcggcggcggcggcggcagccggcaggagctgtggagacagagatgcggaggcggcactcggtgggggctgtggcggcggcgcgcggagtggtcttcaccggcggcggcggcagcaggagctgcggaggcgacgcgcggagaagagttcgacggcgatggtgcgcaggagctgcggcggctacacgcgagtgcagcagcggcggaggcagcacgtagtgggaactttagcggcgacggcgcacggagggagcgaaagcggcatgtgggagctgcagcagcgcgtaggtgcggccacgacgacgcgcaggtgcggccgcaacggcaacacggtgagtattctcacggcggcgcgtagcagctgcggtagattgagcagcttggactcgagacacatctggttagcctcatggcgtttgtgtttttcttggaatatatagtttgagatttatgttgtcaaaattttatcaaatctgtgaagtgtatgtcaattttgtaaaaaaatatatcatatctaagtcaaaattttcaaaaagctatcaaatatatgtcaaaattcatcaaatttaagacaaattgtgaaacctatgttaaatttatcaaacctaggtcaaaatttgttaaacctggataaataaacaaaaactttcaataaagaagggtcaaacaagcaagggtataaatggtacttttgtcatgagttaacaccgttaagttgctttcacagaatagggtcaagtttgatctttattttttaaaaagagggtcaaataagcaaacttaaaataacagggtcaaattggaagttagacattaaaacagggtaaaaatacaattgcccctaaattttaaattaaaagttgattgaaattttattcgaatgtactttttttttctcaagtttcaataaaatttaactaattcttataaaactttgcaaaatttatattacctgtgtatttaaaataatatcattttaaaaatcaacagactctattacacatattttatcattgttttctagactataaaaattaaaacacaactatatagaagagttttcatcaaaaatctattaatatgatatttacaatttaataatttaagatgtcaaaatttgaggacgttgctttttcaacaaacataatattttttaataacacgaaaacaaattcatggggtttaaaacaagtgcgccaataggcgtgctcaatttctagttttgacttcatattggtagtaatccaaacatatttacccaaccaaggataccaaaaaagaatgataataccaaaatttgccaaacatttggtactaccaaatctttgataggtagcaaaccaaacctaccctatattcccaggttaggtttattttgatgatgtcttatcctcactagttagtggttgtacttatatagaaagcgtaggataaagtagtgtgcaggttctggttactctaagcacctagcccgagttaccaagcatttcatccttttggtattatcttaaaaaatttcatccttttggtagcttacgtctgaaaccagactttcaaatgaacggaggagaaatcttctgtttcgaattattggcatagaaacatcgaaaaatcgagatgatatacatgtttcataataagaaagcgtacatacctcaccaggcatctagcatctgcagctcatataccatagagaaataagggattatctcaccatattttaataccctttatccatctattaatattattttcctataaataagggacactttgtttattttatccttacaactaaagttgtcttgggataggatgctaagagtggatttgttttaggagagaggaagtagctacgagctttcgtagttttaccgaaatatcagaggagcgttcaccgtgacactgtgcaggtccatatttcagatatctagaagcatcatagcaacttgaaattgcttcgaagaccacgtgaaggtaaagttgagaaaaacaggggatcggagaatttcctatccccaggccccagcccatcctgaagagacttatatgtcattagcgcataattaattaagtattaactattttaaattttaaaaatagactaatatgattttttaaagcaactttcatatagaaattttttgnnnnnnnnnnnnnnnnnnnnnnnnnnnnnnnncgtacatcatcag

SEQ ID NO: 30035 - DNA, 18937 bp, Oryza sativa
  unsure (1)..(18937): unsure at all n locations
tgtgatgacgctcnnnnnnnnnnnnnnnnnnnnnnnnnnnnnnnnnnnnnnnnnnnnnnnnnnnnnnnnnnnnnactctgcttataaaacagtcaaactgatccttccccttccaattacaaccatggagatgttcaaaatacaaaattggcaagctgctcccaaaggtgcgtcagctaactgtagatccttacacatctgtaatcttgctgctgaattctgcgtagtcgttctgtttagtgtcctttgcagtaccttcctcaatgtgcctgcctgcaggttgtccaccaatgtgcctgcctgtaggttgtccatcaaatgagctcgactccctttcattgatggaagggacaccaaaagacttcaagaaatcattggtcatcctctcagcatcatccagaaagctaccaatgctcccgaaaaggcctttctcaagagcttctatgtcactgcgaagtccaggaaatgcaaagggctcattggtcggaaaaccaagagatagtgacccgcttttcatttcatctgtgacgtcttcttcagtattttcagtttttgattccaccagttcagagggcctagaagaagattattgtgatcggttaggagaaataatgtatggtaggttatccatcagattattgtaatagcttgtcaacaaccaaaatactttgggaagtacaaaatctatccagaatactaatcatagtgttgtacattggttacaaggagctacgaaatacagaaatttgggtttcatgcacttaaaagtttaacatgaggcatgtgaagaaataaaaggaaggatgctaacgagatgtgagttttcaaaatcctgcaaaatgaggatatgctatcggtttgatgatgaccactagttgttgaatctttagtgtagacaacacgaacacagctgctctttacatatcgttagaatataataacactgtaatgtaattggttgtaggtgtctagaaatcccatgagttcacgaacatcttcaagcaacaagtgtatcatacaaatttaccccatgcctacaaagtactgcctccgtccaaaatttgttgattaacaagttgagcgcaaaatagcccacaataacttttaacccatgtcgatggcacgggcacctaaaactggatagaaattccatatctaattagctaccaaaattcaaaagcccaagttattacacacatttgatcatactattcaccacagaactcaaacgtctcgatcatcacggcacattccccattcttaatgaattcgtgtttgtatcaaatcagcgaggacagactcacgaaaatcgtccacagagaggcggctatacacagctcacaatcatacacgggactaatagtaacacaactgcgcatgacatgttatcaccaattcatcactaaaacaacgaacagtaatatgcaaagaggggatcctcgcaggaaaagaaggaacagatcagggaaaagcgcgaggccatggagtatatgtatatacctgccgacgcagtcgcggaggagctgctcggtcttctcgcacttgcggacgaagcggccgggctccacctcctccgtgtggcaccgagactgcaccacccggcgcgtggcgcagcgctccccatctacgcctccgccgccgccggagaggtcggggatgtcgcccaggccgcggccgccgtcatcgccgtcgtcgtgccaacgccaacccatggggtccgaatcgatctggagagaggggatcggagcgtgtgcagttgatttccgggtcgggtttggcggtgtgggggctctcgcctctctgggccgtgtttggcttggagagcaatccggccggctcgtttctggaaggatgtggaaggccggaggcgtatgcacatcgtgaccaaccacgtttctcctactacttaggctgtgtctagatccaaaatttgaatccaaacttcagtccttttccatcacatcaacttgtcatacatacacaacttttcagtcacatcatcttcaatttcaatcaaaatccaaactttggatccagttaaaaacacagccttagttttcattttttttttctttaaccaaaaaaaggtagggttactgaaaaccacactcaaagggattgtttggtaaataggacaggagaataatatcagacactctaaaggtaatattactgtatcttagtcatctattctttacaacacatttaatcctaaacatttatctatttttcttctcaatcccaccaatcataagtcataacccatttgctgaacacaccgaagggtttctatctgatattacaatttgtaaataggcaatggctacacataaaatcttattttagtgtgacattgactagttcgtaccgtctaaataaaatcggcgaacattttatattgtattccctccgttttatattgtaagactttctagcattactcatattcatatatacgttaataaacctagaaacgtatatatgtttagattcagtaacatctatataaatgtggggaatgctagaaagtcttacattgtgaaacggaggaagtatttgttaactctagaaagcatacggtcggctataaatccatgtagaacaaatgacatgttgtgtgtggtgagttcaccgtctgaaacgcactatataattttagagcctattcgatttggacgaatttcatgggaattttaaagaaattgacctatttttcatatgaagtatttgttctagttaaatttttccgaattcattgtagtgtaacctgcaaattttaaccgtgacaaaagtagtactaattttcgtgcaacaactgcaattgatattaccaaaatgaactgatatgataaaatacgaacttaactcgttagtttcttatggtgggactaacttacctgggttaagtactatacttgacatgtgtgatcatatttacagctaattattctttcagcggtaggtaacgtacccatcaacaatgttgatccatgatgacttcatcaatacatatatcggtccagtcttctgggggtgatcgtgtgtgctctagcaaggggcctgtgataacttcgtcgatctcaaaatatatcgacccagttttccggagcaacctcataaggttaaggtgtgcgcatgtacatttcaacgaggggaccgtggtgacttcgacaatctcaactctcaagcgatgccgacccaatctttcggggatgctctcgtgtgtgtttcagtgagagatctgcccgcggtgactttgttaatctcaaatatgcccgtggtcttttaagatgcttgtaaggataggatgtgtatatatacgtttttaaggtaagtgcttgtctctgcatctggtgtttatactgtactatctccgttaaagaaaaaaataacctaggagggatgtccagatacttgtgcgagtttgattttttttggacggggagagagtaggttcaagaggaaaaaaaaactgatctgaaaccccgggtaacctaaaaacctcagcttccataccgtttcccgttcctcctaaacccttcggctcctcccttctcacgatgttccgccgcgccgccgcgtctaccttctttcgccatgccctctccacctcaccatactcctcctccgccgccgccgccgccgcggccgcctcctcctccgccgtgaactccatcatcctccgctccctcaaggagcacttcctcgaggtctccaagatgacgcccccgcccaagatcagcccgcccaagccctacacgatcgtcaagggcgcccttgaccaggcattcggccccgtgctccgccgcgggtacggggatgccggcgaggagatctcaatctccgtcgccaggctcgccaacatcatgccccccggcgccgactacgactcggacgacgacgacggcggcgggggtggggtgagcgagtcgattagccagcttttcctccacgtcgacatctccaggccagggagcagcaagtcgctgcagttcctgtgcgggctgtaccccgacgccgtggggatccattccgtctgcctccggccgaagactgccgagtctgggacggcgggtttggctgggaagggcggtgacgggtaccagggccgtatcttccagtgagtttttcttccaaatcagcgaaattcgttctcattctgtgaattacttgtttggttcagtttgtaagcaagcattttagtaaatttttggggctttgggtaatctgactggtggcgctagtataacctgatcagaaagcaattgatctagaatgagtgaatgcctagcaggtgcgatcttaatactaatttagtggttagaatggggctttagggcatattttgttagctgttgcataccatagttttgtaaaaatagttgcgttagcctaatcatgaaggatggtggcagttcaggtgcccagtgttttatgttctgtaatactttcacttgaggtgtgggagtttatgatgtgtactaacttttaaggtctatgaagtataacagtagtctttcagcctttcaggtggtgttcgtaaatattttatctcaagctgtggattacctattgtttaatgtgtataaaggaagaatattttcgttgtccttactagtgctaattgagtttgaaacatgtaaaatttcagatgtactagcatgctcaaaactctgtactcctatgggtatttagtttctcctatcagttaaatcaattttctcagtcactacaccggttaccatatatgcatacaaataatgatcaccataatttacagagatgtttacatgttgagagagctaaataaaacaaatccttttaaaacacttatcaaatggctagtgatacgtcatagatgcttaggtaccatgaccaaaaaatgttttgatctatgtaacagtggctacatttacccagtaatatgaatcttacatgttgcataattggttaagttactgatatcatgtgccttaaatatgtatgcacatgcctcacagtttggctcagttgtgcagtgcacaatgcacaaaaagtactaaaagtaatattaaaaccccgaatataagtccagtgatccaagcacatctttaaaagccttttactatcttgcaataactgaaagtttgcttagctatttggattgtggtcgtttgtttctctcatggatgggtatcaataattcatttgatgtttattacatgtataagactaagtccgctgtgtatggtgcttgtcctggacgatacagtacaaacacatatgttagccctggatgttgatgtactgctttttactgatcatgaataattatcttctctttgattgacagagaattggatgagaatgtgcgtgatgcattccatcattacatcgaggcccgtggtataaatgagaaactcttccctttcctacaagcttggctgtatgtgaaggatcaccgcaatctcatacgctggttcaagagtgtgggtacactgatcagtgagccaaagtctgagtaaggtcgtcacattatctgttgaatcttgtgtgtttttttgctttgtacaagtttcttatcgatagggaaagctgcagttgattgtacagcatatgctatattaggctgttatggaattttatctgtattttcacaaaagaaaagtagcacttctgttaaacaaatagttgtctcaatataaacttagtcgttactgttgcatcatgtggtgtgaagatctgactccaattttatacttttcagatgttaataacatcttgctgaagatcacatcggggaggcgatactaggaatgtttcttgcctgtttgagaaaacccagaagatttggagctatgctacaataaagcaaatgcggcacacgatattgcattagtgggggtttcttcgttctgtttagtttaactaagcccctggggagtagatcgtcactggagggcttgatgtgtaggattactagcgtgagttttcaatattcctgtgattggatgctctaccattagttgtgcattacgatataaccatgcacttgaacaatttatgcatccttcctataatcatggctatagggttacaaaattagcctgaaggagccggaaactattggtaatttttgtaagagagcacatccccaacttttatagaaaggccatcattagatgattacaacacaatcacttggggagttgggggtatagagaactgtacaagattacagatgaatatgactcctttcggttccatttccaattacactgatgatgatactatttccaattgcaccgatgatactcgtggtgtagagaaggaatgaaccgtatcatgctgggtctttgcaggcagaaacaacaaaatccacggcaggagatggaggtcgattggttggtaagccgtaacctgccgtgctgaagcttggttggatgcctggatttcttggagcgtgggccatataaaagagggcaatctcctggcttacctcgacctctcgacccagcccggcagcccacacaatccaaaacttcggcccgtacatatgccatgctgtagtctactctggtagatccgcccgtctctaggatttgctcactggtgaacgttgatgtcttgatgaacgaaacaatgagaagaggttacagtgaccaggaacagccttgcagagttgcagatgagttcgagaaaaggttcaaataagtgttgctttccatgccaccacgtaatcagctgccacaggcacgtttgacaattgaaatcgagatttttccttcgttttacttgtagttgtaggccctaaattcctaactgccccccaatgtccgggcaactagaacggcatcgggccccctaggggatcgcagtatcgcaccacgcctgcttcgcgtagccgtatcctcgtggcagcgtatcgctcaccgctcgcgcgggaacgtggcgcgtacccgaaaagggcgtgcgtgcgttcggtgcgggggagctgcgtgcgtgcgtacggtgcgggggagctgcgtgcgtgcgtacggtgcggggaatgtatcgcgctcgcgtcagctcgaatctaacctgcccgaaggagagagacgcccgcgccaggacggacggatccgagagtttggtggcttttcgccgcgatatttccgagcttgcgcggggggcatggggacccctgggatatggggctgggagggagccaagcctcggccggccggtgatgaggacgtgacgtgacgtgatcgggtgttgctgattcagccaccgattgggacgtgggaccgcgcgtgagggtgaaaacggagatctttggcgtgatataggcgcgtcagtgtcaccgaagcagggaaccatactgtgtatctggatcgacgatacacgtatccggtggccatgcagaagacttctggagacattcatgcaggagacgacttttatacttcctccgtttcacaatcttaagtcattctagcatttctcacattcatattgatgttaatgaatctagcgagatatctagctagattcatttcctccgtttcacaatctaagtcattctagtatttctcattaacatcaatatgaatgtgagaaatgctagaatgacttacattataaaacggagggagtacacgtcttcgttgggagattcatcacgtgtcatatacggagtatgcttatgctttcatcgatattggattggattggattattactatgaagtgtaatcagtttttgccttgaattctagtacctcctttttgtaggagagtagaattatgagtactatgggaaactggctagggaactcttataaaattcgagcgcgacactactaccgaaggagaacgatcgagtttgttcaaagcatacgcatcatcgtcttatcatcgattccacctatcaacatctttcgacgcgcaaaagttcaatctccatacacataagccaaaaactcacgtcaatttcggtcgttcttcatccactagatcacctaaatatacgcaccaccacacactgcacaagtacagtactgtactccatacccaatgcaactcacactcactcccgctacgggcgacccgatcgagcctacctctaccaggccaggctagctataaaatcacgtccatgtcgttgatagttgactcggtgtggagctatagcaggtacaataaaagactattaaccagctataaacatattttaataagataaaagataagagaaaatagcagcgggctacagatctgtagctagctgcaacacgaactataagacacaatgtgtgtataacaggtgggatcatatgttaatagtatagtaagcaactattgtatgaattgcctattagataggctataaatgaattagagctagcggtgggctatactattaaacttgctctaaaagcaggtacaatagtaagctataaccacatatcgagaaaaaaagagaagaaagagaagaaagcgggctacaaatttatagccggctgcaatacggacttcaagacattatgtgtatatgagatgtggaaccgagtattaatggtatagtatatttttatatctaactattatataaataggctattagattagctatagatggtttagagccagtagttggctatactatctctaagctcgcgcgcacaatgatgctgatgcatgcacccccgcgcacccgttaacgtattgatcgaccttgccgttcgtctaaaactaaagtcagcggcagccgatcgacctcgtcgcgagcactcgacggtatgggatcgagtcggtggaggaagggtatggtctccgcagggcgcacgtacatacgtacactgtaccgcatcgctacgcacggcatgcacctcgtacctcgccgctgttccgttccgtgctctgtgtcccatactctacggccacgcctagttggatatcttggcaagcgcgcgagcgagtcgtcgctcaaagctcaagccaagccaacagctggcacggagaaactagcctgcattatgcatacacgtcattcacgtatgcatgggcatgagacaacaccggttttttttttctgttggaaagcattcgaagtgaaagtaatcagggctaattaatatatatatattggatatttcacgttttcacgtgaaacactactttcgtaagtggcttccatacgaatttacagtatcaagcgatacaggagctcctcactccatctctctacttaagcctgcaaacctcgccgcgcagacaagcacgcgacgcgagcgagccagagcaacgcaagcaagcaagcaagcagctagctagcgcagcggcaatggcgatcgtgggcgaggagtactgctccgcggaggagcgggtgctcacggtgcgcaagacctcccacttctcccccggcgacggcttcgcggcctacgaccaccgcaccggcggcctcgccttccgcgccgacacctacggccgcggccacggagggggagccccctccgccggcgagctcgcgctcctcggccccgccggagaggcgctcatcaccgtgcgccgccgccgcccgtccctgcaccaacgctgggagggctacctcggcgcccgcgccgacggccagaagcctctcttctatgctcgccgctcctccatcctcggcggcgccgcggccggcgctgtcgtcgagctcctcgccccgctccccgcctccttctggtctacccacgctgctgccgccgagctcctccgcgtcgatggctccttcccgcggcggtgctgccgcgtggtggcgcccaaggcccagtcaggcggggaggcggcggtggtggcagagatcaggaggaaggtggacgagggggcgcgggtggtcatgggcagggacgtgttcgtcctgcgggtgggcgccgggttcgacgcggcgttcgccatggcgatcgtcctcgtgctcgatcagatcgccggcgacgaggccgacggcaacgccggagaggaaaccaaccgcgccatgatttggtgatggaacgaaccgtgcgcttcttggtctttttgtgtatagcgctgcgttcttgctgatcgcaattttcctcttttgttttgtttgtgcgtgttggtgtgtacgcctttgctccggagaaaacggcaatgtgcaatacgtgttatgcaacttatttcgaagtttttagtttgtatacatagcaatcgccagaatggcagatgaatgtgtggattcttgaagccttttttttttttttggagtaatcaccggaggagagagattctccacctaaattttccattgaaagtgagcaaattaaaggttcatacatagaggatcgggcacagcaagcggcgtgccattacatattatcggaatttaaagggcgggatttccaagctatagcgacaatcctatcagatcgcttgagccgtttctacccagagggttgcatcatcgttacatcggcgcaggagacgacggagacagatgtcttgatttctgaaaactacctatgcctgtgattccacagccccagaggcaaagcaaaaaatggagcgatggtgcgcgaccgggatgttcattgagggtttgatggattcttcgagctttcttgttcatcagattatgcatccctgcttcgtttttctattctggaatctgggcacagttcattttcaatactagcttggactttgtgttcaccggccactttggtgatccacctcaacagctttgctgagagcacaagaatataaggcttccgttgaagtcaacatggtagaaaacattgtgtggcagtgaactgaagccagtcaccctttgcgagctgcagcctgcaagttgtggaatgaagaaggaaaagttccgcacgtgccctgtgcttttctcgaatgaaagtctatccatcaccccaaaccttcaaactagacaaccctacatattatgcaatacaccatctacataaccctttaaattgttaacatatatgtccaatgtgcaagtcatatagtaaaaattttacaacatctatgacacttagaaaacaaaataataccgtctggctatatgaacaatattattaatattgtaaggtttaaagggtcatatatacctagttttacagtttaagatactaaacaaacttctcttcaaagtttaggatgacatggattttttccgacagagaatatttttcgtggcagagattgctcgagcaggtccaaatggatcccacggtaggaaaaatgcacgatgcagactgcacgtatgatgtctcaatttcgtgagccacgttgcgacgaacaaatacgttattactccttaatagcaatgaccatatcccaacaaaaagaaaaacaatggcagagagcattgtcgactgtagcgctgaaatcaggcatgcatgggagcgcattgcggagaatcttggcataaaaaacgaccattatagcagattgatgaacctataatacactaaaatacagcaaatatactaaccatatggaacacactttcattagtttatacacacatgcaaatgtgcacgcgaatttcttttttctgcaccccttttttttcacgtcagtcgatacgatgcacgaccagcttggacactccattattcgcctgaaatccctgcactgaccaaatcgatcgtctacccacgtttaaaaaacacgaatttcgcatcttctatgcatgtacactctgtctttccacatatgctctcgacaagatgatacggtctgatctcccttttttgagctaacacatggcgataatgtttttgtgatagtactgaagtagatcgtactacatcacaatctccgctacagcttttgtagcgcgcggacccggataaaccccacgaggccacgagcacccaccgctcacatcacaccagcgacagacacagcggcgccagcgccagcgcgcgccacggcacggctcaattattgtgtcgcgccgctcgcgcgtgcggtaccccgcttttcctgcttaatcggtcgctgccgcgcaccgcatgtgtacaggagaatgggtgggttggtgacccccccgcccggccaatcgcggtgtatatatggccaacgcgccgctccgcccgcgcgtccgagcgagaggcaaccggcagcatcggtagatcgttgtgtcgcgtcgcgtcgtggcaagcgagacggacggatgggtggggtggcgtcgcgccctcgaggtagaccgcacgcaggcaggtcggcggggtcgatggcaacgcgggtggcccggggccgcgcgcggtgtgaccgtgtgagtgtgtgactgatcgatcgggcagtgacatgcgtgcgcacgcaggtcatgcgctcacgtacggccacgagccatattttcgttgggttaacgcattcatgggtgcaaaatgcgatggaaaacgacttgaactttatcgaaaagggccggcgggactgatgcgcttggagatagtgaaaagtggggaaatggttcgttgttctcgtatgtacgctgcagcttttgttcctgcttgacaacttgtcaatactttcacgtggacactgagtttacctgaggaacaaagtggctccaagtcgtggtccagaagaaacgtgttctcgacttcgcattacgtaaaccgttgatatgttttttttatatataaataatagatcataagcaactggtattgtgtatgtgatctgcatgcgcattgatcagaattactctgtcactacgtcagtatacctaattataaactagtagtgtcatgcttgtttcatttcttctctcattttgatttagcattaggattcttgctagaaacttctctacctttttttttatagataactaggaaggtagcccgcgcaaatgcatgggcatgcgtcttacgctaagtttgagacactaaaagcgatatattaaccggagaacatctaccccaatttctccgtaaattgtttttgttagcattagttacttttataatttttaacctattagttttatattatatcatatttaagtaatattagttatttataatcttcttcatcatttgaaaagaaggtagacttattttcttttgaaaatatttcaacgaaagtaaaagtaagtgtaaagcaaaagaagtgtgtttttattttttttattgcacatatattatcctggtttattagaggatgaatttggtgggacataaagctccactaaattttatatagcctaatataattgatatagtttgagagacaatccatctataaacatttcatgtagagtgggtaagaggttctacgcaatctaacgtgaatacaattgcacaataatatttttgaaatgtgatgtaccatgaatacacgcttgtttttcttatataagatagatctaatgattaaaaataatagtttcactggtttaaaaggcataggagtattctaaaagtgtagcttaaaaatcatggttgttttaatatccaacattattttgaattgaacatagcttaactggttaggttccttgtggtggaaattgcccacttgtcttcaaatcccagacttgataaattctttcagtggtagacaacgtacccatcgacagcgagacaatcatggtgactttgtcatctcaaaatatgtcggcacaatctctcagaggtactcatagggggtagagtgtgcatgtgtgcgttcgtaggggtgagtgtgcgtgcgttgtgagcgcactttgtttctcaagaaataatccaacattattgataagtttattagttattgataagtttattagggacgggtggacgatgcgtagtatgtacatgctcgggagattttttttctcaatccggtggatagtagtacgtattgtacatgtgagaatgagatgcattttaaataaatctaatctaatgatttaaaaatagtgggtctgccgaattaaatgaaaatcgagggttggatttttttttcttttttctcaaaatttgtaaggttttatctaatttattatagtgccacgtggcagcttaggagcattggtaggagtctcacgtggtggcttgagagttttctaggaagtttaatggatttttcatatataatatatagatacacaggacaaatacacatgcagcttttgcttgcttgttccgaagttgaacattaccgttatattatcatgttatacagaaagaaaatttagctttatgtttacttccatataatttctatttccttatcaagtagaatttggtacataataggtcatttctatcttaagctcggaatgtatataggtggacaaacagctaggatctgactgattattttttaagtaaatcttatttagttatgcatgttttgtgatgcatcaaattatggtataatctatattttgtttttctcataattcagaatttttagaactttttgaagttcataaatctgttttagttatgcatgccagtgaagtgatatatgatgaaataatatataatgtcactttcttttaataattgttcatatatgtttgaataacatgtaaagggtctcaacaaaacttaaatgaatataattttacaagttaaaatatagtcaacatgtgtcttaaattctaattgtgattttaatcataaataacacaatggtacaaatagatcaaaaattgaacgtataattttaaagttaaaaagttagtattatttaaaatttactgttgcaaataatatgtatttagaagtatacttatttaaaatttattgttgcaaaatctttcatagagagagaatggaaggaaaaaaacgtagaggatttcctaaaagaaaacggaggggaggatggacgtcttttttttaaggatgagaaaaattaaatctaatctaatggcttgaagtgttatgtccactaattttaataaaaaaaatttaaggttagatgtttattttttaggtatatgatttaggtgttacgaatgttaaaaaatttttaatcaaattccccccgttagctaatacaggaaaaatgaattatacatagaggggagggagagagagaggggcatacgtggggagagggcgaacgtaacgactgaggagagaggtggggaaggtacgtggtctttctttccatctctttgtttatatgagattaaatctgatggttaaaataattagcctatcaatttaagtgaaagtggatgttagatgttcttttctcaggatttatatttttttttaatttattagagtgccacgtgatggcttaggagcatttgaagatgccccatgacagtttaggagcgtttgtagaaagtctattagacttttatatataattactaatattaatttgggttttatgtcatgtgagtctaaaagaaaaaagaaaaaaagggatgtgtggcccaacgtactaaataatatctataatatataaaaaatataatatattactggtacgtacatatatttttgcatatatataggctggagttaatatctatgagttggaataattaatttggtttttattgttgtgagcgaaaaagaaaagaaaagagataagatggacgtgggaccatgcatgaagtacgtacgtacttacatgcacctatgtgggttatgtgggccttttgagataaattggcttggctatttttattataaattaaatggtaaaaaataatgggtccaccagattaaaagaaaactgattgttaaatttattttagaattataaatttattagagtggcatgtgacggtataggagccaccaatttaagtgaaaatcgacggttagatttgatattttatattttttatgacgggtctagttgatgcatatttgtggaataatatattttatttttatatgtagaaaattctatttttgattttttcgatggtactatatacgtatattttttggctttattttttttatcgtaaatacgctggtacgtttttttcctccctcacgaatcgtagattcgtaagtaagccgctcttttccaagcgaaccgatgaagagaagttaagctttattgttttctacatagtacgtacgtactcatggagtatttatgttttttccctgccaacagtaagctattagtttctttttaaataaaatacatctaatctaatctaatggtctaaattatcgggtccaccaatttaagtgaaaatcgacggcgagattagatattgccacatggcggtctaggaacgtttgtagcagtgtcacgtggtttttggctttatttattttatcgtaaatacgctggtacgttttttttcctccctcacaaatcgtagattcgtaagtaagccgctcttttccaagcgaaccgatgaagagaagttaagttttattgttttctatatagtacgtacgtacttatggagtatttatgtttttttccctgccaacagtaaggtattagtttctttttaaataaaatacatctaatctaatctaatggaatcgacggcgagattagacattgccacatggcggtctaggatcgtttatagtagtgccacgtggcagcttgagagtatttgtaggaagtttaatggacttttagtatataatagatagatagatagaaatagatagatagatagatagataatagatatatgagaaacttatatctactagtgctagtacggtgaggactgtgagcctgtgagccttgaggctgtaattactcagttatcgcgagtactcgacttaaatcgagattcaagaaccgctcgataaacaaaccaagtttaaatgtcatcaaaccaaaatccaaattttcagtaaaatcttatctgaattataccggttttgggcagtaccaaatgaacatttatcaacgaaaccgttggagattggtattaggtgacccaaacggttttgcatatgcttggtaccagcttaaaataaatataaaagccatgttcctatcatgacgaaccaaaattatgagaaaaccgaaaagtttaaaacatataaaatacaaagggatcaacattcaacataatgataattgtaaaccggttttaaaaaatttaagttctaattcatacaaatacatgtacatatataaggccatcgatgatccgaaggcaacacgacccctttttgtctagcgcgttgaaggcagggaggagatgggggaggttgcgactcctttgcgcctgagttgcctgtcaggcttccaacatcatctaggtgatcatctctaccactgcaggtctcctttgccactggcaccatatggatctggacaacatttgcccatgcacgtcatcactagcccctccaattcaggttcgaccatcatcgccgtcattgtgcttaggaaagttgatgatgccactaaacgtaggggaggaggttgagttcagatcgtcgtagatatgggaccaaggccgtcaatattgggagcaccaacattgacaatgtctatgggcaatgttgctaacatcctctccgttaccttaatgccttggggtgaactgtccgagtaaaaaaatatagttttagatgcttagaatggcgatagcaatatcgtagttgttgtgaccttcttagaggtattcagtcgacacaataatcgatcattgatttcatagattatgttcctggtttgagtaaaccgtttgggaaaacaatggttatgcagatcttaccatctataaatagagataacctatgtctttaaggtggtattctaataagtaatttttttagttaagctacgattttatcaagcgaagtcattcgtcttacaaattctataacaaattaacaattagctatagtttctttgaaactaagaccggtatatatttcattataaagaaaagtacaaacacaaatgcatgaaaagtattaataaagagctaaaagaaggtgacatgtgactcagattgtgggcctggctaaccaaagtaccttgcagcaatgcaactaattactccagtagttagctttcatgtcgtcatgagttcgtcgggacaacatatcagaaattcgacttattacgggcctccacttatttgccttctcgggcctctcggcctcttgggctaccactgtggtttaattctgcagataatgggaaatatgaaagaagcactgcttgggggtttaacagttagggttatggattcttcaaataggatcgaaggtacacatgcaaacaccgaatccaacaacgggggctatcagttcacgatcgacgtgatcgagtacatccctaccctaacattgaattttcttttccattgtgaggataacaaatatagattttagcgtagattcaagagcagatccgcactcaaaatccttatctaaattttcgaaaacaaatatattcgcttttgtcttgcgccatggcaaccacatctagcagcacgccgcaggcgcgagctctcccttcttgtacccgccgccgcacaggcccgccctgaacgccaagaaccccgccgcgtgcccggcgacggccgcgaggagcacgccgacgttgaacgacatgagcgcgagcatgagcaggtacgccagcccgacgcgcaccgcgtgcaccgccgccgccgtcgcgcgccgccgcctgctgccgagggaggaggactcctgcacgcggggggagccgaggaactcgaggagcacggccagagcgaagacggcggcgagcgccagcgcgtacatgccgccgctggcgcccggccacccggtgaagaggatctccgagttcttgccccagtaaaacgtcatgtgcatgtaccgcttcctcctgcccgcgccgccagccgccgcaggcgccatggccatgggcatgccgtgccttcccatgtccgccattgcagatgctcctgatctccgcgtgcacgggtgtgtttggtttgatccgtcatccacacgnnnnnnnnnnnnnnnnnnnnnnnnnnnnnnnnntcngattgtcattcactccgg

SEQ ID NO: 30036 - DNA, 8583 bp, Oryza sativa
  unsure (1)..(8583): unsure at all n locations
naacaactttgacttcctatttctataanaatatttattgaaaagtgctatatgtaaacttttatgaaagtatttttcaagataaatctatatatataatttttatattttcaaactcaacaatttgagagttattcatgatttatatttctaaggtttgacttaaacattgtcctaaatgatttcctttataagtatggattagtataactgaacaggtgcgcaaatcgaggacctcgcaattcgaggttttcatgagttgcagaatctggctattgtcacaggaccattagagatgaaaaaaaaaagtgagatcaaattaggcccaacagatgatcgggcttggacttgattgggcttacagcttactggccattttccctcttgagatggataataatcatggtcttatggatggatcaattgaatgaaggaataagagcaaggtcaatatagcagcccactaatagctctaaatcatctatagccaatataatagctaattcatacaatagttgcttactatactattaatacttggtcccacctgttatacacgcattacatcttggagcccgtgctgcagctggctacagatatgtagcccgctgctcttctctctttttctttatcactttaaaatatgtttatagctgacttataggctactattgtacctgctctaatcatcctatgtacggcaggtattctggtaacagatcatttatggaggccttagattccaccagacaaatcatcccccgtagcacgcttccacgaccttatcttgaagccaatttggtgcttttttttgtgtgtacgtttatggagaacgacatgccatgctgtgcgttgggcgcagaatgtcaacgaggaaaatccatcgtacggcatgggcggaaaaaggtttccttcggaggcttccactgtcaagacgaaattgtagaatttacaagtggccagattttaagtctgaaccacacacaactgaccaattataattgcccctccgcgaagtgttcagcccgatttagtagtacaattatgtggtgaaattgattaacttttgttcagttgggtgcataaaaaaccattatttgggttgtttagcagtgcattatctctaaaatatagcggtggataatgtaacaaattaaacagcagcaggttgacagccaatctctgacgcagcttaagaatcaactggactcgagtatgtaatagtattgtacagactccggtttgatatattttgatttaatttttttttagcagctcaactttgagagatttttgttcttccacatgtggaagaacacctgtgcttttcaacagcagccatagaaacatgaagatcttcaaaaggagaaaaaggagatggtagtactacataggaagtaaagtgtgttcttgtactactaaaagtggtgacgcgagcggagcaaacaaaaagacttaaagcactaagggtgctgtcttttggatggagtaccaatctatctaccggtaaccttttgaaatgtttgctgcatatgcgctctgttttgcgtctcagagaatttaccactggcggtggcccatggtgcagcaggaaagaagatgggagaacgtgaaggataacccatagagcgtcaaatcgatggagcaaagcaaacttatagaggcagtaagacagtactttcagggtagcatactgtttcggtagagctaatcatcattcatggaattgccaatccagtcagtagttcagtgctttttaccagcaaaaaatggacaatacagtggcatgagaaattcagcaacatgaactccggtgcatgcagaggagcaattttgggtcagcaacacaaaagaggaaggtagaaacaaaccaatgcagaacagttttgtgccaactagcacatacagatgcaaaacaaaacaagaattgtttgaaggacatttacatttctttttaaagacaaggacatttacataagcgcaccataatcaatttattagaattgaaattacagccagggtgaatcatcaatgaaacaagtgatagatagcggattgcacgattacagtttcacggcaccggaacttttcagatttcaacttgagagatggaccatcaggagcctttttcatgtcacgtttttgagccatacaatgatacagacgaaagaaaaccagccaaacaactcatccaaccgaccgttaacaatatacacaattacacaaacacatgcaagcatcaaaccaacgtccaccgaaccgaatcgatcgctcacagtacacaccaacgtcgacgaggcggctactagcagcaggccgggtcgtcttgcggtcctcctccacctgcgcggggccgacgcacaggccggcgcggaacgccaggaaccccgcggcgtggccggcaacggccacgaggaacaccccgccgttgaacgacatgagcgcgagcatgagcaggtacgccacgccgacgcgcaccgtgtgcactgacgtgcgcgcgagcccgcccgccgccggggcgcgccgagccagtgcggcgaggcaggcgtccgccctgcggctgccgaggaactcgacgatgacggccagcgcgaagacgaagatgagcgccagcgcgtacatgccccccctcgtgccgggccacatggtgaagagcacctccgagttcttgccccagaagaaggtcatgtgcgtgtacctcatcgacttcatggcgcccatgccgccctgcgccgccgccccggccgccggcggggacatgccgcccatgtcgtgccctcccatgtccatagctgatagcgagatatttggcaattgatctgcttgctctctgccggcgcgtctcggcctctcgggagtacgacgtgtatatattggaccggctcaccggggcgcgtgtagtacgtacgtcagggcaagtggtagtacaccgtttaccgtactacacacgggagcgaggcgaagagttggcggccaacaacttgacagcggccgcgtgggcagttggcgcatgtacacgccgctactcctgtgtttagagagtttggattggaccggttgtggctaggctgggtggaccaggtgcattgagccgctgcgagcctctcttgccgattaataagcagccagtggtacagtgggatgatagccacggaatctccgatctgggatgaatggcgagaaccgatcgagagaagatcttttaattaggaaagagttgacctttgcttctcagctgaggggataactaactgaactatatttggaactgttaatgcatcgtctctcttcatcaaaatggaaggatgtacattgacttaagcaagcgtgcgatatgatctatacttgcaaaacggcgtcgtcacataatcttatgtaagccatatggacttctttgcaccgtgtcgaagaattttgcggtttgcaaatgacaatttcgcactttcgacgaacgtgcactttcaacataaacgttggaaattttgaacatcgctctagcaaaaatgtacctgatactattctgttccctttttataggaaaaataatgtgctctacacgggttctagttaatcacctccgaaacaggataatttaattagacataaatatatatgaacactcatatcaagtttaaaacttgaactagggtaaacagatttaaaaaaaaaaacctaatcagttaaactatacttaccttattgttatccgctcattttagttttactaggtgatataagagccataaaaatgtaataccccctcagtcccaaatatatagtaatttaagattagattagatatataatagtattatgaataaaaccattgttctacgttactatattttagaatcgagagagtaacatcttacattcttcttatactccctccgttccagaatataagaagttatagagttgggtacggttattaagaaagtaggtagaggtgaatggtggaaagttatgattggatgagtagtgaagatatgtgtgaaaagtgaacggttaagggttgtgattggttggaaagagaatgttggtagagaagttgttatattttaggacaaatcatgatgaaccctgagttcctctcgacactcaagactgttgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagtaatctgatattgcaaataggaattcaatacaaatgataagttggggttccgaagaacaagcagacggacggtctagccgacacgcgcgctgcaagcaagtagcaatggctaaactttaatctaacaaaaccctagaaaccctgaaggggtaactagctatatataggggtgggaggacgacctaggagtgcctagggtcgtgctccactagcttggggtgcaccccacatgggccccacctgggccggggtcccaaatgaagttacaagcccatagtcccattacaggtgtcgcagcaccttgtttcttcagttgctgccgactgagatggaatttggcaatgaggcttgatgcattggaaagaggactccgagagctttccatcaagtactcacgggccgaaaacggaggtcgtatggagtttcggcggccgtttgaagttagcagtgtagcaggtggccgaattggattttggcacttggaggactcgaacttgatatcttgttgtccatccatgaggtgagcaacggatgtatccgtagtagtcatggtcacatcatcctccccttcttcacggaaaaccgtcctcggtttttccatatggtgttcttcacatagtccattcaaaataacctgtttcatccaatcaaaactagagaaactcgaagtagtgtgattagcaataacatgtttctctaaatccgaacaaatgaaaactctatgcaccaaatatattcctctatcattatatttgccaaagatatgaaaaatagcattagttggacgtggcaaatcagacttagcaaataatttctccttcaaattatcgagctcacaaaaatcatcaaactgaacatagcccaaagtatttaaagaagatagcaatttacgttcctcaacttcattagcaatgtgaacagcatgcttaaaatcagcacacaaagaaacactaggaatagcatgctcattcactagttgtggcatggatataagtgaagcattatcacacaactcttctttatcacaaggaacagcgagtaaatcaacttgtgacaaaggaattccagcatttggttccactaacggttgctctacttttgcatgaaaagtgaacaaatttacttcgttaataatgcactcaccttgattaatttcagtaccatttactttaccttggatgtcctctttagatgatggaggtgtctcaaacttgagtgtgaacaatggaattggtggctctttcatgtctctctcctccttttcgtgattacgcacttcctacaaatagttagtaattggaggcaaagacatagcgtgtttctttttcatatcctcctctattttactttcagcattgcaagcaaattgtaacaaatgagaaagagatctatacttttcacaagcaagcatgtcctgaatttctttgttaagtccacataaaaacctcaattctgtagcttcttcacattcatctaagccacaacgtaataaacaagcatgcatatcatgataatatgaagtaacacttttggtatcttgttttaaacattgcagtttgttgagcagaatatcagcataatacatgggaacataaacatctctaaaatatcatttcaggtctttccaagattgtggtattttgttatgcctacaaagatgtttccaatcattagaagcatgtttaactaaaacactagaggcacacataaccttttgtttctcagacaagacatgcttttgaaattcactatcaaccgctagctcccaattaatgtaagcatgaggattatagtttccctcgaaataaggcagtgcagatttgatcttacctagaacatcgtcacttacctcataaaggtcatgttgatcactcctcatgtctcgacgaagatgtcgatggtgagcacagctatccccaattatcttgcgtatccctgccattgttagtagaaaacaagaaacatacacaaaaatatgcgcgttcctattaactactaggtagtggcagctcaaaaatcacacacactcaagcttttaaccaagctcttacaagatcttaccaatgcaagcggaatggtgacatacaccgactcaaccaagcaccccaatggaggttggatgtatcgatgccttggcgaacacttgttgtacggctgcaatcaaatctgtggagctctgggtaggcttaaatatgtagcaaaggaatagcaaatgctcaaatcagagaatgcaaaattgaataattgttcaaagtcaagcaccgtgctggtcctaggctagaacgtactagagacgcgagcctagacacaaatgataccacaagatagcactaggaacaactcatgcacaactctgatatatgaagttcagctcaaacataacaatattttctcttttctttctttcttctttctttttttttgtttccttttcttttttttttgggtgcggcttttcttttcttctttttttatgcacctttctgccttttttttttctttctttttttttgattttattttacaaaaacagattcaaggacctcaatgtaagattacagggactcaaacataaatacaaaatttatagggactcaaatgtaaaagttaaaacccaaaattagaactatacaataatggaatcctctcgtcctgtaggttccgtttttgcaaaaggattttcaatccgatactcgaaaaattttcaccaagcagtatgcaagatcacggtatagattgaaaccgtgaccgagaggagacactcggactcggcctggtcgcggacccggggtggtggtgggtgaggaaaggaaggatgcggcactacctaggagtccggttatggtgagagaaaaagggaaactgatttcaatcaatctgatctactatttctttccagattaaactctcatacttccaaaaacagatttggaaattcttcttcctcctctctacaccggcaacaagcgcaggccgatctattcacgggcaaaccagaaactcaagcaaatcctaaaggcaactccaaaactgaccgataaaaaattctgaaaactacaaaaacaaaaccgtggcagcgggccgattccgttttcgtaggtcccgacaacaacagagacacggtggcagcgacgattgtggtacaaaacgtgaccagaacttgaaactctaaacaaactagacgctaagaccagcaacacgatgtgacaatgcaacacaaaattcaacaaagcaaaaactgaaaagaacaatgcaatggcacaatatggctaggtaaatgatacgatttttttgtatggctattttctggttaggaagataaaaattcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaattcaatacaaatgataagttggggttccgaagaacaagcagacggacggtctagccgacacgcgcgctgcaagcaagtagcaatggctaaactttattctaacaaaaccccagaaaccctgaaggggtaactagctatatataggggtgggaggatgacctaggggtgcctagggtcgtgctccaccagcttggggcgcaccccacatgggccccacctgggccggggtcccaaatgaagttacaagcccatagtcccattacaggtgtcgcagcaccttgtttcttcagttgctgccgactgagatggaatttggcaatgaggcttgatgcattggaaagaggactccgagagctttccatcaagtactcacgggccgaaaacgaaggtcgtatggagtttcggcggccgtttgaagttagcagtgtagcaggtggccgaattggattttggcacttggaggactcgaacttgatatcttggttgccattcatgaggtgagcaacggatgtattcgtagtagtcatgggcacaatatacttcccttcttaacgaaaaacgggcttgggtttttcatatgggggtcttcacatagnccaatcaaaattaactggttcattccaataaaaactagagaaaccttcagttgtgtggatagcaaatacc

SEQ ID NO: 30037 - DNA, 4949 bp, Oryza sativa
  unsure (1)..(4949): unsure at all n locations
gcggattgattgactatcnnnnnnnnnnnnnnnnnnnnnnnnnnnnnnnnnnncacaagcctccatctaccgctctcacttctctcgcagagatggcgcacgccttcgccggcggcacctccgccatctgccgctgcccccacgaccccggccgagccgccctcgtatcccgccctcgccaccgcctccgtgtcctcgcgtcgtccctacccacgccggccatcgagggccagggcgtcgagttgtcggtgacgactcggcgggggcgggtgctgccggtgctcaaggactgctccctccgcgtccctccgggtcagctctggatgctcctcggccccaacggctgcggcaagtccacccttctcaaggttcttcatcttctttacccccctgaactgaagagggcgtcgtccttgtgcttttcatgtgtattttgttcgtgccctgagcgtttttgctcatggagtaggcaaaagtttagttgtagtattagattgtgcccatggaccacattctttgatatcttgctccaggaaattttcgtataccgtcaggagccgatggatgttttaattcgagaaccactagtatgtatcttgggctaaccagtgagtgagcattgtatagaatctcaggagtggagcatcaagcacatttgactatttggatgaatggaccagatggcacaatcagattagcaactttttgtgatatgctcacccagaatagaatgatataggatgactggatgagaaagtaaaaaagacagaggagaagttctataaattttattataatgctgtacaatatttacttgcctaattaggctaccggactatcaaaattggtctgaatttcttagtacagctccttaatgggatgttaaccgaatgttttctctaggttttggcaggatttttaaatccttcttctggtacagtgtatattaacaggccatgcagctatgtcttccaaaatcccgatcaccaggttgtcacttatattctgctttagtgtttatctgaaatttcactccgttctcaaatggaatacaacaatgttaaaattgcattcacataacgtgtattatgctagttagaaaatggaattcatgaaaatctttgttcttttctatctggtatttattgatactctgcagcaaattgaagtgtctcggttccaatgttccttgcttgcatattcgttttggactgtataagcatgttggccatagtcttagtaaccctgttgaataactattcatcggttaaagtaccaaggtccagtttttctttataagtacttctgcaatatttaggctttacttcaccgaccaatataactcatccagctttatgtattttaaggtaatactcatactccctccatcccaatataagtgtaacctagtacaaatgtgatatatcccacgactacaaatctggacagacatttgtactaggatatgtcacatctgtactaggttgcacttatattgggatggagggagtatttgagagcttagttaactatcctactaagttcgacaacattatataagtctttgaaaagaaacgacatacatagacatactaattcgtaaattgtactgtaatctgatgagttcactcttaactgttgcccataatagatttagtttcaccaagcaagaaattttgtgctacatgattgtcttaatgaatctagttctgtgttcctcattaatcttcattcacaaacttgggtgtgaaagtaattcctaactcagaacttagtaaactctttggactaagaattttatagctaattggatacataaggtgttgatattttagttcctttgaaaactatacagttgtgctgtttgctgagtttcccctgaactaaatttgaacatataaatgttcattaagatattgctagactgtatttgcatcatattactagcaactatagaatgttatttttttgactcttgatgcattggaggaagattgcttaatgacacattcatgtcaaattagatcaagctttctggtacatattaagttacgttctttgaatgcaggttgtgatgccgacagtggaatcagatgttgcatttggtcttggtaagctcaacctttcgttggatgaggttaggtcaagagtatcacaatcactggatgctgtgggaatgttaagctactctcaagtaggcagctgacatgctccttttggattataatctattgtctgcacaaggttcacaaacattcttcatccaacacagaggccaatccaaactctgagtggcgggcagaagcagagagttgcaattgccggtgctttagctgaagcatccaaagtactactactggatgagctgaccacattcttggatgaatacgaccaggtataaatataatgcatgttcttgtttctaatcagttgtactcaaatactccctccactttttaatatacgacgttgttgattttttgagaaacgtttgaacattcatcttattcaaaaaattatgtaattatattttattatgacttgatttatcgtcaaatgttctttaagaatgacttaatttgttatatatttgcacaaaaatttttaataaaactaatgatcaaacgcttgtcaaaaagtcaacaacgtcatatattaaaaaacagaggtagtaattgatcacgaggtaactaaatattatgctgaggagaacaatgattaaccacatcactgaaaaccccagatcgatttattatttaaacaactaaacaattgtgtagctttgcttctacaaatgcaattttcttttctttattcacatttgttgagtggccatcatacctcaaaagctatggctaaacacaactttaccccttgttgaaatctcgattcatatttttctgtttctaatatgtactctttagtagcatgtattactccgctctggtaatgacactgtgactaaaatgagcgttctactctttctttcatcaaattgtagatgggtgttatcaaggcggtaaggaaatctgtaggtgctggtggggaggtttcagcattgtgggtgacccatcgactggaagaactcagatatgctgatggtgctatttatatggaagatggccagacaattattcaaggtgatgtgtctacaatatccaaatatataaagaaaaagcaagcccgctacttcggtcactttgagctttgatacttggaatgaatatgaagctatggggaaatttgcctactcctgtacacatcatattgttgaaaatcagtttatttttttaggctatttccccgcaaatttcttacctcaattccaagctgtattctactctcttgctctttacttatagcaatgtcgatttgggcattttgagttgtcatgtagggcctagatgttcaaattctgccacagctctgggtttcacaattcacgtttgagtatgttaagcctggaaaatttgggaattgcctaagcagcagttttcctgtgttacatacatgaccccagtgaggtggtgtgtgtcatgttgacgtgccacttcacttcacactgaagcagcagaatacctgagccaattttgttcttcccggctgagagatccaacccaaggtacaattacaaatgaggaccggcacaatagctgctcacgtagcacggtggccaaactaagaagctaccacctgttctacctttttcattggcaaaattgagaaattggccaacctttttctttggcaaaattgagaagttgttctacctttttggttggcaaaattgagaaataagctagaggcttggaaggtgctacctttttgtttggcaaaattaaagctggcacctattctaccttttttctttcgcaaaattgagaaatactgtagtagggtactagagacgtgtgtgataagtccgggaagttatctggcgtggtcgccattgcgttgcgtcacacagatgacacaacacagccaaaggcaaatctaatcaagtattcactcattcattcattctctggacgcatgctccaatcacactcgagctgacgcacacgattgacccctgaagccaaaaaagaaaaaaaaacaagggaaaagaaagaagatccactccattttactataggtcgcttgacgccgaagcctccatcgattacatttacgcatgattacacatctcgtgcgcccaaatcatgcctaatccggtaccccgcagcggtaagcatttttgacggctgttccctcgcatgaatcggctttgcacggatgcagagatcggcagcacgttgccaggtcgactcgagcgatgagctgcagcgtcaactgtggagatgctcgcaagctggccactagtcgcttccgatgattaagctgatggttccttccgacaacaacatggattaatttaatcaggtcttcgctgttaagagtaagaatccctcctcccaccaatccaggcgaagaaagtccaagcacctgaggatgagatgcatcagacaaattgttttctcacagagagagaggtacatccgccccgtcggtgtggagatcagacggctccgtggggatctaccgaccacaccccgtccagtccggtctccatcgctttatcaggtttgccgcgagttgtacttccttgcacgccaccacaaaacaacacacacagcgagcgacagaagcgagatcacccgttgcttgctcccctcgcgcggctcgacgtcgacgatgtgaagcgcgcacagcccacgacggaacaccggctacggatccaacacccaaccccaattggtcccggtgggtcggacggacggagcagttgcgtcggaattttcggccaagaagacgtgacgagccactagaatctttcctccggtggaaacctgcatcgtcccagaaaccggtgcctgtggcgggggggcagccattcaagggaggggccc

SEQ ID NO: 30038 - DNA, 16780 bp, Oryza sativa
  unsure (1)..(16780): unsure at all n locations
gcgtgttttaactgagcgtcgnattggnacgngnnnnnnnnnnnnnnnnnnnnnnnnnnnnnnnnnnnnnnnnnnnnnnnnnnnnnnnnnnnnnnnnnnccgtagtacgcgcgcaccgggggggaaaaaaggccgtgagcccacagcgggtgaggcggacacgttgcccacgcccaccacaccacaccacacgagccaaagccaaacccccacctcgccttacgctcagccgccgtgccgtgcggtgggccggtggtgtgccgtgcgtgtggtgtgcgtgcgtggctaactcctcctcaccctcgctcgattccaccaaaaaaattcccctctccagctctctcgcgactggctcaggctcacacactcgccacgccccccccccccaaatttattaaagtcctattctgttactcttcggatcccgatctgcgagctggggccgcctttattgctgttgccggtgtttaggatggaagggcacgagggtggggaggaggaggggttgggggaccagttcgagcggctgcccgacgaggtgctcctcgacgtgttcggccgcatcggcgacgtgaaggcgctggggcaatgcgcgctcgtctcgcggcggttccacgcgctcgtccccctcgtcgactcggtgttcgtccgcgtcgactgcgtcatatccgacgacccgcccccctcgtcggcgggctccgcgcaggccgctgcggcggcggaggggggacctcccgccgcgcgggggcgcggcgcgctcgcgcatctcgcgcgcctggtgctcggcggcatcgtcaggcccatccaggcactcgggcagatcctctccccggccgcggcgaccgtctcccgtcgctccgctgccccgcccgccgcaccggctcctgccgccgcggacgtctcccaccattcgccgtctgaggtcctccgctccttcaaggagctgcgccgcctccacatcgagctgcccaccggcgagctcggcatcgaggacggcgtgctcctcaagtggaaggctgactttggttccaccctcggcagctgtgtcatactcggcgcgtcatctgtaacgtcgaagccacccccaccaccggccgcgccgcccccaactgctgcagacagctcggctgcctctcccgattccagcagagagcccgatgaattagggaacatcccagagtcactctatacgaatggagggcttaagctccgtgttgtctggacgatcagctcactcatcgctgcttcggcacggcattacttgctgcagccaatcatcgcagatcactcaacactcgagagcttggacctgacggatgctgatgggcagggcgtcctcactatggacaagaggcagctgcaggagctgcgtgtgcggcctgtgtcagcttctgggaactcgcaccgcacactcatgccagcacttagtatgcggctatggtacgctccgcatattgagcttcctgggggccaactgcttaagggtgctacactggtagcaatcagaccaagcgaggatgttctaagggaagggggaggaattgaggttgctggcccgacaggagctagctggattttagatgcctttgaggagccatatcgaacagcggcacaggtgcttctcaagcggcggacatatagtcttgaaatgaactcattctgaccatcagagaggcagcttcagagagctctacactttggggaggtaaattaccacttaaaccacttgatgtgattatggaatagaattgctaccaacatataggtgatgcgcaatattccagaaactactctgttttatctaatgcatgactagttggctactttatttatctaaagaaaattttgaagtgagagtcagttgtcattatattaagtttatgtctctatttatgggtttctggattagtttcagagataaaggatcataattctgttttacaagctatacaagtgattctgttaaattcctttgactgatcaaacaacatgttgtattaattttttgtgctcattctgaccaattactttgaatcatactctaattcttgaaaacctatattctagttggcactaaattttgcaaaaagatatccagtattcagtttttgatgtgaaaagtattgtgaggtcctattatacatgatcaatgatgactataaccaattagttttaatcaatgaagtcttatagatataaccatgagtagtggcttgttgatccatgggtatagcctaaccagtcctcgatgatgtaactgcaacatgcatgaattcttgatcaacggaaacaacattggggatttaatattctacaaatgaaatgtgccaacaaaatagctaattatgaattctcctattctgttttcaggcattgaggccaactgaccggttccctatatttaacttgtcaagtttaattgttttctggtgttttgactctatttggtttatgaacagagtagtttcagtagtttgtgatataagagatgaggcaatttggattgaccaggatggaaaacattttcgtaaagtagtctagtacatacttatgttagaacagcacaatagggcagagctttacttctgttaaggcaggcttgcctggattatgtactgagctggtcctaattaatttgcagtaaacaccatgtgcttgacgttgccctgtaaccctgttggcaacttggcatggttgatgccaaaaagaaaaaaaagtaacaagatataggagggttatcatatggaggattgttcatgtggtctccagatattctgatatgccattttactttcattttccttgatatcatgagcaggacacttttaccaagtattcgaagatttttgaattgttaccttgtaggactaaactggggattacttgtgagtgctaggaggttgtgttctcattggggtagcgagatagtgcttggtgacttgaagtcagaagccaactatgttgtgggtcgatatcctaaaatcagaaccctaatctgttgtgcctcgatattctgaagtccttcattatgactattctaaaatccttcattttgaacatggctagcaatgccttcatcttgttagtatgccagtcagactaaggttcttcatcattattgacatcaagcaaggatctgttcctagatattgccggtgcacgtttgcaattgataatttcgtttcctactgcatttcatgcttatgcgtgtcagggtgtcctttaccagattatagaacgactggggtgtttcttggtgaagacgatacattattttttacaggccttgttatattctgctagtgcaaaattttgtgattgttagtttgctccattggaatgttttactgaactcattttcaccattacttccaggatatgatgggatgctattgagacgtatctaggagtcatggtggacatcaggcatctgtaagtatatacacctgtttatgttgggctgtttggcatagagttggaatggaatgtgttatctgcagcaaaagcaccctgaagaaatgccatgaaatacatctacacatgaggttggagtgcccggtcatgcagacaacgcatctgttgattgtctcttctacgaggaggccccatcgattattagatttaatagtgtcattttttgcttttagttgcccgcactgtgctgttagctctgtatcaaattatggacaaaacatgctctgctttccagaaaagtttgagccgtgctgcctcatgtgaccttgtaaccttttgtgtatcagactacaaagttacttcccgactgactttttcttttattggataaaagggagtgcgtgactacagtatagaaacctacgtgccttgtgcgctgaactcctgatttcttgaatcgagcaagtgccgtatcaagatttacggatttgttgatgaaatgatgagtggggtagctccgggtgacccagaatgtcactggtaatggtatgagtatgctactacgcagttcttctagttctagtacgtcaatagcacatttatagcgttcactcttgcaacagatccagcactcgtgaaacgggtcgtgcgaaaactaatctgacatcgttgttgccgttctgtgccatctagtcggagataaccaaataaatcctgtgccatcgggacgggttttctgtctgtgcaagacaggcctaaaggccgaaacgcaggacggatctagttcagcaactcttgaccgaattgaagctggcccagatgtacagtgctgcagacttgtcagccgacacgccggccggacccaattgaatgagcctggcagagcggccggctgcatgctcaactacaggcaagcactgagcagtatacccgtactggcattggatcgaggcatcgagcaccagtgcaccacctgaggagtgatgacctgggcacttgacctggcgatagataatttgcccaacctggctatggcctgcgggccatgcgttttacttctactccgaacgaggcgtagctaggtagccgcagtataactcagtaaaattcgattatctttggtaaaaacctttttgggcgccgaacgatggttaattagcaaaaacctcccaaagtaacgttgaagtgatcacgccaggtatgacctgcgcatgacggcacgtacgaacaactgttcacacgcgctgcctctcgtttcgttccggtgtcgctcgtgctctgccggcgggacacaggcacaaccacgcgataactacatttcgatcggggactgggcattccattggagtactttacatttttttttacattaaagagagagctttattaatgacggaataaagggttgcattcttggtttaataagtttaggatttgtgctggggcacatagcctccactcagcattagacctagtactcattgctattctagcaagatcgtgcgccaccctattcacttctctcttttatcttgtgcacttgcacctgctggagacactgcatggcacccgtaattttattggagtactttacatactattctcgagacctttcgggccactgaaagaggcttgatgtccatattcgtagtattatgatgtgtcaatttcacctaaattccttataagatagaggaagtagctagctcgatctcctgatctggctctctgcgcatgcaactcaatgccactccactcgaccgcttttcatcgtctagttaggaggagaacatttatttattactccatccaaatgtctaaaatctatttattcttttgtcaccaaaactaaaatataattaactcatttaccatgtgataaaaaccaataagtactaaaataacttcttggattttgatttaatttagctcataaatattacaaatagatcttaaacttttgaaagaaaaaaccaaaaagtaatatttagatggagagagtataattcatgctcgatgcctaggcagataaccactacccgcttccggtcctgtgcatcggtgcatggtccagactctagtggcactccatatgtataaaaaaatgggttttcagagttgatcatgtctcataccagtcgcggtggtacaatgcatgctcatatatggaaataaccaatgaatgaaacttatttttttcagccgacaaagcgtacactcggttatatgtgccacccaaaaagtcattattttttaaaaaagtaataacataaattaatatataatatattactaaaaaatataatatattactccgcaaaataataaatacaactataaaaagtgcatactattggcaattgatatttgttatttttattatctatttctataagttgaatttgaatttacatatttgtaaattgatatgtcatatatatgttgatttatcttactagtaaaatgtttcagatctttgtcgtgaactttgcatatattaaatgggtgtacgtacggaaaaacaaacacttctattgaattactactaccatcacctggcgggtaggtactctgtgcattcgtacagttattttcttccactttttatctaagttatattgaaagttgtatatgtatctactttcttgaagtgctaggcacaattttattttatcaataattataaatttaatgattactctccaacgagaaatataagacatattagtgtgtaaaatagtcccaactttaaactttggttgttaatttcttttgtaataatcaatgactattaagttaacatcatattaaggaactttcaaatttaaaactaccaacttttcaaatacatgcatgccttatatttttcagtgacagagtacaaaattacacgtagacttcaaatttgcaaattttggtgttatgatatcctccacaaaataaaaccactacctctcaagcctgtccaacgggttctaccataaaaactaactatagataataacttcccccaaacagatcactataccgtaaggttatgagttcaaatcttcctaggagcgaattttagattgggttatttgagggctaagttccctatttgatagactaagttactaaattaaaatggctgcatatatccggttggatatagaggccgggtaaaaaaaatacctttctctggaaaaaaagttcactatactgcgccctccattataatttttaattaatatttataaaatttgcaactaataagtctctggttgtatttgtgttggactcgttgtttccagctttttgaccggactattgtcctgatttatttactccatgtttctaaacatatgacttctaaaaaaacattcttccaccttaatgcttattatgccacttgttctatgctatttataaagtttatttctcaaaatatttaagttaatctaacaaacaagtgtaatatctgcagtaataatctggtgaataatcttttgaaaaactaccttaatatgcttcgtgatttagttatatttcaaaactcgagaattaattagtactaccaattattgttctccttttggggtctgagttttagagtggagtagtacttttcccaaacatttaattatcccaaaattttgaattagcaaacatcatgtttgtgacggttatagataccgcatatctaatagtagttgagtaaacacggcgacgcccaccatatactaagtcctatatgaaatcatacctcgtatatagaaggagttccggataaggaaggataagtagagttctatatggaaatgataaggacaactcagattgtatccatattggtctgcctagttctacttggacaaagggacatctatgggtataaatacaagaccccatagggggagagagtacacaacaatagatagacacacaatacacaagccaacacacgtcactagacattaacatcagggataaacctaaacagaccccttatggtgcctgcggaggccaacaagagggatctagcgccatctttgattacgatgggctaatactcgaggaggaagattaccctgtcgtcgactacatgttggttatccataccaccaagttgacggtggatagataggttatctcacatattgtacttgtgtgattcagatgaataaagagcaacaccggcttcggccaacaggagtagggctattacctatcacatacggggcccgaacctatataaaatccttatctctgtctcttttacctcaatctcgcatataccttggtaccgacgattctcataccatacaaataccgtagtcgagacctaaaacgtcgacaatgttttacccggtttagagccattatatttttcatgattaatagtaaaaaatgggaactattagttactacctccatcccaaaatacttgccgccttgagtttttgtttgtaacctttgatcattcgtcttattaaaaaaagttatcgaataattatttattttgtttgtgacttgctgggatagaggcagggtttacaattccgagatgacattccgttccgggctctggtagtatgacgtttttcgcgaaatccggtgaaaagccggtagatttcgaacaaatttcataaaccaaaatttgaatacaaattccctgagtttatcgatatgctcacgaaaaccggttggcttgggcgaaattccgagcgaaatcaggtgcaagaccacatcctctctctattatacatcattatctgggctatgtactaagtaggcctaatacatggaattcggtccaagaaagtgtattcatttttttaaaaatattgttattattctcttttctacagtaaagttcaagaatacacggaatacactaatttttttggaaaatttatacccatataggttctatgaatatcatatcatttataggaattgatttgatttttttccttttttatcaatttaaattttaatttggatgaaacccatcgaaattccaaatggcttctacttttgagccacgtcaaaacctcggttttccgcaaattcgtcggttttcatcggaattgtgaaccctggacggaggtagtagtaggtcacacttatacctaagcttcttttaatctcattttttttaacggttttgctataattttttgacatatttttcagctgattgctataattggagacacatttgataaaaaaaaatagcatcgcataattggcatttgatttccacatggttatgatcttttttttttatcaagaatggttataattttattgctacaaagtataaatataataaaaaattaaaaaatgaattttagataccgttctaagttatagataccgcatcttctattatggtactctaggacgaaggaagtaattaacgtgcatttatggcaatacaatgtatgtgacccaactaagatcatgtttggagaactagtcacgagttattttgagagctattttttagcacaagaaaatagccatccaaaaaaaatagccctaagttgttcggatcaaagggttattttgagagctatttggcttttaatataccttcccatgaaaagagatagagataaaaggcatttttttagtgggccccacccaaaatagtttaaattagcactccttgggtgggatatttttttagatgggttattttcaaatagttctcaaatagctcaccttttagatttttttttggctatttggctatttgagagagggataaaaaataggacctaaatcgataatctgactttttttcccaattaatgtggcacacattgctcattaagtatagagatagatagagagatacagttatacgggtagatcgacgctggtgtagctattgctaacattattgaccagagcattagctagcgagcccaataaatttggtagctaataccgcctattccgccacgtaccgacgcccgttcccgcagatggcaccaccctcgcactgccacaccatcaatggcggtgccccacggaatggtgccatcccggaggtggagacgacgacgtcgacgccggcggcgtcagataccgcgctactgctcgacgctgacgagttccggcggctcggccaccaggtcgtcgacttcatcgccgactactacgccggcctgggcgactaccccgtccacccaagcgtcactcccggctttctgcgccgccagctccccgccgacgcgccgtcccgcccggagcccgaggcgtttgcggcggcgctgcgggatgtccgcgacctcatcctgcctggcgtgacgcactggcagagccctcgccacttcgcgcacttcccggcgtcgagcagcaccgtcggcgccctcggcgaggcgctcgcggccggcatcaacgtcgtgcctttcacgtgggcggcctcgccggccgccaccgagctcgagatggtggtcgtggactggctcggcagggcgctgcacctgccggagagccttctgttcgccggcggaggcggcggcacgatcctgggcacgtcgtgcgagaccgtcctctgcgcgctcgtcgccgcgagggaccggaagctggcggagatcggcgcgaggaggatcggcgacctcgtcgtctactgctccgatcagacccacttcgcgttccgcaaggccgcgcgcatcgccgggataccgcgggagcactgccgcaagataccgacgtgccgcgacgacgtgttcgcgctctcgccgaccgcgctgcatgccgccatgcaggccgacgtcgacgccgggctggtccccttgttcctgtgcgccacggtgggcaccacccagacgaccgccgtggaccccgtccgcgagctctgcgccgtcgcggcgcgccacggcggcgtgtgggtgcacgtggacacggcgtacgccgggtcggcgctggtgtgcccggagttccgcgacgtgatcgccggcgccgaggccgtcgactcgctcagcatgaacgcccacaagtggctcctcgccaacaacgactgctgctcggtgtgggtgacggcgccgtcggcgctggtgccggcgctgggcacggagcaggagtacatcctcagggacgcggcggcggagggccacgacgtcgtcgactacaaggactggggcaccacgctgacgcggcggttccgcgcgctcaaggtgtggctcgtgctccgctgctacggcgtggagggcctccgctcccacgtccgctcccacgtcgccatggccgcggcgttcgaggccatggtgaggggcgacgcgaggttcgaggtggtggcgccgaggcggttcgcgctggtgtgcttccgcctccggtcgccgccggagagactcggcgtcggcgtcggcgtcggaggcgagaaggcggcaaacgagctcaacaggaggctcctggaggaggtgaacgcggcgagctcggggccgtacatgagctccgccatggtgggtggcgtgtacatgctcaggtgcgccatcgggagcacgctcaccgaggagcgccatgtccgcgaagcgtggaaggttgtccaggagcgggccacgtcaatccttcgtaaacgtggctaaaacatctcggtaggtttgatccaaattaagcatggttttctccaagcagattgataaactatgcttttcggattgacacggcaaaataatcctgctgcgtattatattcttcacttaatctcttgactaaattagtagagagattaattgtgttgcattatttaaaaaaagaattatagaataatttataaataagtaaaatataccgattgtatcacaattttacaaggtgacttttttaaatatttaacgccgttgatttttttaatatgtttgatcgtttgtcttattcaaaaaaatttaagtaattattaattattttcatatcatttgattcattactaaatatatttttatgtatatatatagttttacttatttaaaaaaataatcaagacgaacagtaaaacatgtttaaaaaagtcaacggcgttaaatattttgggacggaaggggtatatttttgtcacttgtctagcaaaatactcaaacaagtaaatgatcttttccgaatatgcgaataacgtaaaacatgttccatgtacatgcgtcacgttgatcacttcgctaacacggtcatacacgcataagctacaaataaaccaacggtacgtgcaataattactactagcactattgatagtaaatctgatataagatgaaccttctttttagtgctaaccactatgcagatgtgttgattgaaaaacacaccagcagcaacacactgagaatataggagttgatttgcattttcattgctggtctcgacacataaatttgtcatgcccctgttgctcacgagcgtataatgttagggcaatctaccagcttagcaatgagtacaggccatgcgctatatgttttgtaacattcgtgttgaacaacctgtaagaataaactactaaattacatcctttttaagttgtaataccatcggtatattttatttttttagtaaatgaattaaaatcgcaactgttcccatctttccgtataagctcactaaaaatatactgtaatatttttacggatgaaattggctcaaataagaaaagtatgtgtaatttaactggttggttagatttcttgtggtggaatatgttcactggatttaagtattagaattaacatggatgctcatattcatcactaattattcttttagtaggatgattctatcaagcatcaagtcagcttcacatatttgttaaaaaaattatcaacaaatctaaaagatgaactttctccattctaacttgatcatcccctctcggaaaaaaaaaagagcatcccctaatataggcaaaggccatcaacacctatgacaccaaaacattcttcactatgaaattaattaatcctcatatatcaagttgttctatcgatgtatatccatgttcgctttgtcagtaaatagctactgttgctgcagagaagctgcagccgcagccagatctaatgaacatgccgatatggttgacgtgcatagaattgtttacttttacgatcctacacccccttcatggtcgctttatagttttcttttttatttattaactagccttgtttagatctcaccccaaaattttttaccctgtcacatcgaatgtttgaacacctgcataaagtattaaatataggctaaaaaataactaattacatagattgcgactaatttacgaaacaaatcttttaagcctaattgctccatgatttgataatgtgatgctatagtaaacagacggattaattagacttaataaatttgtttcatggtttactgacggagtctgtaattagttttttattagtgtccgaacaccctatacgatatcctatataatagccgatgtgacacgtttaaactttagacccttgatctaaccacaccctcatgacttgctagtcgtactactggctactgccgacttgccgagtactcccactgtcttaaaaaaaacaaaccctaggtttccgtatccaacgtttgactgtttgtcttatatgaattttttttataattattattttcattgttgttagatgataaaacatgattaatactttatgcgtgacttgtctttttaatttttttcatatttttttaaataagatggacggctaaacgttggatacggaaacccatggtttgtcttgttttgagatggacggagtagacttgacagctcctagttctcaaaaaataaaaaagacttgacagctcctagtcaaaacgtcaaaacgacgaagaaaagctgagggtttactttaccgacaaaaactgattgattttcacgatcttttggtattacggctgtgtttagtttagactgaagtttggaagtttgattgaaattgaaacgatgtgactgaaaagttatgtgtgtataaaatgtttgttttgatggaaagttagaagtttaaaaaaaaaactttagaactaaacagggtctactatatggctcgaaatcaattttcgggaaggatttcgaaaacaggaattttttttcaaaatttgtcaaagacggtgaaaccgccgggatcaggcggtcaatcagaaacgtagacctaaattgctagccccaatgattatgttcaaaggccttatccggtttcagtaaagtcaaaattcaaatgatatcctcgttcattacaatcgtccgaactaggcgcaagggaggatggcggtctgactgactccatgctgtactgtacttgtatggtacagcggggcctgtcattattcggtcaggtagccgtttcagaagcgagcgcaccgatccgtgattagagcgtggatcggcgatccggctaaggcctgtttagatgggaaaacttttaagtccctatcacatcggatgtttgaaaattaattataaatattaaacgtagactattaataaaacccatccataatcttggactaatttgcgagacgaatctaatgagcctaattaatctatgattagcctatgtgatgctacagtaaacattctctaattatagattaattaggcttaaaaaatttgtctcgtgaattagcttttatttatgtaattagttttgtaagtagtttatatttaatactctaaattagtgtctaaagacagggactaaagttaagtccctggatctaaacaccacctaagtgaagccgtctcgccgccgcccgagcgcgctgccgtgcggggcgcagtgaaggcggcggtggggcatcatgcagacatgcgctgatcagcgattctggaagaatttgtcggtggcggcatcaggaacagggcgacaggcacgtcgtgctcaagatcgagtgcggaggtggacatcgccaagctctcctcaccatgcgcttggtgccggtaggggttcagactccatggcaaccttcacctcgtcgcgtggttccaccaagactcgtcgacggcaagcctcgtctccccaaacgcttctctttgtggttcttcatcttgcttcccagatcgctaaaggtgttctggggtttcgaggtgaagagtacactcgtcgccacaacccggcagcctgattcgtagattctttcgttcctatgaccctctagctgttcgttgtggatggtggtggagggatctattttgggaccgataaggtaatatggcaggctacaattgaaggaggcggatgccaactttcttctcatcattttagtggctacttctcgcgatgatgttttcatcatcataaggcagtggcgttcagatctaccatagaccatcgtcagcttgacttcgattaaaggtatcgcttatctatatctcatcctttagatctacccaatggattttgggcgtgtgcctttttggcttctcacgacattatcttcgtagggtatttagctatggcctatggattttgggtgtgtgcctttttggcttctcgcgacattatcttcgaaggatatctatagaaggatgcaggtaattatgttcgtggccttttgtgattatgttaagtttggggtatggaggttctgtctcggaataagggggcaacaatactagtgggcttcattcaggcggtacttgttactaattctttaactccggggttaaatccctaagtctgtccttagttggttgtacttggcaatggatgttcttccttcttgaagacattgtctagagttcacagaatttccctaggtgaaaacctatggtctgatcttagttgattggaacattacaatgatgacgcgtgcgcacgtcatttcctcattggaggcgttgttttaaagggagtccgtttgatagtctaagtgttgttttggtggagataagagatgaagattactcgtagatgtaagtcgctgcggcacggttgtagcagttgtgtcgcttttttttccttttcttttataatattgataggctgtgtacatcctaactatgcagaggccgagagtggtcttagagaaattgtatcatcttgatgtaattgtttaagatcaataaaactctctttatcttaaaaaaaaaagggtacttgtatggttcttgtgcggtcctgccatgtttttaacgacgtgcgataatagtctaatctctcacatgcacagaaaaattctgtcatttgacaccgtgtttagttccaaactttttttcaaacttccaacttttccatcacatcaaaactttcctacacacataaactttcaacttttccgtcacatcgttccaatttcaatcaaacttccaattctggtgtgaactaaacacaacctaaatgcgcccttgtttcatcccaattaatgcccttaaaatatactcaaactgatatctcaccctgaagtatctttggttgatacttgctctgcctctgttataaaaacaattctaacatttataagacaaatacgaaagggcatgtagcctagtggttatagtgacctgagtagtaccccaaggtcctgagttcaaatctcctatggagtaaattttagattgggttgtttgcggggctaagttccctatttcaatggccgtatatatccggttagatgtagaggccgggtaaaaatacccttatctaaaaaaaagtataagacaaattgggaaggaagtacgtcctcgttaaacaagcagtgtttggaagagagagggtggttgagaagtagtaaggagaagagatttaaattggcagtagttggagtgagaagtactctccagtttcaaaaatcttagggcttattcggaatggaggattgaaaaaacacaggaataggaaaatcataggaatatgataggaatgcacgtgtaaaacagagaattgaaaaacataggaatactatataaacatgcgttcggatagagcgtaggaaaaacataggaatttttaaagaacctacccactaactaaaatcatcatgtgtcagaggagtgaagcttgtgaagattagtttgttgattgcctcgttcccatgcacaggaaaaataaaaagaggttggagtggattgtttgttttcctgtggaatggatggccaaggaaattttccttcgaatttcctctgattttcctacaggggattcctttgatccgaatgctgctacagtacccgaatccatagnnnnnnnnnnnnnnnnnnnnnnnnnnnnnnnnnnnnnnnnnnnnnnnnnnnnnnnnnnnngtagtagaagttcatcaaancgcggggggnaggagaggctgagggatgcacagggtgaagggacgtgtcgatgacgcggtcgggaagcaatatcccacaccgatataggggcaccagtcagagttg

SEQ ID NO: 30039 - DNA, 5362 bp, Oryza sativa
  unsure (1)..(5362): unsure at all n locations
ngtttgatgcaataaagaggggtacgccggggggtaatggcctagaggaccccaagtccggaggtcaattccggaggaagatttaaatgtggtgttgcgggacagattcccatttcaaggcggataaaggggtaagatgaagagggcggttaaaaataccttttttaaaaagagtataacccatttggcagaaagtcggttctcttaaacaacaaggttttgtaaaaaaagggtggtttaaaagttagtagaaaacaaaanatttaatttgcgagagagttgggttaaaaagtacttcccaagtttcaaaaattctgagggcttattgggaaggagggtttgtaaaacctcaggaataggaaaatcataggaatatgataggaatgcacgtgtaaaacagagaatcgaaaaacataggaatactatataaacatgcgttcggatagagcgtaggaaaaacataggaatttttaaagaacctacccactaactaaaatcatcatgtgtcagaggagtgaagcttgtgaagattagtttgttgattgcctcgttcccatgcacaggaaaaataaaaagaggttggagtggattgtttgttttcctgtggaatggatggccaaggaaattttccttcgaatttcctctgattttcctacaggggattcctttgatccgaatgctgctacagtacccgaatccataggaatgcagatcctatgtttttcctgagtttaccctccgatccgaataagcccttagcgttttagatatgatctcatttacaaggattgatttatttgggtgcctattctctattatgccatattaaatacggtagtttgcacattatacttaattctaatgtagtctagtggattgagtccaccattgaattttgtgcatgttgggttcgaagcattgccatccttggaatgtatacatacaagggtaagtaattctgtggtgaccaagtaaatctcaaaatgtcaacagttgtgaaaccggagggagcagtactttaggatagtatctattaacttattaacttattaaaggaatagaaaaatgggccttcacgttcactctcacggcctagaaattctcacattaatcagagaaaaagaaaaataaagtctatatagaaatacaatttaaaaatagtttaaattcggaattagaaaataaggaatatcggaagaagagactagagtccatatacgaatacaatttggagctaactaaaatccggaatcaaaaaataagaaaaattaaaagatgaggttagagagaccatatagagcttagaaataattaaggaatattgaaaaaaaatagtctagagtccatatatgaatacaatttagaaataactgaaattcgaaaataaaaaaagaatattgaaagataagtttagagtccatatagaaaaacatataaaatttagatctaattgaatttcgaaattaaaaataagaaaaattaaaagtataatttagagtccatatagaaatacagcttagaaaaaactaaaactagaaatttaaaaataaaaaaatattagaaaaagaatctagagtccatatgaaatacaacttagatgaagctaaagttcaaaattgaaaaaaaaaagaaatactagaaaaagagtctaaagtccatatatgaacacaactagctgggtggcccgcgcaattgcgtggctagcacctaaacaaaatcatatatttttttatgatttcacttaaaatttattaaatagctatctcgttgtcttaagactttgaaagaccaaaccttatcatccccgtgtttctattatatagtttttaacagtcacaccagttgctaccctttacttctgtcatctccttctttatttgcttgctcaatctaccactatttctattcattctcctggtaacctttaaaaattggatcttatagtttttagaatttattgtcacgttgggtttcatttttataatttctagatgcgcagtcaaatgttgccattatactcctctacggcccatccactgtctcttctctttattgtcattgggattttaaaaatcgaacataattatcctttgggttcatttttactttctataagtcccgccaaaccgtcagcagctttgccattatactcctctacggctcgtccgttgcctcccttctttattgtcattgagattttaaaatcgaacatgattatcattgttttttcttttactttttagaagttccgaacatttaaaaattggaccttgtagtttttagagtttactgtcttgttgagtttcattttttatatttttttagaagtcccatcaaacgatgccactacgctcctctacggcccgtccgtcgcctactctttcttgtcattgggattctaataatcgaacataactattgttggaattcattttatattttctagacgtcccaccaaacgttggtggctctgcaactatactcctctacaccccgcccgctgcttctcctttttattgtcattgagattttaaaaattaaatatgattatcaatggggtttatattttttactttctagaagtcccggaaacggccttgcctgttgcttcacggcttgcctgtcgtccctccttttaatcgtcattaggattctatttggtgttttattaacagtttttatatgtcgtatcaaccgccaccaccctacttttagatggtttcgtcatgtgttttagatggtcttttctttcaatagtctttttaaccaattttagttactccatccgtcacataaattgtgcttgtactgtttgaccactcgtcttattcaaaaaaaattgtgcaaatataaaaaaataaaaagttgtgtactgtttgaccactcgtcttattcaaaaaaaattgtgcaaatataaaaaaataaaaagttgtgctgaaagtactttggataataaagtaattcaaaaaaaataatgattccaaattttttttgaataagacgagtggtcaaacagtgtaaacaaaaactcaaaatcccttatgttatgggacagagtgagtatttatgaattgtattcctaactgaaatcttgtttttgtttttctaatttcagaatttttttccaaattttaattaatatcgtattctgttcttctaattttttttttcaaatttttattgtcaatttcagttgtttcaaaattgtattcctacttgaactctcttttaatttttctaattttggataatattttatttttttattctgaattttaattaatcttatattgggttcttatatggattcttctttcaatattgcctatttttaattccgaatttcagctaattttaaattgtattcatacttaaactattttttattttttgctaattttggattttatttttatttttattcttaattttaattaatctcgtattgggttcctatgtggactgttctttcaatattccttatttttaattccgaatttcagttatttttaaattgtatacctacttggactctccttttcttttctaattttagattttattttatttttattccaaattttgattaatctcatattcggttcttatatggactcttctttcactatttcttatttttaattccgaatttcagctatttttaaatttttatttctacttggactctccttttctttttctccgattaatgtgggaatttctagcccccacagcgaacgtggtgcctcctttcaaagctgttttaaaaatataacagatagatttggaaataactaaaatttaaaattaaaaaataagaaatattgaaagaggagtctagagtttatatagaaatacaatttagaaataaatgaaattagagattttaaactaaggaatattgaaataacggtttagagtccatattggaataaaatttgtaaataacatgacttcggaattgaaaaataagaaatattagaatatgagtttatagtttatataggaatacaatttataattaactaaaattagaatattaaataattaataaatatcatgtatataaaatacaatatgaatattacacatctgttaaggtgtgttcggatgtctcctttcccaacccctcttcctcgttttccacgcgcacgcttttcaaactgctaaaaggtgtgtgttttgcaaaaagtttctatacgaaagttgtttaaaaaaatcaaattaattcattttaaaaaaatagctaatacttaattaatcacgtgctaatggactgttccgttttccgtgtgttactattccggttgggatctggaggtagcgaacacagccttagtttggtcaagttggtacaaaattaaaagttatgctataattttaatatattttaataataaaatataaaaatatatatgatattgtataaaagaatgtaacgatactagccgcgcaatctgcgcgggccactataccaatttttaataaagtttaggaaataaaagtctatttgcactccgaagatgcactagcaattaattaaggaaacacaataagcctcacgcctgcggagctacatggcatgaactgtgtacatattaaatcatgtaggtgattggtagcagtataagatcagtctgagagactcgagcatttatggatgatgtacgcgttaattaacattagtacgttcatggcacacggcacagtggtacatcattcaagtcatctctatatcacgtcattaataagaaatcttgaaccacgcaagctttaccaactgccaagcctgtactcctctccgttttttaaaggaaatcgtttagagcaagtactataatatctcatatgttgcccctaaaaatgccacattagattgggtgatgaggtagaggagagaagtggagagagagaagatgagccacccctaaatcaagagataacctccacacaaatttcaagaagtgtgtgagagtattagagatattggtatttgtgtgttagaggtgatacattgtatgtgttgcctcttaattcatgagtgaataaaatagataaatttagaggtgatagtcacatctaccatagcacttgcccttagaacagcgacacggtcttcaaaatataactttgacttcttgattctataaaaaaatatttattaaaaagatataacttttgacttcttgcttctataaaaaaacatttattaaaaagtaatatatgtatatttttatgaaagtatttttcaagacaaatctattnnnnnnnnnnnnnnnnnnnnnnnnnnnnnnnnnnnnnnnnnnnnnnnnnnnnnnnnnnnnnnnnnnnnnnnnnnnnatgcaaacaatcaagnggacag

SEQ ID NO: 30040 - DNA, 809 bp, Oryza sativa
  unsure (1)..(809): unsure at all n locations
atgcacannatagatactnctnnnnnnnnnnnnnnnnnnnnnnnnnnnnnnnnnnnnnnnnnnnnnnnnnnnnnnnnnnnnnnnnnntatgggtataaatacaagaccccatatggggagagaggacacaacaatagatagacacacaatacacaagccaacacacgtcactagacattaacatcagggataaacctaaacagaccccttatggtgcctgcggaggccaacaagagggatctagcgccatctttgattacgatgggctaatactcgaggaggaagattaccctgtcgtcgactacatgttggttatccataccaccaagttgacggaggatagataggttatctcacatattgtacttgtgtgattcagatgaataaagagcaacaccggcttcggccaacaagagtagggctattacctatcacatacggggcccgaacctatataaaatccttatctctgtctcttttacctcaatctcgcatataccttggtaccgacgattctcataccatacaaataccgtagtcgagacctaaaacgtcgacaatgttttacccggtttagagccattatatttttcatgattaatagtaaaaaatgggaactattagttactacctccatcccaaaatacttgccggcttgagtttttgtttgtaacctttgatcattcatcttattaaaaaaagttatcgaataattatttattttgtttgagacttgctgggatagaagcaagagttacaattccgagatgacattccggtccgggctctagtagtatgacgtntttcgn

SEQ ID NO: 30041 - DNA, 711 bp, Oryza sativa
tgcaagtagctcatcaaaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtcttgcaaatgtagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatgggtatggtttcagcggcctttttatatctttatgttttaatttctatttttaagctatactaacgaaacatttcattaaagggtgtggcaaaccgtggatgctctattcgggtggggcgagacaccgaggcgaagggaaaaggtatatgttcttccatgtcccctgaaattgttg

SEQ ID NO: 30042 - DNA, 481 bp, Oryza sativa
ggcttccaactgggacccgactgcttcgatgcggtgacggcgtcttcggctttggcgtactcgttggctttttcaaacatgagcttgactgttctgggaggtttgcgcccgaatttgccgaccaattcttcgtggcgaatccctttggtgaatgcggcgatgatgacgtcgtcggtgatgtcggagatcttgttacgttgttcagaaaatcgccggatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattcggggt

SEQ ID NO: 30043 - DNA, 524 bp, Oryza sativa
  unsure (1)..(524): unsure at all n locations
gaagcctgctgctaacagcttggtcaattcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggggatgagcgcgctttcctatttacaatctaactcggcgcctattacagcagttttggtaggatcggaaggatctaaaggaatctttttagtctcggcttcggtttccccactttttgaaatcttggcagctggcacttctccttcgctcaccgtggttgcagccagtcggatttcctctcgggcagacgccatctcgcgggtttgggccatatcacaactctccttgtcacatgtgacagcttgcttgatgtcgctccgtagggttaggactcctcggggaccaggcatcttcatcatcatgtatgtgtagtgcgggacggncatgaact

SEQ ID NO: 30044 - DNA, 19673 bp, Oryza sativa
ggtcgagttacgactactgcctggtcctcgaccagcgatgtagcgtttctcccaccacttccactttaagtggtcgagtgacgactactgcctggtcctcgaccagcgatgtagcgtttctcccaccacttccactttaagtggttgagtgacgactactgcctggtcctcgaccagcgatgtagcgtttctcccactacttccactttaagtggtcgagttacgactactgcctggtcctcgaccagcgatgtagcgtttctcccactatttccactttaagtggtcgagttacgactactgcctggtcctcgaccagcgatgtagcgtttctcccactatttccactttaagtggtcgagttacgactactgcctggttctcgaccagcgatgtagcgtttctcccactattttcactttaagtggtcgagttacgactactgtctggttctcgaccagcgatgtagcgtctctcccactacttccactttaattggtcgagttacgactactgcctggtcctcgaccagcgatgtagcgtttctcccactatttccactttaagtggtcgagatacgactactgcctggttctcgaccagcgatgtagcgtttctcccactatttccactttaagtggtcgagttatgactactgcctggttctcgaccagcggtgtacgactctcctactacctctatttcaacaaagttgatagctggtatacaatatcgccaagtgttttacccagagatcccttaccacgacgacacctagcgttgaaacctatcctactgtcccattacgccgtcttgacaaggcctccgaggaacctaagggacttcgggctggggacgcccagagccgataaggccttgtcggatcctgtagagacaaaagaccatgtaagatctggtcgtgtaagagttctcgccgtgcgtattaaccaagccgtgtatcggaaactgagctttccaacttcacggctgggggctaggatcagtgtttgttcaaccaaggcaggtcaagggtccaagagccttatcctccgagaacgattctccgacgacaaggctgggggctagggagagtgtatgactctacaaactgactgatcgaagtcggtaagagagaagacgctcatacacaaaacattggtcggtaaatttaattcattttcaatttaccatacatattataacattatcaccctttgggcattcgctcgggggctatttctatctaatattcttttctgagtattgatttcaggaaaattctattcgacattgacgaagactctatgtctctatggttctacaccaagatcgactatggcgagtacgacaaatgttgacaaggctccgtcgcagactctacgccttctcgatcgctcgagaacggttgctggatctcgacaaggaatacggaatgaagagatggtgtaccagccgagatagaatttcttgacttcaatccaaattctcgattacagcaagacgggagacttagtcgtacgctctgtacttccttggttgacatcagagattgacttagacaaacccttttggtgcccgcacgaggctgataaagaaagtctaacgttatctctaaactcaccgagaacggtaacgtgagcacgacaacagttactccagggtctgcggttgagaatatgaattcgttcatttgcattgaagtcgggggctactgtcagggttatggataccacatacctaatagtagttgactaaatctcggcaggacccaccacataccatgtcttatacagaaactaacttcagttatggagggagttccggataaggaaagacaaccagagttttacatggaaacgacaaggactactcggattgtatccatattggtttccctagttctacttggacaatgggacacctataggtataaatacaagcccccctaggaggacagtgggacacccaccatgacaggatcaacacagtcaccacgatcgacacagacgaccacctcaatcaacaaccaccacaatatacggaacaacagaagccacaacatacaagccaacatatgccaagacaagccgccggatatcgacttcagggataggcatggctattcccctacggtgtctccggataccgtcaggagagacgaaagcgctatctctgatctcgccggacacggattcgaggaggaaggctaccctgttgtcgactacgagtcagaccttcagaccgacatgtcgacaacagttaaataggctaccccacatattgtactggtgtgattatggtgaataaaagcaataccggctccggccaacaggatgtagggttattacctgacaactcaggggcccgaacctgtataaaaatccttgtctccgtctctttcacctcagtctcgcgtatatcctagcaccgacgatccccatactatgcaaataccagaattgcgacatcaaacgtcgatagttgcgtatcaagtagggggattttggtgcttcaggatttcgacttgatgggtttaagagatggattctccaataccatgctagttttcattatcgacgaggatttcttgtgcacgtacattcactgacgtgctagtaccaagtaataacaaactactcttgttttaaaatatactcctagtactcgattagacactagctatctagtagtataaatctagactgatttgatagtactatatgatgtttttttcgagtacaaggttttctgtattttagaacgatgagatataacaagaaaacatatggctacgaccacatcgtctgcatgcatgtacgtaaccccctgcataagtggccgaattagctcttgctgtggttgatggcgccgcacttgttcctgatctcccccttgctccccaccggcatgggcagcttgctgagcttgagcagcgaggcggcgaagtcgtggtcccagagggcggcgttgtcggcgtactcgcggacgtggccgcgcgcctcgtcctgcgtcagcagctgccagtccgagttgaagttgttttctgatttgctactactgcactattgagttgagttgattctaagtaattggattggatcattttgttgtcgcgtgtgcttgcttattttgttgcacaagcttcctagttattgctactgcactattcctccgttaaatgcgcctaacttgttgtttcttgttcagtccgccgccaccttcaccccaccatgggctttctccgcactcgcccagccccgctatttctccacaagagctaccagggtaaaattactgctctaattgccttgcctatctgctacctctgtccccaaatccaaatatgagggagtttggctctgcattcgcattgccaaaatcccttgtatttcttttcggggacggatgaaatcgattctgcatttgcatccacgattcctaactggatgagagaggagtgacctggagaagctacctgtgatgctggaagttttaccccctcgttgagacttgagaaggatttattgttttgtgctgacaagcaacattttgatgcttttctggtgcaaaaggttatgatgaggcgccttgagcagcgcattaggaaacaggagagggcggcaggaagtatgcatggatggcgtattgctcatctgaaggcaaaccacaggctagatttgttaaaatcagacatgaggtaagaatgaagaattttgtgaaaaaaacatgtttgtttaggttaggttttgacaaagttactatgttttgacaggggtgaccaactcaaggtgaccgcgcacatgtacagggggacctgttcgtcatatttgccggtgcacacacggtgatgagtttggtcgccggcgccataaacttcaaggaatccaaggaggcccctccgcctgagaagatgcaccacccccgggaagccctgcaggtcttgggctcttggctattatagatcgatgtggacctgatgtgggaaaaaacctgttatgtaactaaaggttaagacaagtaaaaaagaaaacctagctttcagatctacaagagaagatagagcaaattcgagtagaggtgtgtgggtacaacgagagagagagagaaaaaaaagagggttctggtgcgtcggcaaggatgctcaccgcgcaggaacgagctcggcggaggccgaggggatgggggcggcgcagggagcagcaggacgccgtccggaacagctgctcgccggcggtggcggggatcggctccacggcggggcggcgggccgtgggcgatcaaaacgggttcggaacatcctctgaactcgtggagcccacatccagtttttgatgacgtgttcacggttttgcttccaaatttctaaaaatttacccagatgtaattcgtagtgtaaataaactataatgtaattttgaacccttatgtaaaattaaatttgtgtaatggagtattacatttatatttgatgggtggcctaatctacgagtttttctttaaagaaccgacagcgggagctctgccgaataaaagaaccttggaagactaaccctattcttttctccaacaaaattgataagcttttggatactcgtggcacgcttttctaaactgctaaacggtagtttcatgtgaacactttctatataaaagttgttctaaaatatcaaattaatatatttttcaagtttgtaatgattagaacttaattaatcacataatattatcacctcgttttacgtgaaacacttaatcttcatcttaaaggaagattcaaacaccacctaagtttctctctcctgattagtattcccagaggtctcctttgccttttgtgccgtatttgttttggctatcttgttttcccaacatctaatcgagaatactgtgtcggccgggttgtcaagtttcccggtacaaatcaagtccaaaggcacagtttctgaacaggtgatcagtatcctcaaaagcttctgagcaaagagagcatatccaattgcacggccacaaagtttatggttttgtgataaaattgttagctatccttgcaattttgtgaaatgcaagactaaacttgcggtgaggcaaattcagcaatggatactctcaagtctgaaccccaaaaacatgttcttgggtgaggttgcagtacagtgccactacgcctggtgtttagagaaacattaggatataactaatccatatcgagttagtatttctttatctctatccatacaaattatatatatacaccggtcccagaagcttaatacagtaatccacatatacggtagacatctccagcacacgctatcaaatgccaacgagacaaaaagatcataagctggagaaaatgtgagagacatgacagatattagatgaacacaaggaatctggaaatctggcaaaagctttttctcagtcttggcatcctctctgaagagagattacacagggcattcattcagtttgtcaatgacccccaaaaaaaaggttaaaatgcagagactaaactttacaatggtgcatcagctgactacatctgttgtacattttggtggttgttcttctggcacatgaacagttaccattatacaacacatcacatgcaaaaaaaaaaaaaaaaacaagaaagaaacaaaaaaaaacgaaatatgatggaagggaccagaagtgttggccaattcctcaggtccctgcaaacgttgtgcaacgaaaaaatccagggctcagggagggcaagccaccatggctggctgccatccttgaagaacaatggtcaaagtccccctaaaacgcgacaggatcacgctgcccagatgccttattattgttgtcccttgctcgagagcctccgcttgtatcgcttcagcacggaggccaggttctccttccccttggggaaggcgacatccccagctgcggtgccactcctgcccttgcgccctgagactgcggtctccacatccttgatcatctccaggaccacagatgcggtggtgaaggaacctcggatttgccttggaatggagtttgttgctaccaggctactgtggcgcaggctgttgagcacccggatatctctgtgaaggcacgcacacgcgctgagagcactccgaggcttggagaatgcaggatccaggatgccctgcattacatttgagcgaaaaaaatgattgacagagttagtcttgtacgttgaaaatgagcagtttcaggtttgcagtcaagtcttgggcactgaaaaacaacactcaaattcagactagttcaggactgaaatagctcacctgaagacggttgagaacataggtatacttgccccaaagttctggcctgctttccaccagagacaggtctagcacccggcggatgcaccagacaccgaagctgacaacgagggaggcgcgccagatgcagtcgtctccgcagttaggcagtacgcgcatgtactggatgtctgccttatcacatggtggttgctgagtatcaccaagcagcagttggttgtcactggttccttgttgcaatagcttctctaccgcagcaacttgatcaatcagatcttcgtcgctgccaccattttgcttgaacagccaccctgatccttctagcttcaggagcttcgagatgcagaatctaagagactgaagaagcttcgcctcagactccttgtaagagaaatcatccttggtcatgccacccgatctgcctgcagggttgaactcgcttttagtgagctccgcactcgacacaccaaacagctgctcaaaaggttgcttagcccaaagggatcttgcacttgggtttgggctttgttgcattgagaagatatcccctgggagcttaggtggagagagctcatcaaacgccaagggagctgcaggcctggccaccgagtttgtatactgagatctttccgatgcaagcctgctaaggtacgactgggatccaatggtaccaccacccaactttgattcattcaacagagcactcctgcttgcagcaatcagtgcagatatgtctggtgagctgtggtacttctttgagtaagctgatgaaccagcattttcattcccgtcaagagtggaagggacataataggatctttctgccatcatagtacctatccgggatgttgctgcgatctgtgaaggagtagctcccaatgaagcaagcaagttctggttacgagcatgcatgacagaatcgacataggttggcacagccgatgcagaagattttggaagtcgctgtgggtccaatggcatgctagagtaaggatttcgattagcattcatctgttttaggtatgatgcgagctgatacccatgaatcgttgcaggttggtagaattggttgttgtctgcgtatgatggcgtgctaaaatttgaatttaatcttgcaccttgatcgagtaagctgttgcttgaactctgcagttgggtacttggtaactgcatgccctgagaccaggctgatgacccaatgttattgcccatctgaagcccatatgtcagatccaaattcgacatctcattcttagtagacatcagatcccttgaacttcccaagaaggcagacccttgtaaattgtctcgtaccatgggactcttcgggatttcattagcttgactgtctgctcttacagttgagctaggtgttcttacgtctagcccaagcaagatgtcaaaccttttagagctagcttcttgagtgagtttcccatggtaatcaaagagatgcccccagaactcatcaagtatggctgctagttgcctccttgctgcacggcccaaaccagataacctcgagagactcccgctgccattgcctgcatctgagcctttccccctgctgaaggtaagagatggtgggccatcatccgatgcacaggaaggattattgcctccaagtgacttgttgtcagactctagaatatttggagcctccttatcattgtccatcaaaagagctggttctacttcaatatccctttcgcctgtgctcttggagtccacactctctactgtactttcctcagccacaatagcattagaaattggctccagaggctctggccagtcaacagcaacaactgattttgactcttcaggaatgaatgatggagagtgacaggattcaggagcggtagatgtatgagcagtggaatgttgagaatcatgatcagattctatagctgtgtccgaactatcaatgtagtccagagctgatttcagacaatccacaggctgaatcctaggagaagggacaacatcagatctctgatcttcctcataggtaacattgcccgcacaagtctcttctctgtcttgagtagtattcaagagctctttctgagaaggcacagaccattcctgctgcaattcagcttcatggcttcctgatttcagtggtgtaacagccatgtagagtgaaaatgcaacagagacacaagccaccgtgatgagaaccgtagatggaaacaccacagggcttccagtattccctttcagagtgttcagccaaccactgtcaccaaacagcatttctgccataaagatgatattcgaaaacagcatgaggagaaatgcaagaaatgttaatatctccagatgcaaagacactctgtgggcacccattatcaatcttgatgaggcaacacggaagagtggcacgactgatgatggaaggagcatggcctggataatctggcagattatcagtaattggtatattccttcagcacctgcaaccttagcacagtacagagcaggaactatggcaaaagccttcagtatcagatgatgtccagagagaggaagattaatgccaaacaaatgctgcgaaatcacttggctaccaatagcagatgtcaacgagatgatgtggctagagaagagaagaaccactagaaatatagttggagccatagggtttacaaatatctgcaaaatgataaatgttaggtagtgtatatcactttaggattgctactgaaacaagatttcttcagcaccagcttagcatatcacagggtgaagtagtaggaactatagtactaacctggttcattagttctacaacatcttggaaggtgagaagaagggtgttagtggaatcagctgctgcagagttcattagaacatgattcaccagaaaaattccagtaaaaataaataatactgaaaacaagtgatcatgaaataaggcaccaacagcaaaggcagatcttttctgaccctgaaaagagattatttgattagcaaacatggatacaagctgaaaaaaaaagacaaccaaaagcataagacacaaagggcaatgaaatgtagctggttttgctgtcaaactcactaatgctatccatttttatacactttaggtaatatatatatcatatactagcaaacctaaggcaaagacctcatgaacactagacacttaccattagtgaaccaaaatatgtacacgcgaaagtaaaaaagaaaacaaatagaaataggccacagttttagggaacaaacatttactcaaggaacattctagatttgtgcttgtcaatcagaaatagtattccgcatgtggcacaatagcttattaaatactatagtttcattggccataattgttagttaagctccaaactggattaagtgagaacaaattctttcactaactaacgatgagcatgcctaacataatgctgcaattcgctagaagatgtatcttggtgttttgaaattaagtcaatgaacatcacttcaactctgcgcaaacaattgaaataggacaaaccatatctttttcagttggatacagcgtacccacaaaccactggatctattagaacaaaaacattctccactacatccgatattagactggtataactagtctaatatagtgacccttgctatcagtttggaatttctgaactgttcgaaacactagcaaagctagcaacatgtgtcattgtgtggtgtaaataattgtggcatgccattgaccattgtccaccaaatgcccaaacccccctcaccccaaatgcatcaaatcaaatataattctaactatgtaatgggcacaaagaagcatcataatttacctgaacaactgatgaatggatgtaaaagttgtgtgccattacgtttgcaccaagaagagccatcagagaataagcactttcaccactgagcttggggaaaattacattcgttgtcagaggaatttgtggttggctgaccaataaaccaagaacgtagcaaagaagcgcaaagcctgcaatgcaagcatttaatgtccccaccatcttctttccctagaataggtatatgaaagtaattgacaaatattaactccaaatcagattacaatataggtttgaagttttctatatgagataatcttcttctttaccaggtgtgatatagcatatggtagcagattaggaacaacggttgcaaaacatatcccagtgatgagatcatcatattcaaatagaagattgaatccaagtgctatcccaaaaatctgaaattgccagatattacaatcagaacaaagcatgtgcaaaacatgcagcatttatggctgaaatttctcaggctcagatctcatattaaatatcgaaaagagaagaggctgaaaataccatcgtcaattctgatgtcaacaaggacaatcctgcttgaacacccagaaagatgcatgttggcctgctgtattcttggtggcagatctttgttccatgtggaaaacacaaaaatgtcagcaacctcgaaagaatttcacgaacaaaacgaataacatagaaggatcaaagcacactgttttacagggaaagttggtttttccccctccgcaaaatggccagctagaaagggaacttgagatgagcaaaagttccttttccaccatttccgaaaacaaaacacctcctttctttgtttactatcacaacatatacaccataagggcaccaaaaaaaaagaataggattcttttgcacaagtatagttccaagtgaaccatcattttctttatcaacaggaattcacatacgagatttaggaccttcattatgaagatgcttttcctactcatcagaattcgctcagagactcaattcagtatcaaaaacccatcatcatttctaccatttgcgaaacgacaaaccgatgtcgatcaattgactgatcaaggccagagaggctggacacttttagagggtttgctcctacacttggtcaatgggggctcacacatttgcacactagtagagaagtgctttttagtcctgattcgtaaccttttgtagacctgattttttaaccgggactacgaatccgggactaaagatcgctatctttagtcccggctatctttagtcccgattggtgttaccaaccgggactaaagaggttagattcagttgctcctttattcttttcttttcttcattggtggttttaatatattgatttcactccatcccatcccaaaaatcccaaatcaatcatccccgaattgcctccaaatcctcaaatcgatcatctccaaatacatcataaaatcttaaaaaaaattacatcacaacttctacaaaattcatcacaaatgcatcacatattcacatcacacacaaatctcagatccaaatcacaaattctccaaaaataataataataacggcgttttcgcttagtggttacaagagcctcagtagcacctgaggtcttgggttcgactccccatgggagcggattttctaagatataacggcgttgtgcttttagtggtaggcgacatatccgtcgacaacgaggtgcctatggtgacttcgtcaatctcaaggatttgccggcccagttttcgaagatgcttataggggtagggtttgcgtgcgtgtattcatagatgtgagtgcgtgtgcgttgtgagtatctacattgcactgtgtaattctaaaaaaaaaagccccaaatcttttacatgagccatacaaccaaaatactataaccagagtgaataacaaattaaggtggttaattttcctcctcttatagaacaaggtggcaataaaaaattgcaacatgaatggtgtgtgtgcatggtgtagattggagaacaaaaacgtttaattagcacaaggtgcaaacttgccactaagcaaaaacggcacgcacaccaatggcacaagtgcgttcttcactcgagccagccagtatagctttttagctgttggtgacgttgcagaacctcctgacctccccccgcgccccggtgagcacctcgatgccgcccatcttcaccatcgacgccgcaaaccgcgccatccacgcggtcaggtcgccggcgttctccctgaccttctccgccgtgtcgttctggccggtcagcagcgccgcgtccgacgtgaacagcacccgcccggcgagcgcgttcttgaagtactggttgcccagcgtcgccggcgacacggggctgttgttcaccacgccgtcgtcggcggcgctgccgtcagggcacgccgccctcagcgccgccgcgtagctcgcgtccagggacgcgtccaccgtcgggtacagccggttcttgaacccggagcagtgcgcggtgccgatggagtgcgcacccgagagcgccaccaggtcgtcgacggtgagccccttggcggcgaagctctggacgagctccccggcgtcgaagaacggcgacgggatgctggagaagacggagaaggcggacgacacgttgccgtcgcggctgccggcggggaccgggtagacgaagccgccggacttggccaccgagtcgcgggcggcgaaggcgaggatgtcggcgcaggagaccttgccggggcagacggcctcgacggccgccttgatcttgttcacggcgtcgtacccgcggagcgggatcgctgtcttctccggcgagccgtttgccttcgtgggatcaagaaggatggacgcatcacaaccctgcatgatcaaaaaacaaaaaaaaaaaaacttcgtttacattttttttggggacaaaatgaagtaattaaccatcaatatctaagctttgcttgcagtaatatatcttgtgagaaattaaaactgctatcaattcatagttgaaaaactaaattaacttgtggttagcaattacattaccatgacaaagcaatcatggaaatgcaaacgcagcagcgccggggccatggaagggtcagcatcgatcaagccgtagacgacattgctgatcgtctgctcggcatttgggcacgacgagccgtagaaattgtactgcagacttgcagttgatatggagatgaggctcatagcctggaaggctaccatgagaattagcttcatccccctgctgaacattctgaattctgacaaggttgttcactaggagacagcaaagaaacgcctgaaaccgaatgaatatatgtgtagtgatcgctacctcaaaggattggttgatgtttgatgatgtgacaggcaaacattcgatgtatttataggtacaaatggatgtgcaaattgatcattgataattgagctactccttttgaatgaggagattgattaaataagagatttgaggaatatttggagagcaatcatcagaatagttatttgccagttcttgttgtctaacaacatggggagcaaaacagctagtaactgataaaacgtgtaggcgttgacatcgatccatacctggcgttgtgacggtgaacttaatttaaattcggctggagctatatagagtaaattaattggccgtccagatgcatcatgcatgtgtcaaccgaagcacagtatttgatggaaggatgcatggcggagctagaaagatttttgagcccagacaaatttcaatataactgatatttgctatagaaatttcatcatctatttactcattaatattaaaattttgtgtagttttcgctaacgagcccaagcagccgcccggtggctagttccgcccctatgaaggaggtcagtttatttggtcgatttgacaacatgtatctttatttcaattcaaatgctgttacctaagagcgatgtatttgtagaatttctttccatgtacagtagtaaattaattaactttcacgtcaaaagcttgtgttaagcgtatccactggaaaggacgctaacgccatacatatctttaggattttgagggaactatagcaggcatgttcgctagctcaaatataatcgagattatagtggtctcatcaatatttaatcactccattactgttatctagcatccgaaccaggctagattaattaaacattttcttatttgacttcccttttgtttaagaggtcctgttgactggttgggaagcagctaacctacgttcatcccagccgtgtgtcagatcacgtcaactactgggcctatcaattggcaggtgcaaagcgagcgaccaatagactagcaaccccgaaaatttccatgtacatgcatggatctaaacaaatgtgtttcaacatgtttttggaccccatttttcaaaagttctcatctgcactctctattgatttggctagaacaaatttatttttttctcccataagtgttcgatgataatcatgtcaactgcaaatcagtactacaaaaagacacataaaagtcagtattataggtgccggaataactaaaaccggcacctattatgcttttcccacccaccggagcgcccgcggggggcgctaaagggaaaaattggcacctttaagtatttataagtgccgattttgaaaaaagtccgacaactatactatagatgctggtttgtttatgtgtgttcatcttgtgttcttgatgttcatgtgtgttcttagatattcatgttgtgttcttgtgttcttagatgttcatgtgtgttcttagacgcctcaagtgcaaccaccccaaattcttagatccagtctatggaagtcgcggctgccacgtatgtcatccatctcatctcctggcttggaacccatggattgttggctttaataccatattgttacgaacccactctatgtgatttagtgaattccagcacaagcacacaattcttcctccaacacttgatacacgagtatttggggatacaaatgggagaaatggaatcaagactgagaattagcagtagattggagaagaagagatagccagggattgaagagaagagagatacagaggttgaagaagagagagcatcggaaggaagaactcaggtttcatctattttgttcgatcctcccatctgttggatctgctccttttgtaacggcttgaatgattggcttatcgcagcggattgagcctagctagccatgggctcaatatgtataccgattcagcccagttacatgacaatccacgagtactaaatatgtatgggatttagtctatgcactaacagatgcaaaatcagggacgaaggtagtaacaattcataacaggtaaatatatgggtaaccacaaatacaaatactttatattatactggagtagtctttttttttcgagtacaaggttttctgtattttagaacgatgagatataacaagaaaacatatggctacgaccacatcgtctgcatgcatgtacgtaaccccctgcataagtggccgaattagctcttgctgtggttgatggcgccgcacttgttcctgatctcccccttgctccccaccggcatgggcagcttgctgagcttgagcagcgaggcggcgaagtcgtggtcccagagggcggcgttgtcggcgtactcgcggacgtggccgcgcgcctcgtcctgcgtcagcagctgccagtccgagttgaagttgaccaccttgtcgaggttgttgcggtagtaggtgttgtccagggcgctgaccggccgcagcttgccgacgaacgccggcatgaacctcgccacggtggcgaggtcctcgtcgcgggcgttgttcaccaccgcagggtcggcgccgccgccgcgggagcacctgtagttgagcaggttgcggtaggacggggtgatctggtcgggcggcgcggcgaggcgggcggtgaaggaggagcagtggccgtcgccgacggagtgcgcgccggagaggacgacgagctcctcgacggtgaagttcttgcgggcgaagttgtcgatgagctgccggatggtgaaggtgggatccgggagctccgcctgggcctcgtaggcggaggagacgacgccgtcgaggcggcccgcggggacgtcgaagcggacgcggccgttgctgaggatgctgctggcgtcgcgggcggcgaagatgaggatgtcggcgcaggagaccacgccggggcacctcctctcgagatcggccttgatctcctccaggatgtcgaatccttccagcccgatgctcaccggcgctgccgtctcaggacgagggttctcgtcggacgcgttaaggaggacggaaccatcgcaaccctgcaatactcatgcatgcatgcatgcattgtgcaaccactcattagtcccaagtgcttcaaagctactagtacctccttagtgcttcaaaactactactccttttcactatataagttgttttggtcctctgtttcgtactcccttcattactttttatagttatattttatcttaatacaccgatcaaagataagtaattttacttatcatccatttaaatatgctactagttatttctcgtaaacaagcgatttattaatatatttacatttctcgatgcctatatagccaatattgcgtggaagaatggagagtcacgcattaaattccggaaaagctgcgcgagttaagcaaatagcgcgcactttttttattgagaaaggactcgtcgtttgtgttttttctgttaggcccacatctttttcccttttttttcacgttttgtttttttagttattttctatttttgtgttattactttgaactcaaaattttaaacttttaactgatatttgaatactttcaattcaaatttgaaacgttttcaatccatatttgaaaactttcatctcaaatttaaaaactttccactcaaaatttgaaactttcaatctagatttgaaaattttcaacccagatttaaaaacttttaactcaaaatttaaattttttaaagtcaaattttggaactttcaacttttcatcttaaatttgaaaaattttcaacccagatttgaaaactttcaactctcgacttgaaaactttcaactctgatttgaaaactttcaactcagatttaaaagttttcaacttgagattaaaaactttcaactcagattcgaaaactttcaacttaagatttgataactttcaaatcaaaatttaaaattttcaagttaaagatttaaaaattttcaactcaaaacattttttgaaaaaatatgtgtgctaaagattaaaaaagtaataagacaaaagcgaaaaaaaagataaaagaaaaaggcaaaaaaatcgcaaaaaaatcttgcgaaaaaaaagaaaaaaagaagcctgatgggcttccgggccggggccaacaggcgggcgcgcgccaattagccacccccatgaaatccaagaaagtcattaaaagaataggtggttggattgaaatatgcctatcaaaagtaaattttttagatttggaatatgatggagagagtattataactcattttaattttttttcaaacctttttaagtttgattaagtttatgaaaaattttagcaacatttacaacaccaaattaatatcattaagattaacatttaatacattttgataatataatattttctttgtgctgaaaaagttactatatttttctataaattgaaagtttgactaggaaaaaaaatagaatgacttataatgagaaatagaggtaatataaatgaattcactcataaatccatttaaaacccgaaacaatttataatatgaaatagatgaagtaccgatatgtactcactccgttacacaatgtaagtcattctatcatttcccatattcatattgatgttaatgaatctagataggaaatgtatatatctagattcattaacattaatatgaatgtgagaaatgatagaatgacttacattattaaacggaggaagaaacaaaatataccctgacaaaacaatcatggaagatgagacggatgagggagccgcctatgccgcggtcctgtatgatagtgtggagattatgggtatcccatatctacacggcgatggtattcgaactgggtacaggatacctaatgtagatagaatatcttatctgtatctcgggtttgtttcttaacttgtgtatcaaggaaacacccagagacttagtcggttacgactgtattttatctgtatcttcatattccgttaggaatatagattatcttttgtaatccggactccttcccatatataaggggggtccgggcgcctctaggggcatatgctgattttttcccgaatcatacaatcaataatacactcggcggattcatccccggacaggagtagggtattacttcttttataagaaggcctgaacctgtataaatcctttgtttccaaacccatacactttcctagcttgatagccacccccttttattattgccgaaatctagtttcgacagttggcgcgccaggtaggggtagcgtcaagctttttcgccgatcagtgcaatgggttccatctccggcatcgacgacctcgtcttcccacccgggcagacgtttcggttcggcagcctcgacttcatcaccaacaacttcggcaagatttctctcctcgactcggaatcagaccagtcgggagagaaccggctttcggtcccgtttggattcccgaacgcggctgaaagctatttcaagaccacctcaaccgagtcggcttcaaaccactcggccgagatcgcatcttctccacgataccagatcaggatgatgggccttacccaccggtcctgatgaagctccccgacgatttagcggccgtcttcaccacgacagcgccttcatcccgtaggcctagccggaagtcggcttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcgacgacttcgacggaagcctagatgacaactacacccctctctactttggcgttttcatggccaataatgagacggaggagcaacgccaagccagggagaacgaagaacgtcgccgactggaggaggagcatcaagcgcaagaacaagaacggctacggcgtgagcagcaggaccgtgagcggaccgcgaaggaggctgaggatcgacgtcaacgagctttggaagcagggcgccgagcgcgtgatctcatcggccagcaagatgtcgaagggacaccggttttccgcacccctcaacagaatgcggttgccgcgatcacccttctcgacgccctcctcaaccaaaacgagctcaatcaatccgaccacgtcgtcaacatcttgacccagacgaagaccatgattgcggcgacggtccct

SEQ ID NO: 30045 - DNA, 3841 bp, Oryza sativa
agatgagacgcataagggagccgcctatgccgcggtcctgtatgatagccttgatgacgtgcgacctgacgatgtcctcgacgccgctgcatttgttgtcgtagtagcccactttcagctcgccgtcgccggcctccgccgacgacggggcggcggcgagaagcgcggtcgccatggcacagacaattgctaccgtgagcttcatgcttcacaaacctatctaggagaccaaaagcaacacaaagctcagcgaaagctaatttgctttgttagacagctataactgagttagcgatgcttgagcggcgaggctacatgatgcctaagctcaaggcaagggtatatataaatataaaattgccgggttcggccgaaaaatttcagggccatatgctaattaactgtactgagagtaatattacagatatatttacggcgttgacagtcatatgaaagattggattaatggtacacactttccatatacttcttttgtttcaaaatattttgagtattcaaaaatttatgccacaatataagtatttatgggacactcagtccagtgcacaaaaatcgttctgtacattttcatccgatgcttgaaagggatatataaacaatttaaaatttaaccactaaaagatatttttttcactctgccttagttttgttaataatcatataaatacttatattttaaatcatcttacaaaactattttaaattcttttttcaacttagtgtaccctccaatagcgaacacaaaattattcagctagtactcagaaaaaggacactgaaagtaccaaaatagcaaatctaatgtacagacgatatatacatactccctccgttctaaaacgtcaacggtggaaaagaaagaaatagtatacgacaatagtacagtggcacttgatgtaggggctgttccttagagattgtactgtagcgaaagtagtgctttgaacaaaaattgcatgaatactgatattgatttttttttgaaagaaatataccggttgaaatttgtttggaagaaatattccatcggtatcgcggggtaggagtgcaataccggtataccgaggttagcacgcggctacgcgaaactgccacggtatcgcttattgttgacggtcattaagtgtaaactttaccgtcaactcctgtataaagaatataaaatattatatcaaaacttgatggtaggagtttattgctaaccattttcactagttttgataaatatatttatgcaggtcatttatgaataaaaatacatatgtcatgccataaaatgaacctccggtcaatcatacgtgagtaaaaagattggagggctcacatgacagttgaaaccgatctaaagtagggccaaaccaacctcagtcaccatagaggcctacctgtcattcactggatgaagtcgatggctagaggcggtgggagccgaaccagacttaccgtcccccagctttccctttgcacatggcagcgccctattagatggtgatcacggttacagatgaaccgactgaaaaccaccttacaaccatcatatctaaacatttttttaaaaaaattcatactcatttaaattgaatatatgtactcaatttaaatcttggtgcctggacaccatagtgccccagttaattttacaatatatataaaggaatgtgggagtagttgaaataaaaagatgcaacatcatcatcctctaacaatatgctacatcatcattcaataataattattacatttaaacattatgaagcatgctatattatttgtaattttatgatttattgaattttagagtttttaaaatgtaagcatgttaaatcatcatcccacataattcaaatattatttcaatttatctcttcatccttttttataatattctatatatagttcattctcacttagttaatgttatttctctcttctctcattaagccatatcacatcaattatttttagtcttagataatctatggtccaaaatatctctctccttttcttctctcataaagccatatcacctttacttttacatttaaatcatcattctatacactatttaaatttaatttatcatttaaatcatcattctatacactatttaattttaatttatcataaatcacatgcatcaatttatgtaagcttgtattgtctagctagctatcttacacattgttttcacttgttattatgctaactcagtagcaacacgcggagttttacatagtatatataaatgccagccgcccagccggtacactctaggagaaaatgcatgcgtactaacgtcattttcagttcggtgcaaatctacatcatcaaggtacgtatgtacaacacctaaattcttatatatactggttgtggcaaactgcaagctaattaattaactatatggccgtccaaatttgattcttagcgccttcttttttattcgtgggagattcttagagcctttgcttcttataaaatgaaaccttgaatatacaatataggacatgtacttttttaaattaggatgtacgtacatatacaattaattaacatttgatacattttctcttcgagtgaaagtctgaagtactcaaatgctcacgtgtttttccatggcacatatactatttcgtacgaaaaggcataacatgctcgacgaaatattattagatatgtatgtatttgttatttttatacaataatgtattttctacgagacactttcatggtagttttctaaaatgaccataattttaatattttaacatttttcagctcaactactagatagatacaattacagagatgacgttttaaattacctcatgccaagttggatgttcagcctggttttatcttttactaaattgcagaaaatctccaaacattttggaggtgattgatagaatttttctaaaaaatatcgggcaaagaattgaaatttggatagtgttttggtaaacttaaacattttatgaattaaaaacgatccaaattgcaaaaataaagaaaatgtttacggggtccatggaaaactaaaatacttaaatagttaagaatatattttgatttttttcagatttcaatttttttttctaattaaagatgtccttttaggaagtaaggcgctgaaattccaaaattttcaatttgcgaaagggcgtaaaagcacctttttaaattttatctgcccaaatgagtaaaatgttgaaataatgatcatgaaatgttttggcaaattaccaagtaatcgaagtgtcctggcaaagacacgttctatagtgctataccgcaggtatagttaaatatgttacatatatgagacttctactacaaattttggcatgaaacatatttggattagttttctaatatataaaacttgactatcagggttaattttctaatatgtctctaaatcttcttctactaagactcttagaatttttctttatatatctcttgtaaacctcacaagaagtatcgcaccacccaatgtattctatacgtttgtacccaactcctctatattaatcattgccgatctatgcatgtaggcttttctggtaagagtttttcacataaaagtcatatattagtcgtgcatctatttttataataaatggtattagaactttagagatggatatactaagggtctatttggcacaatttcagctccacctctactagagttagagcctaactaaacagtttcatctccacctaaaataaaaacgaaactgagtaaaataatttcacaaaataaactagaaagaaagatagagttggatttaaattgctctacggctttatc

SEQ ID NO: 30046 - DNA, 455 bp, Oryza sativa
atagttggttggctggctggatggctggctggatggctggctggatggatggtgaatggctgccggcggttcggttgctttgaagcatttgttgctatctaaattcaatttaaggtcgtaccttatcgcccagcatcatattattctctatttgcattccctccatctttcagatacggatgtagccttggatgtgcccgtgcccaatgaagaggaagagcgcaacatgaaacgttagtacaaaagtgccggacacccacccagatcccaatagaatccgccaaatcctgcggcaaattgtaatcccattcaccagctcctacatttaattaacaagagaactattgtatttatctaacacgtggattatctccacctttcatttgatccctatttatagattacgctgcgttgctaacggtccgcacctcctatttcctcaagggtgaggaaat

SEQ ID NO: 30047 - DNA, 314 bp, Oryza sativa
ctctaataaactccatataacaagcaagcacaaaaatgggttcttgacttcttaaggaaaaattagagacttgaacggtccaatttcgagttcaaatggccaagttatggccatttgaagtttatatgctctttaaatgaatatttgcgaatttcttcatttaaattttaatttagaaagggtttattgcgtcagccaagggggaggggcgcgcggaccgggtccacgggagtggggcccacgcggcagcctcacggtccacggtggaccgggcgcacccggctcgcaccgtccggcgccgtgggccccacatg

SEQ ID NO: 30048 - DNA, 3886 bp, Oryza sativa
attcatgcacaaacatgtgtacaaataggggtggataaagagactctttttaaggaaataagtcgctcgatcgagcttatcttaacgagctagttagggcacctacaatgattatctataagctctctacaagagatccatgtcagcatattttcctacttggaagagattaaatgaagagagagagcaaagctatctactaacatggagatagtctatagagaaaaacgaggcaatggattagagagctatagatactcatgtagacataccattgaagtggtttactattaatctagtctattgttgaggtatacatgttttatagatagcaccttactttaccattgcgggtgctcttaggttcgactcgttaaaagcctagctctgtttgacttgcgagctggtttgttaaactcgttaggtaatttgttaatgcattgataccacattcaatttttaatttagtattcatatataaacttaataataaacattaactaatggagattcactaaatacaactagtttggatgtaaataaagcactagttatgcatcagccatacttagacgaagaaatgatgatcttttgtattaacgatctaaacgtgaagctcgatcgtgagctagctcgttaagctcacgagcaaaacgtctagcttggcttactacaagttaaaattggtccgaggcgagctcactacaagtcgatccaagtcatgagttttaagttttttaattccctatatagaaattagaacggaactcgtatgtaattatagaaattaaactgataactagcctatttattattcagtattgttgagatcctaatgaacatatgtacggttcagccgtgcttcatgcatatgccatcgtttgatcgactgatatgatcccaaaattcccaattaaggtttattcgatttcaatcaatattagtgtagcttaatactgtgtatttgatttattttcttgaattatagtgagccaataggtacaattgttgtgaactagtgatatgtatttctcgcgacgtgattgactagtaactttatgcttgatatgtgctaccaccttttctctcaggtaatgctaccatagccagcgacctttcctcgcttttattagtacaatgtagttttattgatcactgttgccaatttcatatatttatttcaaaaattgtatttattactagctgattattcttttttggggaaaactctgactgattgtgaatcatatatatcatgcatggcgccatgattcttttagagctaaggaggcttaaaacagttaaccccgacatctagtttttaatagtcttacaaaaaccatttcaattgattttcaacagttttgcaagtcggccgattgatattttggcttgaagacataaaccagtagtgattttctcttatctctaaaaagattcataaccatgaaagtttagaggttattttttttggtaaagtgtactttcattaattgtgtttaaaccgtcattaatgaccttatctaattattgcacgaattgttagagatgactgctacaaattaatcatcagaggttgcctttttttataatattgagtgagacttccggttgagctcttaataaattttcagattcagatcaaaatatttaacaaactcattaaatcccaaaactatgtcacggaaaaaaagatccttcattcaatttcatacaacaacaatacaaactttcatctcatgccttccaaaaataaagaaaaaatgcatatccaaaacgtgggaatgcgaaaagtagcctatgccaaacagcattactactgtcaacctcaaagctagcttgcaaattaaaaggattggccacgttgacactttcaagtcctctccaacagtgaaagcacaacatgggcaaagtaccaataaaaagtgataatgttataatcttgttgctttgctatgcaaccttgcttatttctaattaataacagtgccttttgaattattggagagcaccatcacaccacaccacacatggtagcaagttcattaccatacttcaattgctgaaagtcttccatgtctttgacttaattagacactgttaagtgatagttgtattagtactagttacatccattgttggtgactgagaagccataaaagtaaagtcacattattcccaagagggacttctcatttaggcttccttcttttcagttgaacgaactcagctcattctaatagggtaatgaagataaccattaatgcataattacttaagtggagtacttactattataaagtattttttttaaaaaaatatttaatattaacaaaacttgtaagtagaaactttttatataaaatataaggtttgacaattcagaaaacatgctaacattaaacaaagggagtagtactagcatgtaggactatcactgactggtgcatggaccaagtccatccactgctgaacatggggaacaacactacacagtaagcacagaatcttccaaataatataaacaaaaagatcagaaatttttttaagaaaacaaaaaaaaataaaaaaaatagtgaagaaaaagagctagggagaggagagagaaagagagaaagctgaaagctgtgaaagaaaagcctctgctgctctctgctagcttcttctcctcctcctcctcccccttctccccgtagataaggaggacccggggaaaaaggggaggcaaaaagctgcgattttccgctaattaaccccggggattagctgcccaagaacaggaggaggtacgattcttgcattacttcaccccacgcgattccctccccggtttcccccaatttcctcccgcaatttctacttgttcttggctcctctctgctgttcttagcctcgccgcgatggcgtagtcttggagaagatcagatccatctcgagttcgattggggttttttttttctctcttgaggttgctggtgatgagcttcactttcttggattgattttttttttgttcttgttcgttgagtttttcactttgctctaatccaaatcttttttttctctctctctctctctaatatccataattaatctgcagatttccatgattggtggtggagttcatcggcaaggaattcagcagaagagatcagattctgtacacagttcgtcttcttgctcggtgactaagctgggttaggagaggaggaaaagaaaatctttttttttttttttgcggcgccatggatgggcagcagctacgtagctcggaatctccggcgagcggcggcggcggagtcaccggcggcggcgcgccacatctgttccacgcgctcgggccggcgctgctgatctcgattgggtacattgacctcgggaaatgggtggccgcggtggaggcagggtcacggttcggccttgacctcgtgctgctggccctcctcttcaacttcatggccatcctgtgccagtatctcgcggcttgcattggcacggtcaccgggaggagcctcgccgaggtatttcgagatgcttctcacctgatgtttttgttttgtctgattttgtagtggtgaatgattcatcatcatcctcatcatcgtcagtcaattgatcgacatcggtttgtcgtttcgcaaatggtagaaatgatgatgggtttttgatactgaattgagcctctgagcgaattctgatgagtaggaaaagcatcttcataatgaaggtcctaaatctcgtatgtgaattcctgttgataaagaaaatgatggttcacttggaactatacttgtgcaaaagaatcctattcttttttttttggtgcccttatggtgtatatgttgtgatagtaaacaaagaaaggaggtgttttgttttcggaaat

SEQ ID NO: 30049 - DNA, 574 bp, Oryza sativa
cgggcacaccgttgagcgtcacctcgtagtgcagattgcactcgttgtcaatggacatccaggccatgccgacggcatgtggattctgtgcatccgcgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccggtgctcttggtcgaggattcggcactgtgcgacgccagcagggtttggaagatttcgcagctggctcgagtcacgatgtgtccctggatgcgcagatgtgggtacttcttggactccacggccagcaggagttt

SEQ ID NO: 30050 - DNA, 2646 bp, Oryza sativa
gctccaaccttgggaattcagcttctattacagatgatcgattgacaactttcatgactaccaggtttagccaggtctgcaatagccaccatggtccacctgctccaactattgagccgacggctatcttagccgatgcattgttcaacatttggtatagatagccgagaaggattttgcccaaagggaattgtttctatgatcctaaagcttcgactacaaattgccaattggtttgtgggaccacagctggatccacagaagagaaacttttctagccacattagcaagaaagctacgtgctcccgaggagtgacaggccatttgcccatgtatgccgctacataaccagaccaccctcctatgcttttggtcttgaagtggttcttggtgttcatactcatacggttacccgataaagttacatctaatctagtaatcatgatgatgtcgatcaaagttggagtcatcggcccttcgttaaataagaaggcattgatggtgttggaccagaaataggtggcggcagccatcagaggttcattcttagcagaattggctatggtgagagcaagcgcttggccgatcccaatctcattctagtggactttcttactagccgatatgtgttggtaccagatggtccagctcttatcaggggtaggcttttcaagagatggccaagacttgaaggtattcttccagtgacccaggttagggttggctagtctaaaggggattctgttggtttcaccaataatgaaatcagtggggtcaagattgccgattgggccaagaaaatagtggtttttgtgcgataggctgggaatcgcaactaggttggaaaggtgctgcaaatccaaaggaatcgggaagcagaaaacataatgagaaaaggagaaatcgatttcatgcgaggaaaagggatctagccggtgagaacttacctcagcgtactcggccgatggcgcagtagacgggctagtggaagacgacatcgccgcacgcggagatctgatcaaaagcgaaatcgcctggggatcgcttttgcgtcggaggaatcgccggagagagaaaggacaaagtttcgcttgagcggtgaaaatagaagtcacggtgtgaggtttctcgagggcaacggttggtatttaaagcgatagaacgtcacgactggcaataacccaacgggcgttccttacgtgcgtgtattactccttgtcccaggaggcaaggtacaccaaaagttgatacaattcagagtttaacaagcggaagcgtaattaattaatttattacatgggcggcgaaggcccagtacacaagaagacaaacgaaaaacagcggaagactagggcgacgaccacaggcgcttgacggtaggcacgagctagacaccaaagccttcatcttccaggaactcctcttatgggtttgggaaaaattgagcaagactgagtacaaccaccgtactcaataagacacacccacaagtgcagaataaatgcaagggagtacaagggagccataatatagggtgttagggtttgcagtaaacagcattaaaagacacttagttgctcaaagctattttgtaaatacgatcctagagctatacaagattattaatcaaggccgtgaacccacacgaacctgccttaacccaaggcctactatgattcagaccgaactggcaacccaaccctgggtcccagctcatcccaagccaacccaggccaaccattccacattttagttgttaggcaggttttaagaattaaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaactccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacgatagtgctttgcaacagaggcctgaagaccggtccttatatggccgaggtgctactatcaaaaccatgcaccccgagcccagcctaaaaccattttgaggattttgaatagagagggaggtgtgaatccaattccacaataatccaaccattccatagtgtccaggtgatgagaatattcccaaagtctagagttgtaaaaccacctaatgttgcctaattaaccagcgaagcatctacctaaaatcatactagtggtaccatgagtagagtgtccactagttggggttttgtttaatctagggtgaacaaggtaataatatcaataacaataataataataataaggtcataacaaaggtaaataggcatggctaaataaaacagtgataacgtgggcatttaagtaaagcgataagcaatatt

SEQ ID NO: 30051 - DNA, 3840 bp, Oryza sativa
ctcgggttccatcaatggcgccggcgggattaggggagggtttccaaacgaatccaagggagagagggagggaaaaatggggggaaagggagaggggatcacggggaatatttccccccgctttattgcacgcggggacgacgggaggcggcgggattcgcggcggcggcggcgctagggcgcgggcgaggtggcgggagcggcgggaggaaggggatgacgggtgggccccacccgtcagtgagggtggcgggcgggcccgcccgtcagcggcgctcgcgcggggagaggccggatgggccgcggggagagaagagagagaggggagggaggagagatgggccgggccggcccaagggagggaagggggactttttagggtttttttttctttttataaaacctttttaacttcgtttattccttaacaattattatttgtgctctgaaaatttcactaaaatttatttacgtattttaggcttttaggaaatatacaaaaatcctctaagccttaattgacttttaactttgcacattttaattgttggaggctttcacacggattttaattattctaggcataatttagaggatatattttaggatcgttttgggacgtgacatagaataacggtcgaaaaacagcagagtgcgaaacttgctcggagtcggtacacggcaaatccggaacattatcaaatatcccggacttggggggcatgtgttaacgaccaaatttggtaatatcaacatcggaaaagcagattagatcgaggtggagtcgaaggcggagattgatccgagaacagagcaagaatcggctgaagtctagatcggctacgattaggatcggctgggtctgagtcggactaggtaagccgatgcagccgattccgacagtataatttggtgtatgacatcgggttgaattgaggtgcttcaagatgattgccgcacatggatagagtcctgagaaggcaattgtatctattaattaggatgttttatgtaacttccttagagatatgtttgggcaaaagtctgccgcaaagacttatggtatcttagagtttgttagagatggtggtcgtgtccggtatggacatatcttgtaatcctcgggtataaatagaccccgaaccctatgtaatttttaacacacacgttcaatacaatttcggcgcatcgccacctttttgctttagttttgtttcgacgagttcttgctttcgggttgagctgcatcggtttcaatcttcaacaagaggtaaaacttgttatgacgacttgtgttctcgagattagtgcttccatctttatgacactctaatcttgtctatataattcgtcgagttatcatatatcttacataatctttggcaatatcgtcatctaacctacaatcggctaacatctgttaatagaaggcagccgattaggttaaatagagacgttgtcctatattatataagatatctaccactttatgaaacatccagcggcttgattgtatagatattgttcttcttttcatacttaatgctgtatcagttgagtttgatctattaagtcgtacttagaatatcaatctttagcctgtcctctggttgtcgattagggtagtatcggagtttcagccgatcttatctgatttaaccatattcgatctatatgcttcagtgacatgtaaaatctgccctttatttcaagatcttattgtatttaagtatattaagcttttgtttggtatattatacttgttttgatatctttatatagagtagtatcggggtattagccgatacatgctagatctatctgatcggctatgctataaacatatataatcctattattaatatatatttcgatctaagtgatttatattgtctcggcatgctgatcgatctatcccaatcacttgatttaagtatatattaatataagaactatatatcgttaatatctacagccgatcgaatagatttagttccttactgtctatttataaccgcgatcgattcatatatggcatcggctcaaagataaatgatatgtcatcggcacctagcagatcggctatcatttatagatttaaccacgaattctttgtctctatttcttgttgattacaggatcaaatcaactgtcacgctcatacattcgaagacgagctttggacctgcactggagttaagcagatctcccaggcctcgtgttttctgtcaacagctaccttgtgaccttgtgagtacccttccctcaccatgctcgccctaccttgctcgtggtgtgggtttccattttcgatgagggggaaccgccccagctgccatcatgcacactaaaacctagcggagtaggcaaccaacgatggtggtatggtggaatagcaagttggcgtgctcagctaggcgagaaacaacttgattatgtatgtgaaaggcaggatttttgagagatatatgtttttttttacaagcgggcatataacggggtatgtgaaattcactcatcatcataagtttgaacaaaaaaaaatcaatgaaaacaaattatttgcaaaaacaacattccataagaaatatttacaaaaacacaaaaatagttctcacaagaaataaaaatagttgaccatatattgatatatagcagccatgtgagctgtgacatgttgtaagagcaaaagagactagtatatatatacacacacacgccaactaaccggtattaatttattaacttatggccacgcaaatatctaaaaacgttaacattcagctagatatatatatagacacataaatagcagagaaaaatccaagaccacatgtacacaaatactacctccatcccaaaatgtttaacgccgttgacttttttaaaaatgtttgaccgttcgtcttattcaaaaaatttaagtaattgttaattctttttctttaaatatacttttatgtatacatatagttttacacatatcacaaaagtttttgaataaaacgtacggtcaaacatgtttaaaaaagtcaacgatgtcaaacattcagagaaggagggagtatataatatgctcctctattcctgcatgcaatttgtttctattcagtgatgacacagtgggtcaaacaagttgcacggcaactagagagccccatgcccagataccggaagaacaccctgaattccaagcacacagttttgttgtttttgcatactgtatcatgatgagtaatacttcctctgtccactgtcccactgaataagacgcatcggcaatttaatatttatcactttaaatatttgaccaataattattttattacaagttaaattttatttgatgaaaataatatcattgaattagcatttgaatgtcctttcctataattatgattttgttgcaacaagcattgtgatatatttttttagatattggaataaaataacatctcggcctttactcaaaagagttatagccaattattacaaactagcactttgtaaaaaaggaaaccaaactagacaaaataacattatttcagtatattggtaaatatccatccatgattggtaaacagttgcataaccgtcgtttcaagcttacgacatgcaacaattaggaaatctccatcttcatcacatttttataactgtgcccatagacgaagcaaatatgttgccttgaaaatgacctacatataagtaactgtaggtgatttgtcaaaaccctatcattcctactcaaccataaagcccaacacaaggcaaaagctccaacaagtatcagttggctctttttatttacgactctctgacgccaatcataaaaaatat

SEQ ID NO: 30052 - DNA, 2357 bp, Oryza sativa
accagtcaatttggaggtctgaggttgcggatctggtctgatcgttggccctccacctccctgagcggtgtgttggcgaggagaccggcgctgagtgactggtggatctgacttcatcaatgcatattcctgaacaagatgcttccatagttagtcaactcagcatgaagataaaattatgttctgatcacggtttgagggtttccgatgcatacctgtggaggcggattgaatgcattatatggcacaactggcagttgatgagagtagctgactacaattgcatttgagaagattttatacatcctctccttcatgattttgaaatccagggaatctggttcttcacggttgggatcatgtttgccgtcgaactcgaatgctgtgcgggatctttccttgattggcgctagtcggcatttgatgaagtgccgagtgatctgctctccctgtaagccttgttctttaagatttaacatacgatccaacaactccaaggcttgtactgcttcatctccgattggaagagagttccaagtatcttggtacactggaggaagacaagagtacccgggaagagcaagctcgggattctgaacatagaaccagtttgcatgccagcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggatgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaaacctcaccgtgcgctggccgccacccgatgatctccttggcagggagaacgccgtgcgccaccatctccttaagattttcctccgtcacgtcggatggcgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagctgtgaaccctagttcgccggcgcagctttacactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtattatatgcctgttttcatggtaaatagtcatggcctaggctatttgacttatttattaccataatctttataatacttgatgggtaatctttagagtttttatattcggatgcctgtcaagtgtgttcattcgtgaactttttagagtgtaaaccactcggatttcttttattgtggctaaaaagcagtcggctagcatgcctatttaggcgccgcgtgtgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagaaggctatgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacacccagagacttagtcggttacgactggattttatctgtatttcatattccggtaggaatatagaatatcttttgtaatccgacaccttccatatataaggggggtcccggcgctctaggg

SEQ ID NO: 30053 - DNA, 10718 bp, Oryza sativa
ttaagtttgtttgaatgtccgaaaatgtgttacaatgtctcaaacctatttgcatgagtggatatttaaaatttctaaacgatatcagatagacacaaaacctatataaaagttgtagatatagataagatctacatttttctacacttttcattttatcttatctatggtgttaaatatggattataagttcaaatgatagtggtctcaaaacaatagcatttgtttccaagacaagaagtgtttgtaggtgatatggcaaggtgactttgtgtgaagtgagatgtcttgaatttgaatttttcttgacacatttgtatgaatatggattcaaaaattatgtgacttttgggaacgagagtgtgattgtataggtgcctaataaaaataccaaatattttttttgactttttagcacctgaaaaataaaaaacgaaggtgtgttggttcaagaaccggcaccaatgagcattcatgtagtactgcgagcagatttaggattaattcttatgacgagtttgaagataatctaccacgtctagattgagtacatattctcattatgataagtaaatatttgaagtggggtatttacctaagaggaaaagcacagaaaaaagaagaagaatatttgagtcgacgagagggagcctcactcctgtctagatcacaaggtgatccaattttctgacaaattttgctaccatcatacccaacataccagtaggttattgggagatccaagtactttgtcttgtgcactagagttttgcatttctactagggttacataaatttatggcagcatattcaggattttattccaatagcgagtttgaagtttgtgcatcatgtttcgtgtctatgctaagttcacaccaatggtaagtttgaagtatgggtcatctcttttctatcgagggtactacatgatgttgtttggagattgaagatttttatggaggacactacggaacgggtgcccgatttttggagaaaaaaattgggccccctaagcatgcatgcaatcttttcttctgggaaacctccacatgcatgcacgcagtcatttcttctcttccacatgtgaggtacatgcaaacttctcccatccccttgtctcttctcccatactcttaattagcaaattataaaccattttttcttatgaaatacttatccaatttgtgattcaattgcaccgttgaatttgttgcaattaaatctttacaaagagatctcacatgattatattttggagaaataaaacatatgtaattatattactaattgaaacatttttattataagtgggacattgatttgtgacctctaaaacaatacaaaatatacattgaaatattgaaagaacaatacgtgcaagatcctaaatgatctagtgaaacatctgctgaaatgtccaaaaaataccacgtgtaaaatttcaaatgagctagtaaaatacccagtgaaacatcacaaaatacatgctgaaacatccaaagaacaccatgtacaacattccgaataagctagtgaagtatcttgtgaaacatcacaaaaaaccttctaacacattcaaataacatcacgtgcaacattccgaatgagctagtgaaatacgttctaaaacatcacaaaatgccttctgaaacatccaaagaacacgacatgcaacattccaaatgacatagtgaaacatcacaaaatacctagaaaaacatcaaaataataccatgtgtgcaacacttcaaaatgacctagtgaaacattagctgaaacatcacaaaatacctcctgaaacattcaaagaacaccacgtgcaacattaaaaaatgatacagtgaaacatcagccgaggacatcacaaaatacctccttaaacatcaaaaaaacatcccgtgtaacatttcaaaatgacctagtgaaacatcattaaatacccattggaacagtaaaaaaatccattataacatcacacggtttgaggagagacgcatgagaatccgattgttttccctacaatcaggcgtctggacaggagcgtttcggatttttatgctacaaggaaaattcgtcttaagatggagattgttaaatatgtgatccaaatttcagcatgcaatatgttcagattgtcaaaacttggtggtacatttggctacaaaggaacgcaaagatcttcagaggagaagaaccggacatgcaaaggacttcacaccagatcatccaagatattcaagaaagcagttttgaattccaaccgtcatgagtgtatctcttcccttctcaaaccaggatctatggttctgagatgattctaagttgtttttccgcattaatcgtgtaaaccatacttttctctccttctaatatattcggcaatactcttgccgctttcctttcaaaaaaaaaaatagcatgcaatatgttcggattagttttataataaaacacttgattagtttcttattatgattgtaagtcttttcctactaggacttatagatttctcttttacatgtctcttgtaagctacacgagaagggtgcgacaacccagtgtgtcgtgcgtttgtattcaacttctctatatcgatcattgctagtcggtgtccgtggttttttcccgtaaggattttccacgtaaaaatttgtgtgtatgtgtgcgtgtgtgtatagaactactatgtggcaccttaaggtgctacgtattaaatggcacgtgatacagcccccagccccacccactgctcaaccccccaccactgccgctcccaaccctgtcccccaccaagtttatagcatgcagttaaaattttactcactaacgaccaatctcgatcccacccctgcgccccctgcccccactcctatagtccaaataattttttttactaacagtgagatagtttcttgttgtactctaacgatgtcagcatcttgagttatttttttactctatgcgcattaaattgttacagaacgtagagaagcgaatcttcaggaagtagtcattgcaaaaccgccacataacagtgatcacgcatagttatcgtcttctcctaaatatctggatcggcttttctcttgccacagcaagcccctcttccttgtgtcgcgactggctaatcggtgatcgccagcaccgccgcagttgctaccggtggttctctccctacgacgaccaggtaatgcgctatccacaatccgttcatcttttttttttctgattttatctccacctcgtagccggtatctatgatggacctcttcgtagctagcattgacgactgcttcgctccaccgccgccgtctccatcatccctgatgacaccatgtgacgaggcaggatgacggatccggccatcgtcggcccagatccacgagcccattagcaaggtggcgaggagaccttccctctacggtgctgaggaggatctggttaaatttttgtctatttctcaaggaaattaaaaagaagtcaatggcaagccataatggtttgcttccaccgtacagctagcatgccaaccactttctgtacatacaaccaacctattcctttaccacgcgcgtctctccaggtccccccccctctctgtctcaatcccaatcgattttcttctacccacgtgggtcccacaccgccacacgtcagcctcttcttcccctcccctttcaacctctcttcctctatcctctcctctctcatcccctctcttctctgtatctgtccgctctctcccatgggagcagccgaccagaggggagcagaataggcggagcggcgccgcatgaagccggcgggtagagcaagcaggcgaagtggggcgacggtgggcagagtggcaacgtgcgaagccgccagcgcggagcggggtatcggcgaatgacaacgacgattgcgacgagttcgacgagaaggaggaggacgcgcaccacctcttcctcttccccgtctccttcatcttcgcgccgacgaggacgtgacgtgacgatgacgctggtcctccccatcctcatgcatcgcaccaccattgctgccgacgccacggacggctcgcttgctcccatgcccgccggccggcggcgagcgcacgcgaatagggaggaggtagggagggacaaccagcacacggagagagggaggatgcggcgcaagagcaggccggggctccaagtccgccgagtccacctccacggcacccggccctgtctccgcctctgtgcccaatgccgcggcgcctgcccgcacggggcggaggcgacgcagcgccgtcaatgccattcgcgaccgtccgccaccctcaccttctcccgcgtcgcagccgccgtcgcctcctcctcttgcgcctcgccctggcggcctcctcctcagccactggccggtttgcccagagaagagaagagaagagtaagagagagagagagaggaggaagggagaggagggggaagagagagggtgcggacgtggcatcctgacatgtgggctcatgtgggtcccacactgactctgctcatgtaggataaaaccagggtcaaaaccaccgaatgacctaaagtgaatggtttttataagttgagggatgtcatatatttggttttgcgattgggggatgattttgtaactcgatgacaagttgagggaccttgggtgtactttgattggcaaataggcggcccaggccattcggcccctttagtatgatttgattttctttaggatggagggagtgcctcagattgttgctcgttaattgccacattgccgactgtcaactcttcgtcattgttgtcacactgccgaacgactgcccagaaacacttgtaaaaaaactgttgtttggtcgcctggactggtatagttccattttatttttaggacaacgaattaccatccaataaacgctatgcactagtatctctatagatctgcatgtttcattgttcataacttcatataggtgccgaaaagctcgtccaaaagtcaacaaacagtcaaaacgacatagtatttattccacacattcatgtttcatcatgtgcatgcacatatttcttccacacgtcccatttggccatgtcgtgcatggccagacctggcacagcaaggaccaagaacaagctccgcccggtcggccacagaagaagatcctctgacgtgaaatctcccttgacgtggtcactgacaggtgggctcgcgagcggttgggcccacatatcagtcaccacgtccctctgacttcatgtcagcggatcctaatccgttggccatctatttttttcacaatgattatcctaatttttctcatgttcttcctatttcttccttatttttccttgccatcttttattttctttcttttttttcctgttcctattcttcttattcttcctatttttggttttcccaacttcgatttcaaatgtcatgggtcacgtgttccaacagcgttgctaggcggcagatcatctgcataagcacggcattgacagacgctcgacctgcccattttgcgctcagaagcatgaaatagcgagccacatcatgctcgactgtgtgttcgctcgttaagtttggcactacatccggtctccctttggcttgcctaggcttgctcggcccctccgtagcgattctcttcaggtctggtggccggtagatagggcttgcctgccttagcatcttcgtaaggccttcgactctctggtcctcttggtttcctacagctttggaaagagcggaacgctagggttttcgattctttctctttcgccggtctcgatggttttccaatacattcactaggaggttcgtctctggtctctcgctggtcctgtctcgtttgggagccttttgggagattaggaggctcctccgccaccccctcccgcactactagaaaaacaatttttcatggcgtcacactataattttcactggcggttatatgctaaaatcgccagcaaaaacatgaggggtggggggtataggactgccagcgaaaaccgattttctctggtggccacgttaagacgtccgccataaaacatactctatttttcgtggtggatctcttaaatgtccgccagcgaaaaccgacgttttcgcgtcggttttcgctagtggttactaaacacttccgctagcgaaaaaacagagcccgctaaaaaaatttggcatcatttaaaatcacgcgcgtgctgagatattttcctttcacccacccactgcctctctctcctctatctcctcctctccacccacccatccacctccctctcctcctcctcccccacctctctcccctcctccttccctgctcctccagcttccacctcttgtcgacgaccgagatctgggaggggcgcggcgccgacgacgggcgggaggggcgcggcgcggatgtgcacggcgacaacagcgactacgacggaagcggtgacgatgatgaccacgaaggaagcggtggcgccgcgccctcccatcccctcctctaccctctcctagatctgtccgaggggaggaggctgccgccgggaaggacagatccgccccggcggcggcgcggggcgcacggccgcggggcctcgggcggtggagcacgaccgtcggccttgacctcgtcacgatcgacgctgcgccgtggggagcgtgaagccgacgccgccaggtcacgggcggtggtgctcagatttctgtagatttgtgtggatttgtgtgcatttttgtggatttctgtggattgtgaatggaaaattttgactgtgaatggaaattttttattataaattgttcgtgtaaatttatgtgaatttgtgaatcgaggagtggatttgggaataatttgaaccggtgttgacggaggcgaacggagcagtgttgctttgtcatttttttttaacctgggccactattttcacaggcggttggtataactcaaccgccagcgaaaatcgtttatcgctggcggccagtataacacaaccgccagcaaaaatcaattatcactggcggccgataaccgctagcgaagatcttgatcttcactggcctttgctttgtgacggtaccaaaaaccaccagcgaaaacccaaaatggccgcaacgaaagatggttttcgtagtagtgccgctagatacgagcaacaacttctagttttgactcttttcccttccgcaatctttttccttgtaaccgacagcgaccagtttggtcgattacgctgtataactaaaactctattttttttctaatatactaacgtgcaatttcatgaaaaaaatatttcatgggtcacacgtgcacgtcctggctcctcttcggccatatcttggttctggccttaccacgtgagccgccacggcatatccttgtcgagcagtgcataataatcaggatgtacccatcaagccatgggctagggtgggctgaccccacatgcatgcccgtttgatcacaaatactaattgttttgatataattcatgtcaaattgtattttttttgttacttatatcttctattatattattaaaggaatagaaaaggaagtctccacgttcgctttcatggcctagaaattctcacattaatcggagaaaaagaaaaggcagagtccatatagaaatacaatttaaaaatagttgaaattcggaattaaaaaataaggaatattagaagaggagactagagtccatatagaaatacaattagaaaataactgaaattcggaattaaaaataagaatattagaactagagtatagagtacatatagaaatacaattagggaatagcagcaattcagaattaaaaataaggaatattagaagtagagtatagagtccatatagaaatacaattaggaaataactgaaattcagaattaaaaataagaaatattagaagtagagtatagtctatatagaaatacaattagtaaataatagaaatttggaattaaaaataaggaatattagaagtagagtatagagtctatatataaatacaattaagaaaaaaatagaaatttggaattaaaaaataaggaatattagaagtagagtatagagtccatataggaatttaaaactaactaaaatttggaataaacataataaaattaaaagtagagtttagagtccgtataaaaatacattttacaaataactaaaattcaaaattaagaaaaacatttgaagaagagtttaaagtcaatataggaatacaatttagaagtaactgaaattcaaaattaaaaattagtttagagtccacatagaaatacaattagaaataataaaaattctgaaataaaaataaataatattggaagaagagcatagagtcaatattaaaaaaaatattaaaaaatgagtcaatatatataatttacaaataactaaaatttgatattaaaaataattaataactaacacgtatataaaatacaatatgaatattacatattagtagttttgtaaagttattgcaaaatttaaaattatgttgtcattttaatatatttgaataatataatgagaaaacatactattgtcagggttatggataccacatacctaatagtagttgactaaatctcggcaggacccaccacataccatgtcttatacgaaaactgacttcagttatggagagagttccggataaggaaagacaacaaaagttttacatggaaacgacaaggactactcggattgtatccatattggtttccctacttctacttggacaatgggacacctatgggtataaatacaagcccccctaggaggacacggggacacccaccatgacaggatcaacacagtcaccacgatcgacacagacgaccacctcaatcaacaaccaccacaatatacggaacaacagaagccacaacatacaagccaacacatgctaagacaagccgccggatatcgacttcagggatagcatggctattcccctacggtgtctccggataccgtcaggagagacgaaagcgctatctctgatctcgccggacacagattcgaggaggaaggctaccctgttgtcgactacgagtcagaccttcagaccgacatgtcgacaacagttagataggctaccccacatattgtactggtgtgattatggtgaataaaagcaataccggctccggccaacaggatgtagggttattacctgacaactcaggggcccgaacctgtataaaaatccttgtctccgtctctttcacctcagtctcgcgtatattctagcaccgatgatccccatactatgcaaataccagaattgcgacatcaaacgtcgacagtggcgcgccaggtagagggattttggtgcttcaggatttcgacgagatgggtttaagagatggattctccaatagcaaactactcgacgacttcggctgtggagatctaacccgaccggaacatgtcttccgacaagatcagaaccatcatcgtcatcgacaacttggtctatcgagatcacccaagcctcaagctccgcgccgtaccaaaagatgtcagatcatatgatgtcgaacgagtacgcaataaggtaattggtagattggtttttcaaattgatctactaatttcgtagatacatccggcatgtatctacaaaggtacgtaatattttatatgcaatttatcgtacctattcagatgatacaacattatcatatcagcaatttattatgtttacctagagcatgtttcttatacaacatccgttgtgcgagtacttccgacgatagaccaactacggtctaacgctgggggctcactccgttctcttatgtataaatcatgcttgtttacggtttacataatgccctgatatttacatctgcttattgtatcctgataatactagaagatccatgcagttctttgagtacatactcgatattatctgctatatatcttgccttctagaaaatatttttcaagaacaattgagcactcgagtaggttatggtcgaatatactccattatcgagaacattctcgacaaatgcggagttatcgcacccaacctaccaacaaagaccgacgacctatctcatagcaccggccatggctggactacttgagaaaaggttgttaacggataattccttgcgaacgtcgtcggcttgatcacccgacatgattgcgaacggacatccggatatgctataagttgggtacgtgagtcatgctggccacatgagatacacttgcaataaaccaactctagcacttccactggtgttcgagagataattctgctcgctcactggttctcgcaccagtacgtagcaatctctcacaccgcagcttccattggtgttcgagagataattttactcgctcactggttatcgcaccagtacgtagcaatctctcacaccgcaacttccattggtgttcgagagataattctgctcgcacgctggttctcgcaccaatacgtagcaatctttcgcaccttaacttcagatggtcgaggtatgactacggcatcgtagcggtcctcgcaccatgacttcagatggttgaggaacagctacgactggtcttcgaccggcagcgtagtggtcctcgtaccacgactccaaatgatcgagggacacctactcaccggttctcaaccagttgatcgtagtaatctctcgtacatttgcttctagtggtcgagttacgactact

SEQ ID NO: 30054 - DNA, 483 bp, Oryza sativa
tgtcctttgggtgctttctccagccacttgctctcaatggagtgccatcttgtaacttacctgaattactattttcgtctacaaaattacaaacagaggaattctcagtaatccatggctcttcaaccatgagcatatgcttgccaactgaattactttgccagaacttgctaatctgttcaggaacttctttaatctctgggatctccgacaagagctcatctacaatatctccataagtagtaaggcttggtatagacgatctgtccagccccagttgagcatatggacgcagatgaaactgaaaaggagaacccactaatgtaataaacggcattgcactgaactaaagaaagtttaaccagcaactggtcacatagatgatgcaaaattcttatgatttatttatctctccttcctcctgtcagcttcatttttatgtagtatctttcatgagaagaatttctccttctcagcttctag

SEQ ID NO: 30055 - DNA, 530 bp, Oryza sativa
gatgccactgtactaatacatgaggtaagatgaacataaatcttttggacaactaattccattattaccaacttgatatccactgccatttccatggtggctatgattctatattcctcccttttgagtgcttgccatcactgcttatgctccaaggtggtttccaaaagttcaatatattatttgagttatcagttctgttttttctgtctgtcctagtgtcctgtagtaaaatatttcactctccaattgatgtggacgacaactggccaagtgcatcaccaactaaccttgcatgtttttgtatactgttagctgcagaatgttctcttctaattattgatgatattaatcactagttaatggcaataatggtattgcgtgtctaaactgtgcaatactcgtttctccaggcaacatttgaggacagtatgaaggatgaggcgatcgctaggaaccatagtacaacaaaggaggccatagcagtaggcacatcagccggagcataccgtataatcttgacccacttt

SEQ ID NO: 30056 - DNA, 8189 bp, Oryza sativa
atcaaacattttcgcaagacatgctttctcaactagagctggcagccatggtattactcgcatccagtataataacagcaaatccatggctatctaggattttagcccagcaatgttccagagcatatttgcctcactttatttttagaacgaggggaaaaccctaatgaaaatggaaaaaatattaagagagttttactgtttttataaaaccttggaaacatttataactttacaaaaaagaaacacaaggaaactagtgctcaccgattaatgtttttctgcttaaaatatttaagccttactagaacatcttaagtccaaccaagggttattttcgagagtaaaattttctggtctaaagctttggcacaaataatggaacaagccttagttgagaacagcctaaagacagaaagaaagtaaaaaaatgaaatgataaaaaataattaactccctaagagcaagggaggaaatctacatagcaatttgaacttaccaagtccaattgcatctgagcctttcatgattctgagcctccggcaagagtcggtgaacatcctgtgattgcaccaaaagtaagacaacagataaatgataaattcagtgagaagagcaacactaacaatcatattcacagccagaattgctattttagttagatggtacaggtgtacttactcccatggaacatcaccaaccagcatccagtcaccatccttgtcttcgtaggttaacacatattcaccatctttctggttctcagcaccttccttacctggtatcacattagaccaactactacctgtcagtccaaataaacaaatagcacaaaggctccttcatgctaaaatccaccaaaacctacatagcgttgttatttacctgcatattcatgatttgtgatggtatgatacaactgctcatgcagaatttaccattaataaactgagataatgttttacccttcattgatgattatgctgaaaatacaggtaatgcatcctatgcacctcagtactttttattctgtgaggaaatgcactttgtataactctaagatagataagttaaacgagaaatctaacagcaagtatcatattaataaaacaggttgtctgcatcaagatctgatcagcttatggtacatgaatccagatacaaactctagtctacaatatcacagaaaaacaaaataaatcatgaaaactagaatagaagcatatctgcgtaagtatttcgtctacaaaatatgcagaattagtactccggtggttagtttgcaccacctgatcactagaaaagatcctaaaagggccacattatacgtaatatgctacaaatctcatgcaaattatattcgtagataactagcaaggtcaaactttggagggattccctacataatgggtggctggttgctttaataaacaaaatcaggttcagtcaaatgtttggcatgccactgaaaacaatcctcatgtgctctaataaacctgaaatttactcgaaatatactaacgaaagccccactgttttttccatctaacatgatgtgtggaggtgagtttcagcccatcaagattaaattatgttgcagcttaaacaaaatagcacccgagaaacctcaccggtgctgaagccaatgaacattttctcgagacccaaagacatgtccttgtagttcttgtaagttttgaggtccaccttcctcagatatggtgcaccatccatgctaaccttgacgtacaggaaaccctgaccctgcttagcatcaacatcctccttgttgctctttatctggttggttgccatcgtgttcttgcggtagctgcggattggtggccatcccaccacctgagccctgcacaagcacatcattgcaaagtaataattcagtataaatgtataagaacaagagaaaaaaatcaataccagaaagaagaatcagcaataattgttcaacggtgggtcgacaaaaaaaactgaaaacgaccacacaactgatttttctgtgaactttgatctaataggggaggaagaaatttgaccatttcaaaggtagccagctcaaactttcaaatatcaggttatcgcaagtattttaatccttcaaatgagaaaaaaaaagagaggaagagcacgcactcacaattaatctttgggggcaaaggagtataaatttagagggaactagaaaaggaactacgcaaagctgaaaaaaaaaacttttgaacggttctaaacacaagagatcaagctaaatccaaaacgcgccacaaagttaaaaaagaaacaaatgaaaaaagcaaaaaaaaatgcgaattttgccacccaatttccacggaaaaagtctcttttgcgaatccacaaaagagctgcctcaaataaacatggcacagattgcaaatttcaccttctcgcaggcaggcctaactaaatcccccacaaaaaaaatctctttatgtaaggaaaaaaaatccttcaaactcatcacccattcgcgctccaaccacaccgaccagcagcaaggcagcatccaccaccaccaccaccaccaccaccaagaacacgacatggcaccaagaaaaaacacatgaagaatcgacggaatccgcaggagcaaagggcacctacttcgcagccggctgcggcggcgcggcgaccttcttgtcctcctcctcagcccccacctcctccccctccctcgccgccttgcccttcccggcggcggcagtgggcggcgtcagcgcggcctcgtcggggaacacgcgcttggcacccttggcgggcagcagctcaagggtggtggcagtggcagcggcagcggcaatagccgcagggcggcggtccggcgactcggagccagggaggccgaggcggagctcggtgcccttcaggtcgacgtcgtccgcgcgggcggcggcggcggaggaggaggagggcggcggcggcggaggcgagaggcctatgtagtcgagctcgaggggcggcgacatggggagcggcaggacatgaaccgggatgcggcgggtttggattcctataggagggaaggagggagatgagatgagcaaagtgtgtagtggtggtggtggtggtggtggtggaagaggctagagtagagtggacagtggagaggttgctgctgctgtgctgcctacttgatgcttctgttgctcgttgttcactgttgtttaatcttttaccagtgtacatccttccagtgtcttttgaatcgtacaaataaaaaaaaataaaagaattaaaaaaacacatgattctgatagaaatgtaagtgtaaaacaaaatattgaaaaagagaggagaaatatatgaatgatcgttagattaggtcataggaaaaacacaagaattgaatgagagttagactcaactaaatttttcaagatgttgaacctcttcctaaactctctcctacatgcaatgaaccatttcgttggaattctataggatttagaaaactctaatcttttgaatcaaaggtccaaatagaaaaagatcatatatgatttaatttaatcctatgaaattccttcgttaatcctttgttgatttaaaagggtcccttactatttttatgtgtccaatttacttatctcaatacctttgctttgatacatatgaattactctctaatatagcaatttctaattatgtatctggacatatcgttgtccaaataaatatgattagataaattcttttacgcttccttaaaaaattatatacatatacatagctaaaatttgttatattttacaatagagggagaataatgtttgaaaagaaataattgtgaggtttttaatcaatccgtctatgtagatatgtctttacataataagctgtattttagtgatgaaataataaagaaaggactgttttataatattaaaataaataaagaattagtaaatgaaaatgtatttataatacagttctttaggtgaaagattcatcgtcatcacaattactcattctgtttcaggttgtaagactttctagtattactcacattcatatagatgttaatgaatctagacacacatatatgtctagattaattaacatatatataaatatgaacaatgctaaaaagttttataatatgaaacggaggaagtataagatatcttttcgaaatgatggtgtgcaagataggtgtggcatgtttataattgtttctagaacattattataagatactctttgacagcttgctattttataaaactaatttatgtggccagtgaggcagtgacccgaccgcaaggcaaactggtagtactcttttaatataggcgtgggtaaatatatgtcgtgacattaactaatcatgccaagcgtggcaatgctagttcaattatgctacccacatttcttgacaatctttttttttaaagaaaaatagagcacttgttggatgcttaattctaaatcatcgaaacatgatcaaataaataaacctaagtgtgatattaattattaaatgatccacggtggtcgggaaactagatatattttgaggattttagatttattacttagaagttgtttaattaaggacttgttcggcggccagttgctggaatgtactccatccgcctccataaaagtgaatttaagactggatgtgacacattacaacgactctggacagatgtatgtccagattcgtaggttggttttttataggatggagggagtagcttctaagcagcactagctgtgaaacagcgctgcaatataatcaacagccgaacacccctaattaagttaacaaaataaaatgttcgtttaattttatagtttttttccctgcatcatctcttgtttaacaagtttatatcaaaggttgtttgaaaatatgaattacattcctatataccagagatcagaactcacggtatggagacccatttctttttggtatcaatagatccgcaactgtctggacaacatacaaaatatgttaatatagtttcatttattgggttttaagatatgatcgacaggaattaatttcatgacaaaagatattatttatcttttccccatcttttgctacatactttctccttttaaatgtttaacatcttgattattagtcttattaaaaatttatctaagtattatttattgtgttgtgatttgttttctcatcatgagtactttgagcatgacttacaaatatataaaagttttaaacaaaatgaatgatcaaatatatgtcgaaaggtcaactgtgttaaacatagaaaaacggatagagcatgttcacatgatgctctctagctactactggtactggttttccagcctcaattaaatgcatgtagatgtaaccaagacaggtaggcttccaatttccctttatatgaccatatgaatgcatgttgcaggctggtttggtcgaaacaagcaacaaggccaatgcaaaattcagctttggccccattcggcttgacaacttgtaaagcccccagcctacattgtttggtactgaaagtactgaagatttggtagatgaatgcgactgggcattgtccatttgataagaattcacaaggagggggacattggatcgaccctctcgccaacaataggacatatgtgcagcttcttgatcaggccttgatgaacttgatttcgttgcagtacaactagctagtagacaacaaagggatatatatatatatatatatatatatatatatatatatatatatatatatatagccccactactgaaggccatactgacaaaatagccccactactgaataggcgtaacggtatcaggatacgaatgaagcaaccaaagataatttatacgtacaatattttttttaaatagatatattaaataattgtttgaaagctcgggttgaagaataaagcaatgaacgaaaaaaattcccaaactcaaattaaaaaaaataagttttaaatttaaatttttggtagtcattgataagctaactagcaaacaaaagacactgcagaggcttttcgtagctaacacaactgtgtgtgtgggctggctttccaagttccaacagagatgacacacctagaatatatcaactgaaatttagtggtgatcgatcgaccagtgtctattcgaattgcgatcaggtacagtcactgtacattagcaactgcacacaacgtggagcgtctatttttatgatcaacggtccagatctaagctacagtagctatgtgaatagtacctgcgctacagtgttactgctacagtaaccatgaacagtgctatgctcgatccaagccgtccgatatgtatccgacgatgaaactgctactgcttaggttgcagtcgcaactattgcgactgcacccgatccaaatcctgtctattcatggctggaatgagatgatctaactcgacaatgttcattccctttttttttttgtcacggtacagtatacgtggcatcagaaatacagagtcacgtacgtgtaataacgtatataattaatcgatcgcgtatagaagacgaaggacacgcgctggtagggatgggcaggcaatgtcgtccctcaccggccggagaagatcacaacgacgcaccgactgacggcgacgttatggccggtcggtcgcgcgacagtccatccgctatctctctttttttttttgaaaaagtacggattacccatctaagtatcgtggtcagccaaatttcccccctgaacccagaaaccagacataactcaccatgaactttcaataccggacgaattacccccctcgacccaatcaagagcggttttatcctatgtggcgtacgcgtggcaacccagtcagcattttcttttcttaaaagatgctggggcccacctgtcatatactctctcttctcttccccttctcgcgctctctctctccctctctcggcgaggacacagcgcggcggctacaggtcgtcgtcgtcgcgctggacacggaggccgcggcggcggcggtggcgtgggaagagccggcggcggcgagggacgcggaggccgcggcggtgctggacacggaggctgcgtcgacggcggcccctccatgtgccccccgcgagatggtcgtagcctgcgtccacggcggccccccgccatgtgcccgcccgcctgcacgaccacggcactggcagccacgccaccataccgtggagcgctagcaagagagaaggaagaaaacgagcagaagtagaagaaagaagaaaaggaggaaaaaaacgaaagaaccaatgagcagcagcacaagccgtcattttggtccgctacatcgacatgaccgctgtgcatgccgtccggctgccgcaccgcatgccgtcctggctgcgtctcgccgtcgctcaaccacgcctcgccgatgcacggccgtgccaagcgccatccggcggcaccaccaccgtcaagccgggggaggaaaggaacaagaaccagaaaaagaatatgaaataaaaaggggaaaagcggggaggcagtcagtgcccgtcgccgtgcgtccgcgcctagcgccacaggagcccagccgtctgccgcgtcgaccgacacaaggtcgtccgtcgccagccaccgcaccatccgccgtgcatcgccaccgccgactgcaccgacgcccgggcgcgccacgcgacgctcgccttccaccgctgcacggccgagcgacgccctttcgcactaggaccgcgcccgcgccgtcttcccgcgtcccctcacgaccacccgctgccgcttgacctgcgtcgcgtgccgctgcagtgggccgagcgccgccgcccaccacccgccccagcacgccgccgtgtgcgccgagagagaggaagtggggaaaaggggaaagtggagatgagagagtatacatgacaggtgggccctaccattaaaaaaaagaaaatgctgactggattggcacgcgtacgccacataggccaaaaccgctctggattggatcgaggggggtaattcgtctggtattgaaagcttagggtaaataatgtctgatttttaggtttagggggtaattcggccgaccgcgatagttcagggggttaattcgtactttttttttctttttttttttcccatggaacaaagatgtttgtcaatttaagtatttttttctcataggttaattggatccataccat

SEQ ID NO: 30057 - DNA, 5404 bp, Oryza sativa
  unsure (1)..(5404): unsure at all n locations
attgaaaaggtaaaaaaccgagccgaacaaaccgagtttgtttggtttggttgttcggtttcaccgaacaaaccgggagaacatcttccatgaattccgaagcacacgataatcaaatgaatcgctagatggttcataaaaatcgagaggggagaagttgctttctgccctcgcacatggtaggagtcataaaacttgcaatctgagcaaactgccagctatgagtgatgtgtgcatgtggcagctatgcagctgcccgaggcaatcgtccacgcatgcagtggcagcggcagcatcgttaaggtagccatccaatccagccatgcgcgtgcaaagatcgatgtcgagatgtcgatgaataggcttgaccgcttgagaagatacgagtagtgttaaactaatgggctctgtgccttgtttaggagatgttgggcctttcatgttaccaggctgggttgctgggatatgatgtgaacgtgtggtttcggttttctcgggttgtttggttcgtgaggattggaaaccgcagaaaaaaccatacaccgaacaaatgcagaataaaaaccgaaggataaaccgaagcctgaaaaacccgacacttcggttcggttcggctcgggtcggttcggctttcagtcttcgggattttactgcccacgcctaatatagatacatgcacagagtatcaggaaataataagccattgcagcagtgcaccacatgcgtgcaagtatgaagatcgcttgtgtttgtagttcgctgcggcatgatatttgttgttgtgccgcttttcttttgtaataatcgtaagtcgtgtgcatcttaatcatgcagaggctgggactggtcttagagtaattgtattgtcttgatgtaattgtttaagatcaataaagcttcctttatcttaaaaaaagtgcatcacgtgtacctcttcaagaacctttgcaattttctctgaagcctttctaatatcttcagtagttttagcttcaagaactgaaaataatcaatatagcacaaacattagcttccaaagttaccaacagcttatttcatcaagcatatttgaaaaataaacagtatatctttaccaacacatgtttcctccttagaagatggaaatataattttgaccccagtttcatcttcaatctgcttctgcatggttccactgcatgccaaagaatacgattgattctcagtcacagagagagacaggccagcattatcctcaactgaggatagttgaggataatgcatatctgaaacaggttcaagagaccaatacccttttcctttcacaaagcgcatcagaggagcatctacctagaaaagaacagaattcatgaatatttgaaaagaatacaagtaaatatcactcatacattgagctttttacagggaaaagatacattaattgtcatacatatccaccgagcatacctgaacagaagaggaacacttttcagatagattggacctatctatgtccttattgaagctagcatcctccatagtatcttctgtggctaatttattttctggcaaggatgcgttgtaggtggaaacttcaataacaacattagttgttccatctgaggctgaattctcttccacttgtttgcttacaggacctgacatctcattaaggtcagctgcatcatgtggaatataggatgattcagaagtgccacccaatgctatacacaaacaagttaaggaaaggaaatttagagatagatggatattatctttacagcatcatagattagcagcgtccaatcatgactagggcatatccaggtttgaatgcactatgatcttgagtcaaggtattagcagtagcaagtagcaaatggggcttaccttttggagcagcggcttctgtggagattggcctccatctctgcacagcagactttcttttcttgtgttttgccgaattatttgaggctccttgtgcacctttcattacaagtgagtgaatactattttgattaacagatccctgtcacggtcaaagtactatcatgtaaaacaccatattgactattgaggtgatgtatcacagaagctctgatgaaggcaaacgcattaaaagaactagtagaagcagataacaaggtgctgaaaattttggtaccgtgcagagttagacaattttcaggcctgcaaggttggcattcgatctcaaggccaggccaagtgctacacacaactcattaagttaaacatggaccggcacagcataccgcagcagatgaacacgatacagagggtagaacacaaagtattagctacggaatttctcaagagagacatggcaattgcatagctgttcaaaaccatacttgattcaatcaattgatagcataagcccctcaaggcataaacttttctcaacaaaatcccccaaaaaaagatccccattactagctccaattgacacactgcggttcaattagactaaacaaattctatcggttcctaaaaccctagctcagatatttatccatccgtatcaataatgtatgtacgaaccaaaacaaaacaaaaataaaacaaccggaagcttcttgtgggggagaacaccgtggggaggcagaggaatcggacctggaggaagcgcggcgcggaacccgcggcgcatagagggcgagcgagccgactaaacctagcaaagacgacaggagaaataaattactccattggtaagagagagagacagaggagctgcaacccccccgacgatccgggcgcttcgatcgaggaaaagattggaatttctactggcttccttcgatcgaggttgttgcggggagagggataacgaaccttgcgagggaagcgcaagccaacatgggtggtgtggaggccgcgcggctcagagacggcggcggcggcggcggcggcggcttccggtttagcctgcctgctcggctgcccgactgcccgtgcccgctagtggtgaggtgagcgacagcgactccacggcgccataattaactgaagtatttgctactcttacgggcggttctaaaggatttaccactgcgtccacgtatcatagacacataaagatctatatgtggcaaataattaaatgtcccactgctttggggttattttggtttgtgctttgataaattttatggtccttgaaagagtacctcacggtatcttaaattttacactattttttttatatggaacgatatttagtatctggatatatcaaaatttacactagaaaggtggtgtttgaatgtctgaagataaagatgaggatgaagattaagtattccacgtaaaaagggtgttaataacgtgtgattaattgagttttaattattacaaacttgaaaaatggattaatctgatattttagaacaactttcatatagaaaattttcacacgaaacacgccgtttagccgtttgaaaagcgtgccattttaatccaaaagtttatctcccactttcataagaaacgaacaggccaaattgtgcacatctcggtattttttcaagaatagtaaaattgaccttgtgcttatcatcaatgacaaattttataatagcaggtttaagtagttttaggagtgccaaaaaacctacgcaaacttttatagtttcaattttttaatcacttgtgcattatcgatgaattttgatatgaaactaattattacccctgccatcctaaaatataagagatgtatgtgtcttatccaataaaaaaaatcttatattttagaacatgagagtgctattttatctattagagtccgcagcctggtccactaaccgtgggccacccaggtcacattgggcctgctctaccacaggcccaactggagccacaactttagatcctgggcctacacacccaaaagactagtttgataggtgaggactacactcacattttaagtcgtgctccctcatcatcaattatcgatgtaggactaaacctaacattaccaatgattttgcagggtgcattttgacttcaaattagaatgccttaggttctctcaggtaccgatatctgttactgatggcaaactgtagacaagaaaaactagtgaccgtatacctttatagacctttgtgctttgtagagtaaatctatgtaattgttagcctatagccttaggttctctcattctttctatcagctcattctttctatcagctacgaaaaattgttcttgccgtgatcatctcatactaattattctacaatctaatattttcctttttgaaattcttccttgtcatcagcttagctaccgacctttttgtaattgtatagtgcgcgctaatttactccgatccaacttgaaccggtgctattgttgattggccattctaataagttcaacattgccaacttttttcttatatacatgattctctcatcacatactctggccactcttgtgctaagtgatagtatgtttttgcactgttgacatctgctttgatgcaggaaaaaaaaagataattcctggtgacaaattaacaagatacagctgcaaccctgtctttttctctgcacttctgcatacatatgcaaattttggttcgtaggcaggtgatgtcttttctctgtcagacatcacaccacaaggcagcatcacgtagaagtgatngaagctctaaagagtcnagggctttctaagggggagatcacatttcatttttgcggttcaatgctcccactgacatgcaggacaagggcccacctgcaagtgagaaagccagccgcgaaaacactctcaaaatgatggattgagttttgaaaagaatttcaagaacgctgaacatgcaatagcacggctacctccagcccagaacagcagcaaaacggcacatgggagctaagatgattgatgagttcaaactgaagatatattagtaaaaacaacagagaaataaacttgcagtagtgtgattgtacaaggtccagaccaacaacaggtttacaacaccatacaggattatttttgaggtactaaacctcataaaggagtgcaggtagctcctgcttcatattaagaaggaaaaaaaaccgaagagttgccacacaggattatgcatggctgcttattccactatcaaaagaaaagacctatatgaactcactcactcaagaatgccacaccaacaatggcacattattggttcagtaatagtaaaccgcagtttcatccttgggggatgaaatggttattccgaggctcgctccgcttgcatattcccgggcaagggaagcgaagagcagcagtagtagtgtccactttcatcaaacctgcgtgtctgacaaagatgaatctcgggaatgagatattcgccccattcatgttccgcgtatttttcgaatatcttccgagcat

SEQ ID NO: 30058 - DNA, 5835 bp, Oryza sativa
tgaatgttgtcacactcagtagtcagtacctgatttgctttccgaccgaggcccatcagaaagttgtcaggctttatatctctgtgcaagtatcctttggaatgcataaactcaattctagtaatctgttataattatttacagaaaaagtcttaaattaatcattcacagtgctcaactcatgcatgcagagaagagaaaaagaaaaggattgagttggtacaaggacaactgcaggtgataagttgtaaaactaagttttgcatgtcaaaagagagatacacttccttttgttcttttttggtgaatcagcatggcgattgggaaactttataatgaaatatttcagataactgttagaaatgaactttggtgttcaatgactattgtgagagaacaagacaacatggaactatccaagaaatttaaaaactctcaccaataaaccttttgtttctgtgagactgatcatccaaaatgaaaattgttgcataagtaaaattcacagtttcactagtattcaaacttctgaaaagaatgttgccattctccaagtttttccacgctatcaataatgagttggaataaaatgaattaagcaatgcaaaatattagttaccatctggtctgctaacattagaactgtcttcagagtgaatttcctgccgcaatagacaaacagatcctctaagctcggcccaagcaaatcgatgacgaggacattttcctctccatctacaccacaccacttaacattcgcaatgccacctggatgccataattttttttccaatcaactcatgatctcatcaaaacagagtgcacaattgcactatgcagaactgtattcagggcctacttcctccttggagagcgttgtagagcttcgcctcataaaacagctggggatgcttcgtcttgctactctcctgataataaaacgagcaatcaaattaatcttctactacatacaaacatagcatgcaactgtgtggtataagccatcaaagaagcatatgaggattgaacaggacaaaagcacaaacaacttgtactcatcaaagaaggaatctgattcaagcaacactaacttttggctctctctctctctctcacacacacacacccctgtgttcctcgtcagcagctcttgcttaaagcactaccaatgcaactccactacgccaagcgtaatcatggcctacccagtcaagtagtcaacctccatccacgctcatcaatcatcatgacgtaagagaataggccaagtagctagccgtacaactaaactaagaaaaagtaaatgcagcggttacacatcctcgatcgttcaaagttgttaaccgcataattatcatcacagcattttcaatcttatcatcagcaacctacaaaggctaaaacaaccaactagtaactggaaattttcatcaaaatcaatcggaacactaattcgtatcgcacggcagaataaacagcaaccgaatcgaaaaaaaaatcgaacagaagttcagtggactcacaatcttcaccgccgcgatctcgtaggtgtccacgtgcgtggctgcagtaacaacaacaacaataacatcatcagatgattcagatgacacgcagtaaaaaaccccaaccgccgccgcaaccctagccgcgccacggaaacgaatcaatcgagcggcggccgccgcttcttaccgaggtagatctccccgaaggagccgcacccgatcttccggccgagcttgaacttgccgccgacgatgcggtccatgcccctcccactccccggccgcgccgcgtgaaccaaacccccgaggaattccggcttggggattgggctaagtaggaagacgacgaggagggggagggggaagcgcaggcgtcgcgcggttgttgcttggtgcggacgtcgcagcggagcggggcgatcgagcagagagcaggtggaggcggcgcgcgcgcatgcgtgcttttgcttccgcctcctgcctttatttctggtggagggtgagcgacgcggcaggcgccgggtcggaaactcggaagaggacgagaaggaaatggtgccgattttatttcctcggcggttggatattataaagggcgtcgtatattcggacattaataaaaaaactaattacaaaatacgttaatagagacatagagacaaatttattaagcctaattaacctatcattagcaaatatttactgccacattatcaaattatagagcaattaggtttaaaagattcgtctcgcaaattagtcgcaatatgtgcaattagttattttttagtttatatttaatactttatactccctccgtcccccaataaatcaaaccctagcttccccaggtagaattagggagaaggataatggaccaaaatatccctaattagtagataagttatattggtctatggttaagtaatgggtattgaaggaataaaatttctcgatctacggaccgatggtaggtaggaagttaagagttgatttattttgagataaatttaaaatctagaagttgatttattttggaacagagggagtataggggtttaaacgttcgatgtgataggatgtaaagctttaagataagatctaaacagggctaaattattatattgtacttctcgtagtattatatttttgggtgcgtggcggcgtggcgcttctcgtatcctgacgtggcgcttcgcctctgtgggtgggggttgaaacgtggcaggtgccacctggacgcgggcagatttttaggcggtgtcggtggtggcgcggctggccacgtcattgtgactggaagtgaagcccagtgggcctcctttgtgtcaggcctgcgcgtagttgggactttggtagtgggcttgcagcggaaaaagtgtaccgaaggtccctcaacttgttagcgggataaaaaacggcctcaaaccgcaaaatcagatatgcagattccttaactatacaagaccggtcacccgaggtctttgatggttttgacaccggttttgttctaagtggcggctgggtcagcgtggggggtagaacggaacaggcggcggcgagcggtgctgagcagcggccggcgaagcagagtggagcaaaggcgcggagcgccggtggcggcaggcgggtgagcacggtggccggtgtcctcctcctccaccgccgcatcgacggtgtgtgccctgcttctcccggtggtcgtcggcgtcctcctcctcctccgccgccgcatccgccgagtcaccggcaccggcatcctctggccggcggagctcgccgctccgttcaactcgcacgcgatgctcagctcctccacgagctactccgccgtttgccccatgagcgccacgatgctttccgccgccggctgcgcgcggtcgacgagcacggagaggagcagtgaaaggttctgcttcagcgtgcggagcgccgggcggatgcgggcgtcggcatggacagctcgaggagctgctcgtccattgcgccgtcgcggaagcactcgtcctccacgccgccgcactcactcggctcgccattgtagtcgtagcaaaacaaatctgtttcagacaaaagcaaactccaaatctttgatcgaacaatgatcttagccacaattcagtgtgatcttgatctgaatcttgattgttcttaccccggtactgcatattgttgatcaccagcgtcggcaagatggtcacatcccctctagcgccatgtccaacctgcatcaagaacagcactggcgaaggtgttcgccagtcacacaccgaaaatcctgcatttttcagcatcaagctggtcagttggtctaacaacctgaacaatctgctccgtcttgagcacgtcgttctcgatgtagtcgtagcacccgacgccgctgcactcgggctccgtgtcccagcggcagaagaagtagcggtcctcgtcgccgtagaacccgggcgtgtccggtacggcaggggcgatgcaggggatgaggcggagcacccgcgccgacgacgtctcctcgatctagtactccggctcgccgtaccgcaggcgctcgctgcggccgccgccgccgacgacgccgaggcccacgccggcgcgccgcaggttgctgaacaggcagaggctgtgcaccgcgctgcccttcctcgcccagagcaccgccaggcgcagcagtcgccacgctcgtctcccgatcgacgccttctgctgcttctgattcgccgctgctgccgccaccaacgccattgccgcaaataccagattcagcggaagaaaacggtcgcgaaatgctcccctgctcccgcgtcgccgccgccgccgcggcgtcgccggccaccggacctcctctcccgcctcgccccgtcagtctcctccccacccgccggttgcccagcccagagccccagagagaaaattgagagagagagagagagagagaggaggaagggagagaagagggggaagagagaggaggctgaggtggacatactgacatgtggggtccgcgtgggtcctgactcagcagccacgtagaataaaaccggaattaaaaccgccgacggatctattgtgaccggtttttattagttaagagacgccggatatctggtattgtggtttgaggacgattttgtatcccgctgacaagttgagggaccttcggtgtactttttctgcttgcagctggtgcgagcaattggatggcccattctagcggcatggaccaaattggtttgagttttaaggcaggaatgtttagttgtagggaataagttcacttgaaggttccttaacttgtcaacgaatccgattttcgttcttcaacccaaaaatcaaatacaacagatccctcaactatcaaaacccgtacaaagcaggtctctcagcagttttaatgatgattttggctgatgtggcgtctacatggccggttttacttatcctcgtcctacgtaacggtgatgcgacactagaagcaaaatataaaaaattaaaataaaaacaaaacatagtgcccatatgtcagtgagacaaaagaaaaaagtagtgggacccacctatcagtaggttccaccatcctttctatccacggacgatgggagaggagcaaccagcgtctcctctctccctcctggccatcctttctcgcagccgagcgcacgcgaagagggaaaaaggcgacggccggcgagagggccggagataccaattaaccagagatatacatgcacttgtgtgaaagtaaatttacaatagtttcaactactagttgattagctaccctgactgtttcgttgtttcgttggagacctgaaattaagcgaaaacatcggcattgaaaatacgcttttctgagggagaaacacaaagagttgtgttcgaattacatgacgaacagtatagttcttccggatgtgtttgaggagaggagataaaggagattggaaagatacgtaaaataaggtgagccattagcacatgattaattgactattaactattttaaacttcaaaaatagattaatatgattttttaaagcaatttttctatagaaattttttacaaaaaaacacaccgtttagtagtttgggaagtgtacacgcggaaaacgaaacaaactcactcagatcaccccaggaaagaacacagtcttaatcaagattaatttatagcgcagtacattaccacgtccagtagtaatccagatgaacatgctagcatcattaacagagtaccaatgtaacagcgcctctaatcaaatcagaagcaactaataagaacatctccaacaacctctctaagccaaattttagccattatagctaaaaaaac

SEQ ID NO: 30059 - DNA, 1729 bp, Oryza sativa
cagctactacaatctcagctccaaatccagctcctccgacgagctcccggcgctgctccggccgccggagtagccgtcgtagctggagctcatccaggagtagtactggggctgcctctgctgctccgacgagccatactggccgtggtgatgatcacccttcacttcatacgccacgaacgccggcgacgccgccgccagccggccggagccgtacggcagcatgccctcgtagtacggctgcacgccgccgccggcggcgatcctccggtgatccgccgcctcgtagcaatcctgctgcaacggcggcaagtggaagggcggcgaggcgaacggctgtggctgcggcggcggcggagagtacggcgcgtcgccgccggcggcggagcggagggcggccaccatctggttgtggaggcggatcttctccagctgcgcgacgccgagcccgcgctgcggctgcttggcgaccttgtgctgctgctccgccgcagccgccgccgccgccttcttcccctccgcgcgcctcgccctgccgccgccgccgccttccatgcacatctcgccgccggcgtggctgctgcccatcaaccagctgcaacaacctctacgttctcgtcttctctcttcgagcaatgcaaggtgtagtagctgcagcgatggcgaccagctgcctatttatacagagcttagcttagcttagctgaagccacatgggaggaagagctggacgtcgtcagagcaaattaagctgagattaatggatcctaagaaagattcaggccgatctgctccagcgattttctatggctcgctatctcccaaagttctacttccaagaacgatccctacctagctagctagctaacccattctgccattgcaatgcaagttggtgacttttgcgacatgatgtgcaaatataatactacaacaccgggagctcatcaaatcatgcatatttctatatcatttttgctactccatccgtccaaaatataagcattttttattacacagtcttcaagatactactttaactaacaataagtataaaaataagatattttaattaaaaatagttgcatattacgatagtttgtttaacaataaatctagttacatcaattttacattattgatttttttgattttttttttgctattaatagtcaaagttaaaaatagttgacttgacactataataaaagtgcttatatttcgagacagagggagtagatcagtaatgttgccgtcgttagcctgacctacatatcagtgactaccagttcgcgagatctccgtagcaggcgagattgggggttttgcatataatttatagtttggatatcaatatgatagtcgccatgcgaccggtaaggcacattttcaaggaggccacgcatgtcgcgggaatgcaaattgcagccccaactgcgtataaatccagcacggattggatctctcgatctaacgatcgatcaaattaaactggatcatcaatttggtgatatcgatcgatccaatcaatcatgcgtgtgtgtgtgcgtgcctctctcatgtcttggcctttttcagactgctaatcacacaggcattaaacaattggcaactcgtgtagttgacgcaacaactgcgtaatatatatagtacactgctctgaaccagaaataattaatgggaatatatgaagcaaatgaaatcgtatctagatccttacagggcatgc

SEQ ID NO: 30060 - DNA, 2008 bp, Oryza sativa
  unsure (1)..(2008): unsure at all n locations
gcttagctagctactagctgcagcctcgttgtaggttaactactgaactttaatttgcttgtgctgccaaatgcaaatcagcatcggattactacaaattaagcaagtgtgtccgggaaactaattcaactggtaatctcgctggtattatggcagagatcttcgctgatctcaaactgatatgcgacgatttttctaattaagcaacgacgacgactgggtggatgatcgaatggttttgatcgagacgtgatcttcctaggacacgggagggagatcgatgtgatctgctagctacctcgcacgtttaccgctgtctgaatttgttaattaaccacttaacatgcatctcgcagcactgttcagatatcaagaaccctttgttaattgcgtgctgggatagttcaggatgtttacaggttggggcgccgatttttggaagatctctggtagatcgatccaactcagagatgacaacgatatatttatgtatagtgtggtttttgctggtgtgtgtatgtagtatttgctctctgacctgataattcagttcgtttcgcctttttcttttcattcaagttgtttgattagcccatgcgatcagtacagtgccttatataggcttatagccaactggggcggaacacgtacattatcccccaagaatatactccaactagatgaagggtgtgtttggttgcaagccacactttgccacagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaacttttattggcaagtaatggtaaagtgtggctgggaaccaaacagccccgaacccaacgacatatatataagggtattgctaaatcacattccatataaaactggacaaaataactttatttttcacccatctcacatataccaatgcaaaagcaaaaataatatcttttggtttatcgaactttaataaaactaattttttaccttatttagttccaatgtatttaatttgttctcactttcacaaactctaataaaaaggttacgttaacttattttgggacaaataagatggtgataaatatagttactttggaataactagagtgggcaaatgacgggcttttcctgctttctttcgcgtgggaaatgatgggcttcttggccgaactagcaacgaaaccacaggaagatagctacacatttggcccacgtagtggaatttgcatcgaacaagtccagttaccttccctcaacttacatcgaagttaatcagcatccttaaacctcttatcttttcaaatccgtccgtattgcgattagggatgccaatnaagttcgatgtgaagatgagggacggtcagtggacttattccttctgcatcatgcaaaacagcccgattccggatacatctcatcacgttttgtctagtcgcctcgaatagggcttaagatctctcattttgtgaggaaaaggaaaaaaaaacgagagagagagaggaagcttcagccaggcgccagttgaggtctagtggacagtagaatgtgtgggccccacacaggtcagattcgatcgccaaggcagaggaacaagtttacacgtcggcatcgctggggcccacgttcagttcaatccaccccgctgttcccgccgaaccaggtgtactactactccgtacttcctgagctactgatgagtagggcccacctgcaggtgtaccccgcccattttcgcccttacgtggggcccacaaacagtggtgcgcgtggttagtctaagcatgggtacgtgcaactggggggctgacgtacgggaccggagttctgtcgggcccactgtcagtgacgcgtgggtggggccatggcgtgtgcgtgggggtagg

SEQ ID NO: 30061 - DNA, 4455 bp, Oryza sativa
tagcctttttcctttttgtccatggaaaaaatggttcccaactttccaccgatcgcttagcttagctagctagctttagtggcttgtctcgatcgatcatctattcatcttattgtcgatcagagaccaaccatttcggcatatcgttcgatctatcgcctaactttgctgctagctagccatatatatttggatttatattgttgtcaaatactatatcagattgatcgatcggtgatcggtctatgccgttgctgccgatgacgaagctggagctcggccaccgcggcgaggcgtgggagcccggctgcctccgcgccgtcgccggcgagctcctcttcaccttcctcttcgtcttcatcggcgtcgcctccaccatcaccgccggtaaatcgctcacgactctctctgtactaaaatataagatattttaggtcaagtttttattcgtctttgttattacaagaacaacattaatcgattgtgtatgatgagtatatccgtatttaccacgtgcggttaattattttttttttcagggaaggcggcgggtggggccggcgaggcggcggcggtgacggcggcggcgatggcgcaggcgctggtggtggcggtgctggcgacggcggggttccacgtctccggcggccacctcaacccggccgtgacgctctccctcgccgtcgggggccacatcacgctcttccgctcggcgctctacgtcgccgcccagctcgccggctcctccctcgcgtgcctcctcctccggtgcctcaccggcggcgccgccacgccggtgcacgcgctggccgacggggtgggccccgtccagggcgtggcggcggaggccgtgttcacgttcacgctgctgctggtgatctgcgccaccatcctcgacccgaggagggcggcgccgccggggacggggccgctgctgacggggctcctcgtcggcgccaacaccgtcgccggcggcgcgctcaccggcgcgtccatgaacccggcgaggtcgttcgggccggcgctggccaccggcgagtgggcccaccactgggtctactgggtcgggccgctggcaggtgggcccctcgcggtggtggcctacgaactcctgttcatggacgtggaggacgccggtggggcccaccagccgctgccgcaggagtgaagtgaagccggggaaggcgcgctcacgtgaggtccacgtggcttcgggagattgcacggccgtgtgcgtgcgttttcggccgttgattggtgtaatctccagatggaattatttttgtacgtttgatttttttttccatttttgttaaaaaaaatgggaggcgtgcgtgtaaatttggggtttttttttgtgtgtatgtgccggtacaagtgaggttttgctcgttgaaaatatgatgaataatacgtatttcaaatattgttcgtgtctgatacaataacatatatgagatgagtctcttctacagtactttcctttggcgtgagtcaatgacatataggctcgctaaacatgaagccaatatatcatacacgaacaatatattaacctgctggaagtgcaaagctcaatgtaaatgcaacttacataagtgaaactggtgaagcaagtgctaggattatcattagagattgcagggggttagtgctcttggctgtgtataaaactctgcaccagtgtacctcagcagctgaagcagaatctttaacatgcttagaagggctaaaagaagcaatgaagtggattcatatgtcgattattctggaactagacaacgctgaagttgttcaggcgttaacaaagcaggtggcctcaagatcctcttgggcgatgacaattgcagaaatcaacagtgtgatacaatgtatctaacgggtgcaagtgcacaagattaagagagaagcaaatagggttgctcatgttttagcgcaaatggcaatgagtattaggtcgtgtggggagtgaaggttgtgtgccccctcaccaatcctagacttgttaaaccagaaatgtaattgtggcccggagacacggtcgaagcatgctcgcaccgtgtgcgtctttcaccacatgctctggtcccgggtttcttcctgtggtcttctagcgttagaagaagtcatctgcaacgtcccctcacgctgttttttggggggacaaacaaagatcaggaaaagacagaccgaacccattcggtgactttcgcggtcatcctcactgaaccgacttggatctgaactacgattcagatcaagtcttaccgaaatttgatttccttttcatgccatatgttgtttagactttactttttccccctttctgtcctttcctctatttggttgatagggtcttcgttctattctaattctaaacccattgtcgtccacagttttcttgtcaacgcgaaggggcaagcagcccccaaacaaagaactcataccgcggttgtggcttgaaggcctcgctatttagccattaataaagtttctctcttaccctaaaaaatatcagtcacttttttcaattctaagtgggttattgatgttgatcgaggatgatttggtggatagcatcgtgccagtaatcaactatcaacattatgcatacatgacgacggtgcaatgggactatcatttgtgcgacgtatatatactacggtttggtatgctattattgactaaaaattgggcaacaaaactttcgatttttcgatttgtctttgcggaggagaaaaattctaatggccgcacgatgaacttgcgtacgttttttttacacatatattttatacactctatagctatacaatatgggaagggcctacgtgtcggacacccgatgctttggggaaaaatcgggcgctgacgtcatccgatttacgtgcaaaaactattttaaactgatttttctcaaaaattacttatccaaatcatgatccgattgcaccattaaattcgttataattaaatcttcaaaacaagatcacacatggatatattccgacgaaattttttttagcttattattgaattatttttaaatgttgcacgatgttccaccgggtatatcggaattgttttactaagtagatcggaaatgtttcactcgtttaaatcgggtgttgtttcaccttatataaaaacaatgtttcagcaaatagcgaaacaatgtttcagttcactgtaacatttgatccatacatagtgaaacattataagtacactagatgaaatattttcggtagaaaaaaaaataaaacgaatttccttaatagggggtttctaaaatatgtgggttttttttgttgcaatggagtatttcagttcactgcaacattagatctatacatagtgaaacattgtgaatacactaagtgaaacatttttggtggaacaaaaaataaatcaaatttcccttaataggggatttccaaaatatgtgagtttttttttttgcaatagagtatatggtgaagatatgtggcaagtagtaaggacacatggtgggtgtcagggttatggataccacatacctaatagtagtcgactaaatctcggcaggacccaccacataccgtgtcctatacggaaacaatcttcggatataggaggagttccgataaggaaaggcaaccaaagttctacatggaaacgatgagaactactcggattgtatccatattggtttccctagttctacttggacaagggaacacctatgggtataaataaaagcccccctaggaggagagggggcgattaacggaggatcaacactcaacacaatcaacatagaggcctacatacgccaagacacgccgccggatattgacttcagggataagcacggctagtaccctacggtgtctccggatactgtcaggagagacaaaaacgctatctctgatctcgccgggcacggattcgaggaggaaggctaccctgttgtcgactacgagtcagatcgtcagaccgccatgtcgacaacagttagatgggctaccccaaatattatactggtgtgattatcatgaataaaagcaataccggcttcggccaacagaatgtacggttattacctgataacttaggggcctgaacctgtataaaaatccctgtctccgtctcttttacctcagtctcgcgtatatcctaacaccaacgatccccatactgtccaaataccgtagtcgtgacatcaaacgtcgacagtggggtcccagtagaaacacatgggcacgtcgtggagggaggggggagcgcccgattttctcctcctcctctgggcgaccgagcggcagcattttcgtacaatatgagtatactacagtctacacttatatttgacttttttttgcggattttctaaggaaagttatatatctcgtcgttgtatttggtgtttgcggtactcatgctttgtgtatacggagtactccctccgtttcg

SEQ ID NO: 30062 - DNA, 4991 bp, Oryza sativa
catttagcatattggggtagtttttttctttttcaacacacaccacccacgacatgcatggagactccatgataaaggctgaactaaacaaaatccccgctattattataaagcattctcatgtgcttaaatatatggacactaaaattttaactcctagcctagccgtagatgaagttatacacgcacaactccacctctctacttaaattaattagcacgtgcttagtttcggtttattcactagtacaacatatgcgcaggatgtaaacatacatgtggtcaaataatatatactcgatgtatataaacttacaagataagaaacttgggttgatgattaatctaccaaaccctagctatagcccgtatatatagcaggccacctatatacttcctccgtttcaaaatgtttgacaccgttgacttttttaaatacgtgtttccccattcgtcttattcaaaaaatttaagtaattatttattcttttcatatcatttgattcattgttaaatatatttttatgtaggcatataattttacatatttcacaaaagtttttgaataagacgaacggtcaaacatgtgctaaaaagtcaacggcgtcaaacatttcgaaacggagggagtatttcgtagctccataatatgggaagaagaggaacataaatacgtaatcatgctttgcgttgacatttagccggagaagtcgatttaattacacccccgcgcctgtgcagatcgaggagaggtcccccggctccgtatattcgtctaatgacttgctgggccgccctttgccatgggccaagccgtacattgcctctgcccttttggagtaatttcttgtgcaagtgtgtgcgatgggacaacatgacaaggctgtacgcgtaccttctaaatctagcctggctccagagacctggaccgtccagcccagcccacaggtgcgtccttatatgctctggtccaccaaccatgtgcgcgtgggccgtacggcacagagggagaccaattggcccttgcccccacacgatctcactcgtctcttccaaacgaccctatgtcctgttttgggagcttaaaattctgagaaacaaccggtgagaagctagctggtgagaacctggagaagctggaaaacatagcttgtgatttctagtttattttttggattctacaactacggattcttagaattcgagtgaaaatctggactgtctaacagtagtggcttctaaaagaatcttcggcaggcagaagctatccaaacaggccatatagtggtgaaacgtacttatgttactaccactactatttaccaagcaattcaacactgtagaaattgaacaaaaaaaattaatcatcagctggaggaacaggacttgctaattaaccacgatcaagaccgagctggttaattaatttaccatgcatggccgtcatggccgcctcctcgtcgtcgtcgtcgagatgtacggtgtcaccctcggctcgtccgccgcttctccacccacaccggcgacagcaccggcgtcgcgccgagcccgaccaccacctccgcctcttcctcggcgaccaccgccgccgccgccgccgcctcgtccctcgcctccgtgtcgaccttccctgcagctgtcgacatcgtctccgccgcgtcctcctcgccgacgacgacgtcgacgtcgtcgtcgtccaggtcatcctcgtcgtcgtcttcctcctcctccttcccgacgacgcgtatcctccacaccttgacgctcttgtccagaccggcgctgtacaccaccatgctcccctccacatcgccggcctcgccgccgcccaccgccaggcaccggaccggcccgcggtggccctcgatcacggcgaggcaggtgtgcgacgtgctcccgcccttgccgtcgcgccgccacacccgcatggtggcgtcctccgacccgctcaccaccacccggccgccgcagccggaggcgaggcagaagacggcgaggcggtggcccttgaggaagccggcgtgcgccggccgccccgcgctcgcctccttctcccacacgttgacgtacccgtcggaggagccggcgtagaggaagcaccggcgggtggcgcccgtggcggcggcggcgtggcagagcgtcagcgcgttcaccggcgacagctcggagcggagggcgatgatgagggcgtgcgtggtgccgccgtacacgcgccgccacatcttgacggtgccgtcggcggagccggtgaagatgcagccgtcggcctcgttgatgagcatggcgttgatggcgccgtcgtgggcgacgaacgagtcggcgcagctgccgtcggagagcttccacgccttcacggtgtggtcgtgcgacgccgtgtagaggaggcccgcgacggcgtggagcaccaggcacgacacggtgtcgcggtggtgcggcggccgccgcttggtgaaggagaggatgccgcccttcgccgggagcgtggcggccttcttggcgcggatgtggtcgcacacggcggaggcgcacaccgtccacacgcggacgtggtggtcgcggctgtgggaggtgaccagcgtgccgccgcacgcggcgatcgccgggacgcggccgcgcccgacgtcgaggtacccgcggttgaagcacccgggcgccgcccacgcccggacgcggccgctgtcggacgccgtgaacagcacccccctcgccacggcgagcgcgtgcacgtcgccgtcgagccggtgcagcgcggagaggcagtggtagatcgccgccggcgacggcgggaaccgaaccctcccgtgcagcggcgactgcacccacggcgagcacatccccccgacaccaccaccaccaccaccacctcccccaactccgaccaaccccggcagctccaccccatgcaccgacgagaggctcagcctcggcggcgtgtgcggcgccgcctccctcgccggcgaccgcgcgtagtggtggtgcaccggcgtccgcgccgccgccgttggccgcgccttccagtcctcctcaaagaagctaaagctcttcctcctcccaaactccatgactagctctacctccctgatcctctccctgcaccactaaacctccagctcagtactctaccacctaccaccacgatgacgacaacaatggcgacgacgacgacgacgacgacgaattgatcgcatccatgctagtagctagctatactgcccaccaacgccacgttaaatcgaggtataaatcgaggtcgatgaaacgaaggagtggtggatgggcgagctagtcgtctacgtggacggcgaggatatgcagcggcgcgcggtggtggtggtggggtaccacggcgggagcgccattactcgccggagttaaggggggcggagtaaatggcgcgtacggtacgaggtgggaagatatgggcaaagagagggtaaagatctcgatgtatatcgcgtgcacatgcgtgtactcgccggaggtaaatatggccacggccacggcggccatggctggccggcggcgagcgaggacgacgtcgatcggacggttgatgagaggatcttgcaagatctcgatcgcgagattgatggctgtcagtgtgtggatgtacgtacgtacggcgcgcgtgcaggcaacggcaagctaggcctaggcttagctatagctacaaacgtcgacgtcgtcccggcaaggaactgcatggtttagttactgcagtgtgtactgccgtaagaagcggctagtggtgaattttggtggtgtcatctctggtgggattgttgctttgtttcggccatggacaatgcgccacgctggcgagtaccttcgtaggatccacgtagcccgtggaggagagagggccgtgtcttcgcgcggggtgctcatgccttctatgagacacgagtgccctgctttggaagatgcccaggcgcatgacaccatgggggattggcgatggccctcctcgatcgtcccggcatgcttcaccctcgacacctcgcactatctgtcgcgctgagatcctttacacagttacaccatccgcatgtcttaccattgtcaaggttgtcgttggtgccggttgccctgatcttcgtcgcccccgctggcttgatctacaccacccgcggcttggtgaggaggaggggataatggcggcaacgcctatctagtaggaggggagatgcgactctaggtgagggaagagtctgctagagagggagctcgtcacggtgaacacacatacacacacacacagaggtcagcagtgacaacgctcattgccgaggtttggaagaggtaagacgctggcggcagtggtgctcattgtcgaggcgggaagaggggataggcctatagtgggacttgatgcccgcgatggtagggaaagggcttatgtgtgtttatacaatttctcttttctattgggggtactatatgcataattttggaccaaaaaaataaaaagaactaattgaaggactaaagctcaaataagaaggtggtaaaatagtatattactatggatcccatcaacaatagcttgcattgtggagaaactatgttgaaattagccccatgcttatgtggcatgctatctcactttaaaatcgcacatcagaggggcttgcattattcatacccttgcataataaatagattttgaggatgttctctagtagagtaccattttacttatcaaatatgagtacaatatatatggatagttacaaacaattctataaaaaatggtaatgtagagaatattgatgtgcaatatttcacaaaattgtaaatcgaaactcagtttacaaagcgatcgagtttagattataaaagagttgggaaattttttttaaaaagagcccaaagattaatccaaaaatcgagttctagaattcaaaatcactttttaattataatcgatatattgattggctgagtaatggtggaccggccatgtagtcaaagcgaagttgtagcaataa

SEQ ID NO: 30063 - DNA, 9275 bp, Oryza sativa
  unsure (1)..(9275): unsure at all n locations
aggtgacaattattcccaatttttttcgaggggcctgcctgtcctagcttttctcgcgagcctgcgcatatgatgatccagataatgcatgcagtacgtacggtgagatatagctaggggctattgagccgatcctagcttgttcggtggagctgataatatttggaagaattattttgtttttattttaaataaaatataaaatcttaaatactacaatttaacttataaaccccataccaagcgtagatatatgatctgaagttgtactaaacaactaaaataccagcgtagagtcgtggatatatatgatctggagttatatcaaacggaggctagattttcaatttttcaagagtcaagtactagtacacatgtgaataataaagaagctatcttttcctttctccataactncagatccatttaatttatatttggagggctacaagacaagcctagatgcaaatagatagatgtatgtgtgtagtggccaaatatagggagggcagcttggttggcgtagctaattttgatttttaacactaataattggattttcactctaaatctggagtatgtctatatagtataaagttctatcctaaaattatgtttctttattagaaatcacaacttaattaagggcatgtttatattgaagcattttcataggaatttagaagcattcaatcccaaaaggaaaataaaaactaaagagccaattggaatattgaaggaattggagcaaatgaaaaacaaaggaaagtttccccttccctccatccttaagtcaaaaatagagctttgaccatgagaggagagggagggagagagatgcagaagtggataagaggacaaggtagataacaaataaggttaagataccccttcagtttttaaccgatggcgccattaacttttaagcatacgtttaaatattaatattattaaaaatatacaataattatttattatttatttgtttatcattaaaggtacttaaagcatgacatacttttccatgtatttacacaataattttgaaaatgagatgagtggtcaaacatacgtacacaagtcaatatctatcatgtattaaaaaatgaaggaagtagtccataaaaagagatgggcataggatttcatgttattaaggttcttagaattcttgtgttgtatatctatattttgttttactccttccgttaaaaaatataaatatgaaataattgcttatttaccattatcgcatgctctaatcgtccctataatagcttagccagctttaggaaaaattaaggttaagatagaaaatggttaggatcaattgagatgagaaattaagcaattaagtgaagagattaaatgataaatatagctttgattggttgaaataagacaatagatggataaatacttattatgccagaaaaactttgaatatctctagtagcttatacaaacagagggatcagtatgttttctttttccaatatatagtttgttttacaactgcatgcattatccctacacattttcttccctatatatgttccattcgagtgactagttttcatgcgttcaaagcagcccccaacaattatatatgcatgttagtagtaataattaagcaggcccatgatcatcaaatactagtaatgaatatatatccagcggcaggaatattcacagcgggacatcgatcgatctgtcaaatcaaagcttgttggtgtggtagggtggttgcaagcaagcaagcaaagcagactactactcctatattactatttactcatatacactccatgcatgtgtatgcacttaattatgcaggcattcaacgcattattagtggcttcatgactactccaggtttgcaggatttggtgaggaaaatgggtggccatcactgcagcggggtgccactgctgctgccacggctactattgatgatatatactccattagttccattttaagtgttgttataattaagtttttttttctaattttaatcgttcggcttatttaatttcttttttaaaaaaataaaaacataagtcacgtataaagtaaaatttatgttttatcatgtaataacaataaaaatatcaatctaaaaaatttcaaataaaacggacgatcaaagttgaacatggaaactcatgactacgcttaaaatgagacggatggagtatatcaagcggctctgttcttttctcaaacaaaaactggataacttttagataaaagtggcatgttttttaaactgctaaacggtgtgtttcgtgcgaaaactttctatatgaaagttattctaaaatataagattaatccatttttcaagtttataataattaaaactcaattaatcacatattattaccatcttattttgtataaacacttagtttttatctttatcttcgtcttggaagattcaaacactattgtatataatcaattagctacaggatatatcaatcattgatatgtgactagctagttaattgtgccaaccagctgcattcatgcttaatactccctccgtcccataatataatataagggattttgactttcttcttactgtttaaccactcatcttattaaaaaaattagaattattatttattttatttgttacttactttattatccaagttactttaagcataatttttcttttttatatttacacaggcttttaaataagacgagtgatcaaacagtgtgagagaaaaaaaagttaaaatctcttataattacataggagtaatatggctcgattaattacgcgtgctgagacatctaggtaggtgacgcatatatgtacgccggcccgcgacgttgggagcggcggcggttagccgtcgttaacgttctcgtgttggtggccggccggccggccccgtcgtcgatcggggggccgctcgctcgctcggcttgcaccaacgtaacgtacggcctcgtcatattgctcaagacgcgtactacgttgttgggacaggctcacaggcaggtggatctttaattatctctccgttccaaaataaacgcagccatgagttttcgtttacaactttaatcgttcgttttatttatttcttttctaaagaaaaaacataaatcacacataaagtactattcatgttttataatctaataataataaaaatactaatcataaaaattttttaaataagacgcgcgataaaaatcagacatagaaattcatggctgcgtttattttaggacggagggagtcatcgataactcctctcattttgttgtgacgtatcgagcacgacatgtctcaaataacttcatctctaacgagttataaaatgacatatttaaaatactacagcatgaaaagatctacaataattatcataaggctcatctcagctgtgacatgtatatatagttttcaaccagcaaccaagcggttagactaggcttctttccaaggcaacaacctaataattttgctatatatttgttgataaattttctctcaaaaattgacatatgcaaatgtagtacaattgttgtgtaattacactgtaacttgtgtgtaactttcatataattttgaatcgttcgatttgctttaactttcatacaagcgaggaaggaaaaaatcactacggcggcgcatatgtgaggggatttggttccatgaccaccattttaaaggaatagcatgttaatgagggattttttaagttacatgtaaattacaatataattatatcatgattatactatacttatatctgtcaattttttttaagaagagttgtcgacaaatatataggtagtcccacaacctaactggacaactattttagatggtgtttcaaaatgttatacaaattttcatcacttggccaagaattaattatatcaattagatgttttatcactcgctaaaaaaatgttgcaaccagctaatacaatatttaaaaatactgacctgcaacatcaataaaccaataggtaaagcataaaaaaaaaactagctgcaacatcaagaataaaaaaaaattgtcaatgagcaactccaggacaactgagggtgtggtacacgcctttaatgcaactgtgcgcatcatctgctagtatacatatagcggaacagagaacaccactcaaattaatacttatgagaaaaatgcaataaatcgttaaactctaacaagagcctatagtgacttttttctctactccaatgtgaccagatccaccttatttctctacaacctccttgagcgtggatcttagacgtctagttctacgacgccgtcgccgacctgctacgcgtcgccacacctgtttgagcttgtacttgggattgttcttctcggtgacggttctgcatgcatcgatgttggctttgctcttctccttaagggccttgtggatagggccggcatgcgcggaggaagatatgtttgatatggtggcgacaacacaggcagatctagggaaaaaaagtaaaaaatataacttttgggaaaattttttttgctctaacccaatgtatatatatacatatatgattttttttggaaaagtaaaaaaacttccttgttaatatattataatgcacatctaatcaatttattatatactccaaactttgttatatttagggtactttagaaaaatatataggttggactagccacataaaaattctaaaattctagatacaccactgggcgactgtgacagcatgggcagcccaacttctcttggttgggccatgtcaggatgaaagccggtgtaatggtaggtctgtgggcgggcacggtgagagtgtgagagagaaagagatgggaacatgaaggagggaggagacaaaggagtagaaggcgtccaatatctgggctcgttttgaacgcccatccacaagcattttctaaccaaatatgcccgcgatcgatcattagggatacattgtcaataattttaagcacatgcctaaactcactggtaaacaaacaataagggataaccataaaattctcaaatactcgtacgttatctatcgttacacttgtcagggctaatttccgatttccatcaattattgcagaacatgcatggatagatcggcagcagaggccagcaatgcagcactagcaacaaagcatagatattactgcatagtaagcccactaacaggcccgttaggcccaagaccctactaaccaaccaaaaggttcaaataatctaacctcaaatgttccaatctagatttcaaagatttaaaaataacaaaacgacggtgtgaaggatgaagtaacataaagaaaaagctagtaatgtggaatgacctgtgtgaatatctgaaatttactttattatcgtgaaaaaagacatcgaagaaatagttcccgtagattgatcaaattattttgttatgactcattggctgccaaagagatggtaatataggccctgtttatgatagctcgagattttaagaaacaacctacaagaatatgacaaacataaatttcctagctgttgacttgaagtctattttttaaattcggtagcaacttacggttagaatctagatacaattttaaattgtttggaggacctagagatttaggagaaagtggagttgctagaagctctctaaacatgaacataattataatagataaatgtaaaaatacttatataatagagtttacgtgcgtcttatgtgtaattaagaaaaaaaaacttgacacgagtgttcgtatttacacctaattagtcttttagtgataggcgaagtatccgtcaacagcaaggcgcccatggtaatttcatcaatatcatgatatgccggttcagcttttcgaatgtgcctataagagtatgatatacgtgtgtgttgtgagcgcctgcatttttgtaacttgttactatgaaaaaaatacttatggaaaatttgcaagggcaaccagaaggatgattaggcatagttccggattcaagatttttttgagctaaaatattcctaactccacaaatccacggatttatatccataattacgttgatagattttgaatatatcattttgttctcattttggataaaacttaaaattttgaaccattataatttaacatataaatttcaaatcgattatgaatggatatgatatttatggcctgtttaagaagcttaaaattctgaaaagcagctagtagataataaacttctaagaatctagtaaaactgggtttctcagcttctggcttctagttcattttctggattctataactacatcttcaaagaatctggacaaaaactaaatttgtttagggaacttctgattctgggagaatctgtagcggcatagccgtgccaaaccgggcctacatgtacatggagatgagttagatctggagcaaatgacgaaaatgcccctcacccccgttgccctgctgctcccccccgtaatccatccgggagctccgtccctcgcttcggcatgaggcctccgcccttaaacccctgagaagagaggaggaggaagccatgccgcaactgccctcccctcttcgccggcttcttccgctcttccaaaccctagccgccgccaccccggccccgctccttcacctttccccccggcttttcttctcctccttctccccctcccccttccccttccctcgcgccgggtgcctccgcgccctcgcctaccgcggcggccaggcaggaggaggaggtcgccgcggccaccacaacaacctcttcgacgcgggaacagcacgctcgggaagaggagcaaggagaagatgggcggcggaggaaggggagggggagggggagggaaagcgaaggtggcgttcaacaagacgcgcgcggaggggaaggacgggagaaagggcaggagcatggagctcaagagccgcaagctcaaccccatcaacaccatctgctacgtacaggtgagggattttgccgatttctccccccacaccacgccacattcccgatggtctcgttattaagccgctctgctttgcgcctagctttcagttcagctcgattaaagcggggattgcctgctttttttatgctacatacattttgtttcctaagacgcgaacgatgtcgagcaacaaaatgataatatgattatatatatatgccttttagcacaaggttagtacctgctacaatcctttgatggcgattgtgcatgttggtttacttcatgacttagcaagcacatttaattcctgggcttacttgggatacaaaacatgccccattggagtatggcgcgatatcttttgccttgggtttcagcatgccggttataattttctttgctttgtaagaatgtgcatgtgtcgcctttctgctgacctaactgtgggcataggctaaaatgttatcccaaattgattgcgatagatgtcttacttaggtttaaagggggtatagcatctgaaccaaactttaaaccatcgttcgcttattacctgcgtgctaagaaaattataaaataataaattttgtcacgatgccaaagttcatcggaggatatacatattaatgccacccgctaccaaattggtagaaatgattcagaacatcaatgctctgatgataacgatgttgataatcacttgtagggtgtatattctgggtttcctttacctgttgaagaccaaaaatactatgttgtcagggtcttgtggatgctgcagttgctggctggcaaagcaagcgatcaaatcgagctagtttagtaagagtgagaaaactaggtataagcacccctagaggcctagaatgcaatcattccagctgtttttgactttttgtgtcacccccctcagagatagttgttcagttaatcaaccccctcacttagatcaactcatgggaacagggacaaatgcctttgccagtgatcttaccccttcgttcttggcttcttgctgtgcagatacttggtacaggaatggacacacaagatacttcaccttccattttactcttctttgacaaacagaggtttatatttaatgctggcgaggtatctgcagcacttgtatttatttgatcactctctctctctctaaaacatacttatgtttttaattaatgtgcttcttaagtgcacaagttgttcctaaactctagttgccttaggggcaaatttgtagctcaggtctattgagttccgtttgtcctgcttttttgtgtgtattgctctgtattttatttatctaattttatcatccttaaccagtttgtcatgtcttattttggtgaacttaatgtgctaaataacaaccttgctgtctgatagggtcttcaacgtttctgtactgaacacaagataaagttatcaaaggtatgaggtccttctcgccaatgcattgatcatatttcttttatccttgtttgattgtgtttgtaaaccagcaacttgcttaaatgttgattctccacctcccagattgaccacatatttttgactcgtgtatgctcagaaactgcagggggccttccaggtaaatttgatcactctatgtactgaactactgtcattatttgctgaactgtgattatatctatgacataattgtttctgttccttcttttcatttttgcaggactggttctgactctggcaggcataggagaagagggcatgtcggtgagatcacatgatttcatcattcccttcttttcagtacctaattgccaactcatcctgttataccttttctgcatactgattgtattgttcccttttatctgcaacataggtgaatatatggggcccttctgacctagattttttagctagtgcaatgagatcctttatcccaaatagagcaatgcttcacacacatagctttggtgtggaacaaaatgtatcttcttcccaatctaaagatgctactgtcattgttgatgacgaagtagttcgaatatccgcaatgtttgtcaaaccaagatacaataaagaagccagttgcttgaatgactccaacttgaagcctggcaatactgctatcatttatgcatgtgaactgccagaacttaaaggaaagtttgaccctgctaaggctgctgcccttggtctcaagcctggaccaaaatatcgtgaacttcagctcgggaactctgtgcagtctgatgcattcgataaaatggttagtactgaatactgagatatttaaactgtaatctatttgtaggattataaataatattctttcatg

SEQ ID NO: 30064 - DNA, 7758 bp, Oryza sativa
taagggtcagtttggattaagggatttggatccggatatatttacaaaatccaaaactagaccatttatttgagaacaaatgtccatttaaggtggatatattattcacaattgcgtactccctcagtccaaaaaaaaaagacaccctggtttccgtgtccaacgtttgaccgtccgtcttatttgaaaaaattatgaaaaaattaaaaagataagtcacgcataaagtattaatcatgttttatcatctaacaacaatgaaaatactaattataaaaaaatttcatataagacggacagtcaaacgttggcacgggagcccacggtttgcctttttttgggacggagagagtatgttttatagagtcatcctaaccatgttcacgccctattgcacaagcccattgggtaaaagaaatcatttggtgggggcaaagtcctgaaagtgcaaagtgtgcaactctaaccaccattgtacatctttgtattaatgtatttgcaaagccctaacaacattactacaataatgaagaacatatataaacattcaacaaaattgataatctcattctgactccttcctctctttttttcccaactgaatggataattagttatcttctcttgcaaagattgcaagagtctttacaggaattaatcaactgctataaaataacaaaatgcttgttttcaaggagcatttgcaatagaagaacgtccacaataggttcaatccgcatctcttcttttcttttttctatcattaaagaagatccacagtaggttctcttcattcgatgagcaaaatgcttcgtgtgatcgagctgcggaaaacccggattgcaagtgaataatttttgccttacaaattggaataaatttctctgattaagaagacagataagaaaaagaagacctgaatcattatctttctttttgaactaaggaatcattatctttccgtaagcataccaatcatgaaccatctttgtatcacaactcctggggttgaagcagacaagaccgtgtgatctgattaaacgcgaaattatctctagtttataagctagttggagaatcatcataaggctggctaattaaactgtaatgcgcttattgcatgtcttggggcttgtccatttctcttttctttctttctgatgttctagatgatattggctcatatcatgggcactgcactttattctagtatcttgttgctaccaatgattcagattatgcttgcgcacgtaagagcatcatcacccaattatatacagtagccgtatatacttagtatctgtaattaaagtattacaccatgcatttgatcctgagtgaaaaaggcccagtatatggaatgctttctttcatttattctgttttctcatcaagaatgatcattcagtaacttgggttcagtctttcagaattcaaagaatattttaactgaattctgtgaattctgtgaattctgaaagagttctaactgaaatcttgaagacagacagaaatccacgttggacttgctatgctaattgagttgctaaccaaaatggtcacaactacatgtcttgctcagctattcctgtgataattataataaaacaagaccgcatttctcaaaccaaaaggcacaagacaccaaggtctccacagaagagcacactagaaacagtccgttcttccaaaggcaaactttgagctcttttgtagagatgccatggaaatgcaaaaaaaaaaaaaaagtgacacttgattagaacccactaactattgcatgatcccataagcacaattaatagcactgcctaccccctcttgtctttctcctagctcccataaattggacaacctgacagtgtcctccccctgtacttgtctgaacttttgatttgagttacttctgaaagtgagcttataatttgatgctaatctccatcctacattcctacctccaaactcagtcctaatcctatcaaatctactcatctaccatcaatttctaagtgtgtgtaagtttgctaaaatctatattctgattctcctccttaatttgttcttgatatgatacacttttagctgcagttcattctgcataaaggctactaattaacttgttgacatgtagatttaagctataatcaccaaacacaatcaaatggttcttgctaatttcctcttcactcttcaggcaatggagcaatgccatcatcatcagcagcagagcaatggccagcagctgcagaggctggagggcattgaggaagaaggcggcgccgccgagaagtggccgccgccgacgactgtccggccgccggagacgccgacggagacgatggagttcttggcgaggtcgtggagcctgtcggccgccgagatctccaaggccctcagggtcctcagcggcaagggcgtctccgacgacgtccacgacgccgccgccgccgtcgccggcgacaggaaggagcggaggtcaccggtgaccatggacggccgccgccatgaacaggcaagcgaggagaacgaggcagcatctatggtgaaagaattatgaatcatcaggtgacgtgacgtgctgtgtggtgcatggcatgcagagagcggacgcgtcgtcaatggcggcggcggcgcagggcggcgcgatgagcccgcccatctctccccgtgccaacctggacgtgaagcttctccgggcgacggctacggcggcggcggcggcgggagggagaggcgggggcggcaagacgacgatgggcacgtggatcaaggagcagaaggagcggaagcgcgccgaggcgaggtcgcgcaacgcgcaggcctacgcggcgacgtccgtggccggcgtcgccgccgcggtggccgcgctggtcgccggcgcggtgttctcccctcctccggaccaccccaagaacggcggcgccgccgcaccagcaccggcacccgcacacgccgccggagcggcaggcgcgaagacggcggcggccatcgcgtccgccgccgcgctggtggcgtcgcactgcgtggagatggcgcaggcgatcggcgccagccacgaccagatcctcggcgccatccagtccgccgtgaacgcgcagaccagcggcgacatcatggcgctcaccgccggcgccgccacggccctgcgcggggcggcgatgctgcgggcgaggctccacaaggagatccaggccgccgccctccccggcggcggcgccggcgccggcgacatcagcggcagggagcccgagagggacacgtcgccattcgccttcgtctccagaggcggcgagcttctcaagcgcacaagacaaggcacgataacagtacaaattctcccaaaaaagagcttaaactttcagagatttttcaccaaaatccaatccaaataacactcccatacgcgtcaaattgcaggcatactacactggaaattggtcaccgtctacatgaactccaacctgcaggtgatcatcaagatgaggagcgcgcatatggccggcaccttcatcaagaccaagaaatgtaagatcaaactaaacaccatgatcggaaatggattttaatcaatcgaggaaatatttattcctccatgttgcatgttatccaaatatatcataaaaaatttaaaaaattgataagatatattaatatgtaataatatataatataactttacaaacatgctttaaaaaataacaaatttaacagtaatttatatacatgtgcacatagtcatatttgttttgttttttaaaatttaaactcaaatgtttgttgagtgatatatcacatactaatttatctgttattttttttacttatttgaataacatgtaaataaacgatgggatctttcttcgagagattagaagtgtttgcgatcatatcctcatttgctctcaccaagattgatacgatgattcatgtgtgtttgcaaattatttgcagttgttgtgcttgacatctgctcggagatcccggcgtgggcggggagggaggtggaggaggggagccacaggaggggatacttcgggatcaagacggtggagaggatgatcgagttcgagtgcaggagcaaatacgagcagcacaagtgggttcaagggatcaccgagatgctcaaccgccgtcacaccatgaaaaattagttaaaatgtttccaatgtaaatgtcaaaggaaacaatcggtagtagtaacattttgtgtggtttgtgtgaggattgggagtgaagatttccatgttctctgttataactgacattgttgttattactgcaaatccatcatcaagaaaaaaaaatgttcccaggatcttcgataagcataagaattctttccctaagatcaaaccagacgagtaggggggattccatctcaatcaagcgatcaaacagcaaatcactgaactggtactccaccggaatcatgaagtaaagaactaccgtgatctctcatggctctgaaagatcatcagtgcacggtcgatggagaagttatcagagtgatgtacagcagtattatcagcgcaagttacctcgtgttaatggccacataatttttcaattttcatcaacttcgtgtctttatcagcggcgtagttgcatgttaatagaggacgcattgcatgtacaacacccattaacattacttgattacgtcaagtcatcaagtctctaatttagcatcctacctcagtatgcacatcaccgctaaaactccctcatcatatcagcttacaaagaacaccgtttttcagaccaatcactgcttgaatatctagaagttggtactccatttttttttaaaaaaaaaaggattttccatgttctgattttcgcatcacttccgacatctgcagttgttgctaaatataaatcaaacaaaaaaaaaggagttttcatgttctgattcttgtgtttgactctgattacttacgttgatgctaaatgtcacatataaccaaaatctcaacataaactgcaagtcacacagatatagccaacattcatgaccacaaattatcttatcatacttagcaggttcacaaggccttctggttcatgagcatcaaacaccaaaactactgcaagagcatgagcatcaaacaccaaaactactgcaagagcatgagcatcaaacaccaaaactactgcaagaggaccatgacaaatttgctggatatatgaaagcaaaatctaatcaaagagggagaatccaaggtcgtcttcactttcttccttctcctcttccttcttctcctcggctttgggggcctcggcggcagctccaccagcagcggcaccgccagcagcagcacctccaatggcagcaccaccaccaacagcaccgatgatcacctgcgaaaagtcgaggtcagcactacataaaaatcggttacatataaatggtatgaccatatgttgagtgtcaatgcactccacaaaacaaaggcacacaaacctaccaatggctacttcgcatatttatagattacttcctggcataaattgtcaactaacagcaagagaattgacaatcgtaaaaatataagatcacagagccacaggctgtaatgctaagaaacacaataaatatctgtagataccaatttctatgtcatagctagtagttaggccagatagataattggcacaaccaatgccaacaacccgtttatctatttcaaatgtgaactagcagtaatctggaaacgagcacgatgtctatagatgaaatttgggctagcaggcaataccccaaaatatttcttttgcacacacgaattgaaaaactagaaacattgttatctgctaaattccagttgcaatgagatgtgcacttgacgcctaactatcgaggccacaacagcaccaaacatcaatcaaacatggtacaacaaattacccatcaacaccacatatctgacactaaagcagcttaattattgcctatttagatctaaacagaacaatataaacagtcaacacacatggattacaatagatggatttatacagaatatcgagaactaaagtaatcaacgcatctgacgaaatagcgccgtggcgacgtagatcagcaggacaatggcgaatcgaacagcagcagcagcagcagcgatggggatgtggtgggggggggaagcagacctggaagacggcggagctgggggagaccatggcgaaggaggactggaccccggcggccgagtcggcggcggacgcggcggcgacgaggcggcgctgcagctcgtagggggtggcggcggaggcctcgagctcgcccttgagctgcttggccgtccactcctcgccggagctccggcacacgaaggtgtagacgcccatgacgcggcggcggcggcggcggcggcggcggagatggaggaggcttcgggaaggcttgcgaggcgagtggagatcgaagccctaatcgcggggtctcccgaggttatgtagtcttctgctgctgggcctacttgggccggcctaggaaaagcccatgatgagaaaccgttacaactcggcccggcccatataactatgggccataattttcctttttttttctttggatttgtcatctggatgatcagcttctctcccaggattattagtgacgccgtgcttagttctaaagtttttccttaaacttttaactttttcatcacatcaaaactttcctatatacacaaacttttaacttttctgtcacatcataccaattttaaccaaacttccaatttcggtgggtcctaaacacagcctgaacactgatggtttgaggacgaaccaaaaaaaattgcatctgttgggattactaaacactgttgtgctaccaaaatgtgaactagaaatgctatgcctcgtgaacccaaaatcatcgaacaagccctgaaaatacataaaccttatcgttcacttcgtttatgggcatgtttggtacagctccaactcctaaatttagcttcagaagttaggtctggaggagagttgtggagctgcctaaacccagctccgcaactctagttcattttgtgagagagctccacccagctccactctcagttttggtaaagctgaacctcctgtatgactgaactccagctcagaaggggtggagctagagctgtgccaaatatgccctatgtatttcttttagttaagatatacattatcctgttctttaattaaggtttttatcttggcattgaaagtgcaagcaagcagatatatttttctacagaagacctcaacaacttcatgcaataatcatgaaaaaggaaatatattaagggcctgttggtaaatacacaataaatcctgctaaaattttgataatattaccatcctactaagatttattttgactataatctaaacaggccctaatatcacaaaacatttagacgatcagtcaccatcccaaacaagaggtgcttagaaagagagaaaaacaagatctgtccacgtgattaagcatccgtgtttctccgatgcatgagaactcttgagaaagttttaccatgactgacaagagcttcagttctacgatcgatttcctaatcaaggctgtatttagtttgtgtgccaaaattttttaagtatataaacacacatttaaagtattaaatatagactaataacataacaaattacagatttcgcctgtaaactgtgagacaaatttattaaatctaattaatccgtcattagtaaatgtttatggtagtacaacattgtcaaatcatgacg

SEQ ID NO: 30065 - DNA, 903 bp, Oryza sativa
  unsure (1)..(903): unsure at all n locations
cccccctctctctctctctctctctctctctctctctctctctctctcacacacacacacacacacacacacacacacacgcacgcacgcacgcacagaccaatttctgattcattgtcgtcttgctaggtttagcctggcagctgtttgatccagagtttgtcagttgggagctagtggtggtgggatttttctttttttttttgtttttatggattttgttgggaaaagattatgtttggggttacatgttataagctgattgaatcaactatgttatcatgttaaaaatgctagttatgtcagctaatcatgattatcattctggaccgatgaactcattctttgtttcaggctgttgacagtccaatgtctagcttcactcacttcatctcgcttccgttgggtatccacccacaacttgttgataagctgaatgaattcaagaggtcaatcctgacttctaatgaatataaaggtaaggatagggacctaagtgaagttctatacttctatagttctatggatgaaatgtactattaacacaagcaattagaaaggcctagtgtttcaatagaatgcaagttcaagcataggagtctgtcagagtaaaagaggataataagggcttctgccctggtctaaaatctttgctgattttgcaagtgctttatgttccatttttgatcccccccccncccccccggatttctggcaactctagaaagccacttttggactttcctagtgttgtgtctgtgtcaataatgcatttttatataagtactccacagcccacacatgtgtaggttgtttgatgaaggaacacacgaccgttttaggctaaatagaaataatagtaaagaagtttatatgcatatggatttttgtaaataccctcca

SEQ ID NO: 30066 - DNA, 958 bp, Oryza sativa
tccagatttggactgataagctagaccacactattccattttaatttcccgacatgttaagtgcacccaccaggtcaccaccactgctagtgctttcctgccaagttttcagtttctacaccctctataagttattttaattagttttttttgaagttaaacttcttttaagttttgctaaatttatataaaaatatagcaaaattttcatcagaatacaaaatatattgaatatgtacatttaatagtgggtctaatatatgaaattaatttgttggaattgtagatatagccgtatttaatagaaacgcagtgtcgtatgacatggaacatttggagttctaatggttagtaatgtgataagattcatgtacagatctgagaaacagcccacttaacacgcaacggcgattgcatatctcgatcagtttcgtcagttaattttctctgcaacttcctgaacttctgtttcatttcgtcatttccctgaccaacccaaccgatcgtcatcagcacgttcatcacggtcagcgtctagaacactgtggatatatgcttgatagtacagtagtagctatagcttggcgtgatcccaaattaaatcatccccatacctgacgcgagaaactccagagactagcagttcgtccagcccttcaagcaactgcagccatgaccatgaacatattcagatatatatgccctcctagatagctgcagctacagctagcaccgcatgtggcgcacatggagtgaagctgttcatccgcggatgaatccaagcgacgcccatgcatacgattcgatgcatctcggccggcgctctggtgctgatcatggttgtcaatctcaacctgaaagaggagctctatgttgtcgccggatccaatcagtaagggcctgtttggtacagctccaacttctatatataactccaggagttgagtctggagtggag

SEQ ID NO: 30067 - DNA, 4391 bp, Oryza sativa
ttttgtggagcaacgtcttttaagaagaaaatgttgctgcagagacatcaccgtcgagtcgaaacgatgaaggctagattcggggaaatatactactaccttcgttttataatatataagttgatttgacttttttctaataaaaaatttctaagattcacctaatatgtaaaaaattttagcaacgtctataacaacaacttagttttattaaaaccaatgtttactatattttgacaatatatatttgatttgtgttaaaaatattgctatactcttttttttacaaatttagacaaacttaaaaatgtctgattaggaaaaaagtcaaaacaaccggactgacgtacactactacacaaataattttctaatacaagcacctcaataggttgcatacggatcacatgtgaccgcgtctgcaaaaatcgaactctattttcgcatatgacttcttaagagactcgcacaagaaaatctattttcgcagtcggccctcttaagaagtcgtatgcaaaaatagggctatttttccagacgggcctcttaagtggctggagggaaaaatatttttttcacatacgggtatcttaaaggtctacccaaaagtctgagttacctcctctttccctccttaacacttcaagatttttcaactcacagcatctctccttacctcatctttatctcctctcctctcctcatactcccccctctctctcaaactctctcccggtcgaccgagtggcggcggccggcgggcgtggggcgaaggtggctaggggcgatggcggcagcggcggccctcccccgcccaaatctgcgcggattcggtggcggtggcgagcgggcgggcgggtggcagtggatccagcgtggcgcggcaggagtcaaaagcggcggggctggggtgcgcggtggtgggcgagtggcgcgatggccgtcccctgcgcagatccgacggtggcggccgtcctccacccagaggccggtggcggtaggagcatagcggaggtggtggcgagaggagtttggcgatggcgggaggaggcggcggcggcagccatcccccgcgtggatctggcggccgatgggtgtgatttttactctctttttttcagatttttttcgcgtgcggacgacataagcacccgcacgcggaaaaccgatttttccgtgcgggtgcgccacccgcatagaaaaattgggattttcacagatccttccaggcagatgggctgaaggtccgaacgcgaaaaccacttttgatccgtctaaaaagaattttttcttactaaaatatacttattttaggacggaaagagtaaagactttacaatataatcaaaccttaccgtttgatccaacaaattaagaccaaatcaccatacaatccatcatatgtaaacttgacactaatttgtgacaagtcaaacttgacgacatgtttatggggcatgtagttttcattatctaaaaaacatatatatatgggccatttgagttctttgccatttgtaaccttgtctcagctctcttcttcttcttttttcttcttgtttttttacaatggctaaaattggaattattttctttttggtacaaaaatttggctagactttttttcttttggtttgctatcaatgttatattttaggtagtagaactaagccaaataattttacaatgcctttttttgctacaactagatagatagatggctacatttttagcgtgccaattttttttagtttggttgagtttggccacaaaccaaaaagaaacccttaatcagctctctgaacattccccaactgcatgccaggatcaacgcacgaggcggtattaacgatcaaattatgcctagttttttttccttttttttgagtggaaagtcatgcctagttggttcacttgattgtggttaaatttcaaccgattgcaagttggaattagcggcggcagcagccggagaatcagggtagtggtagcgagagacttggaagtcaacgaaaagaaatttagcacttcacgagagtatatatatgaggggaaatccttatctttttcaacgtccacgtcgttcgttctgatcgatctatcatgcacggcggctgatatctgatcaaacgatgacatgtataatcgtctcactgcaatagaggtttgatgcagagaatgaacaatcctctacattttcttttgaggaaaaaataatcctctagagatgcactttcaagtgcagtgataaggaatgtgtggtctcaactctaaattaagttaagtgttcaatatctaacacactcataatttcttcttaaaaatgtttagaggaacatctttccctacaaatatcactttttttagaaaaaaaaaatcctctagaatctatactgaaagtatcacatagccatccgactgatgaaacactcctatctatgctacagtaaatttgttgcggtgcatatattgattagattattgttgatatttcctccatccctcccaaaaatatatttacttctgctgtacacctctgcgaaaaaagtgcagagaatttgcatcccacgtctttacggatattattacaatatagattttaccttgatttttgttagtatttgcttttcaaactgtttaacgatgtgttttatacggaaattttttatgtaaaaattgttttaaaatatcaaataaatcaattttataagtctacaataattgaaactcaattaatcacacactaatatctttattgttttacatgccctaacttcacctttgtgaattcaaatggacctagatggatggtatctcctccaccgggcgatccgagcagatcgagctcgccgcaccaccatcgtcggcgccggcgtcggaactcggaagccatccatccaggcgacaccgtcgtcgccatgattttgggacgccggcctagctacaaatgggctttggttcagtgcacagcacaagctagtacacgtccttatcagagagcacctggtcgatcatggcgtgcagccgagatgctggctactttctctgtttcctttttaacttgacaccggatataaaactttgaaggatcatcttttccaacgtgttttgcatgctacataaaactattacacttacattcacggattcaccaaaacatcgtagttttaaaagtctttattggtataaggtaaaatcacaagtgaaaggaggtgtaacttagtggttacagtgacctccttagtagtaccctaaagtcctaagttaaaatcttcataagagcaaatttcagattgggttatttaaaggctaagttcctaatttaaaaatgttgcatatatccggttggatatggagactaggtaaaaaaaatacccttctccaaaaagaaaaaaaaaaggtaaaatcaccttgatcagcagtgtcaagtagtaacaaggaacatgctttgagagcagggattgcaatttcgaaactatgtttttttgctggagagagccgaaagaaccgaaattatttgaaaatttcacaaattttaaatggatttgaataaactttgatcaaattcaaaaaatttagaaaaaccccaaaatttcaggcgaaatatacgcttgccagtgggggggggggggatttctgaaatttcactccaaaatttcaatcactgcatgagagtaggcaagctgcactagctgcagatcatgttcctgcagctgcagctcctccagtaccaccactgttggtgtacaatgcaacatggcattggagcctctgtacccattgatcgacaagctagggttgctcgtgtggcccagctagcactgatcgatggacgatgggcctcgatatgaacatgatcagtcgaatcttgcaggtgttgaaaaacggtcgtccgtcgccgatcgtcgagatggatatctgaagaatgtcggtgctacaacatctatctataagatcactgcatttttctgatacaaaaaagagcctcgccatgtgcggcctgccggcacattttacaccttctagatgcaagcagttcatgcactgagtgatctgcagttctgcacacattgctagtatatatagctagtggattactagctacttgtttaaagtcactttgcagctagcatttctcaaatcttactactgcattatgggtaggtatgttccttcagttgagaattactaagatggagcaaagtgctttattaatcaattgctagtgagaagtgaatagataaataaataaatgagatgcatgataggagaaaagtgaaacaaaaggccaatagagggaatgacgaaaagaggagtggataagttgaccgccggaaacttgttcccgacaatagaatgtggaggatacactcctcccctagaataactat

SEQ ID NO: 30068 - DNA, 4810 bp, Oryza sativa
  unsure (1)..(4810): unsure at all n locations
atatatatatatatatatatatatatactccctccgtcatataagggatttcgacattttgcttgcactatttgaccattcgttttattaaaaaaatatgtataattatttattttatttgacttactttattatctaaagtattttaagcataacttttcgctttttatatttgcacaaattttttgaataagacgagtaatcaaacgtgacgagaaaatagtgaatatctcttatgttaggggacggaggtagtatattaattggacataatgatatgagtccatatgtgactgtaataatgacagcattaaaagtctaattgcttgacgtacggttgataagtcgtaagaaaaaaaacgaatcaatacaaaataatttataggtacattttttatatctatattatatattatttatgatttaaaagtcagtgttgaaaatagactaagataaaaaaattcttagaattaagttttaaaatttaaattttagttgtagctgataagctaataagtaaaggatgagctgtgcacccagtgttgatatacactcatcctttcctaaatactgggtaccagacattattcatatgcaatttttttgtcactcttattttagcaacaaatttacaaatatttgaaatataacatattgtcaaatgatatcatgtgttaaatatataaccatataatttctcgcttagaaaacagggatataatccagaaatactgatgatcatagttgaaacaaagttggcgagcgacagatatcacgagaagaaccgcataaattgaagaggagtttctttgagagattgcgaagaaaattattgggacaattgcatccatgcccccagttttaaacccaattactgttttacccccactttttagggtttgtagttttaccctcaccttttgaatctgaatcatccgtctatcctcacttgtaacggccgtttggtgggtcccatgttttgtgttaaagaaatacaaaaggaaataaaaaaaggttttagaaaatatgaatttacctttatgcccctgagggaatggataaggtcctcccaccccgtgcatgaatcgaaatcgaaaggggacgcggcgagggcgggggtcggcgagggcgcccggcggcggcgtacgcggcgagggcgtgcgcgctatggcggcagccgcagcgagggtgtgcgcccggcggcggccgccgcggcgagggcgggccggcggtagctaggcgccgcggccagtgggtagccagccggcgagccattcacgtgatgcctttcccaggcttccacgcggtggcggccactcccaggtgcggcaggcgacgaggcaggcgacggccacaggatgcgacgaggtaggtggtggctggatgcgaactagtaactaccatttccttcctaactcctccaattaactatattagcatcacttgaatggagtacatagacccaacaatatgtatttgataattgacgtttattgagaaagtagctaatgtactatatttgtatggggacactttgtaatgcttgctgttctgttaatcacacaagctaaaatcatacaatgggggcaaaatcacaccagctgaaaaaaataggagcaaaaattacaataaccaccaaggatataaatgtccttttgctctacaactaacaccgtcaaaccgactgatacaagtaggggcataaggctggttcggatttaaaaagtgggggggtaaaactgcaaaccctaaaaagtaagggtaaacaattaattgtgtttgaaagtggggtaatgaatgtaattgtccaaaaattattagtgtagccactagtgggcttcgagttcgatcgacaggatttgctgcaattcatgccagcttccactttggcactttgagaatggaaatactccctcgtctctaaatattagacgccattaactttttccttatttaaaaaataagtaatcattatatcttttcctataatttgattgattgttaaatatacttttatgtatatacatagtttcacatatttcacaaaagtttttgtataagatgaccggtcaaacatttttaaaaaaagtcaacggcgtcaatttattttataactttcctcaaaaaataactctctcgctgaaaacaacttgtccagaaaaagaccaagtggtgtcatagcctgtccagaaaacgaccaactggtgtaaaagctcaactgtccctacactgactcacttatctgggttcgatcctcactacagtcccttatttcgaaacgaggatagggctctcgcggaacgaggtgtagattaagaagaaaaatgagcggactgaaacatgccactaaaagactccatgagacaaaaagatgggctgtcaaagaggtaaagaaggtaggattttccattttcatttctatcgtccgtgcaaggtactaaaataagaaggggatcacttcactcgctagcaagcaaatgtgttaactcatgagacaaggccaacgatatatatgtctatagcgaggtttgagtacctaatcacaaggatcctccagaatcttttcgagtgcttgttcgagaactaccttcccttcccctggtcagagtgttgaatcaatggctcttgcaacggctgtcttctttcttttccactttgaacgtatccctacatactgtcgtgctaaggtaatcgggatctcagatcatactcaatgaggggtggctagtatcccccttcaggggtatcatcccagtaagctcgtgtctttcataggaagggagctgactcccgctcccttccgtccatcagagacttcttcaagttttacaggaaaaataaccgctccgttctgtgggcttctttcgctgctctctaggatttaaccaaagcgacataattgaaagctctcgtctcagtcgctcgcctaagaaaaggtaccaggttactccgtgatgacgaataagcagcccagaaatgaggggaggcccgaggtagagcactcaatgggctagggtggcccccatttcgctttaccaaccccaggggaaactcaaaatacaggctatcatccttagtacagacagactgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctccatggcaccgaaaatgtctcagggctcaagtgattcaccgaagcgcagtcaaatgtttaggacagagggggtatatatgtgcagcgtgttccagagtactgcagaaacgaaatcactactacgacagaagatgaatgaatgattgctgtaatcgctcaagattcatcgatggatcagaagagtagtgtttcgctcgaccatcaccggcagcacactaaatatacacaaattaagttagcatgggctcgttatagatgtgctggttcacaaatgggctcaaccatggtccatttagaaggcccagtcttcacgtgaactggactgtaattccgaaagaattgggccgccgaatcatgcgccgacgtgggtctcccgtaaacatgggccgaaaaagcacaggtgctctctcctgcttcgtctacctatgctatgaaccttctccgagaattgatctgacctatacaaactacaaaagtcctaaaaatgaaagaagtaaagggataaacactcacttgcaacaagtagtgcttatcagttaagccaaacgatcattaatttggtcaaattaatcaagattagctcccacctgatcaatcgatgtgtccggccggcccgtacataattaacaaaagtataatgccaactacgagagtagctagccatgcatgttttttttaagggtatttttttacccggcttttatatccaatcgcatatatgcaacatttgtttttttttaaaaaaaaaggaatttagcctatggaatatgcaaccactaggttagccatgcatgtaggagtatgcatcatctacaggggattagtaggttgcttcttcttttgggcaattagctagccaattatgcatccatgctccatgtacacgcgaccgcccgatgcatgggccaccacacaaaatacatagattcgattcgattcgatcgatcgagagaattactaatgtcgttctccaagagtccgaagacgtacgcagggagcaatcaagcaactaacagaggaatctcacccgtacaaatcattcctggtttgaccatcgtttgctcgagatcagcttatagctgtagctaaacgtgagattaaaattttaatcatatagttgattttgattttttatcgtaattttatttgtcagctttcgacttttaaagaactaaaatatacgagtatttacagaaattttatctacaattttgttttgttttgttcgcaatcaatccatcaatcacgcatgcacatacatatgcttctcgaggcagcaagatcgccacgtgtgcgtgtgtccatccatcgacggccacgatcgatagcgatatactcctatatcgatattgatcaatcgatcgagatcgatcactgcagcctgagtgtgtctcagtgctgaattgtcggtagatgtagctaattaagctaagctagcgtctacctcaagtaaatctatcacacattgcatggatggaataattgatccaaagggccggggtacgtcgtcgtcggtaagtgtgtaattaacgcaagctaaattagctataatat

SEQ ID NO: 30069 - DNA, 1329 bp, Oryza sativa
gaagatacactttcagttttaaattcttgaatttgtttgtttagttaaaaatactggactgaagaagtctttgattttaaaaggtccttaaatttcaactttaaaatcccagtggctttgtcccaggctttaactgggtgtgcgatgaatttccatttgcaggaaaccgacaatcttaggaaatgggatcctccacattagtttacccatttgtgcaccatttgctctgcggtgaccatctcgatcgctactgcaaaaatagtataacaacaaaatgtcactgtttgtggcatcaatctactatgttactcacaactataatgaaccgcagagaggatccatatcaagtggtatgtaagagatttaaaactagtagaggagagtattgcaaaagtactcgcgacacttgtctctataagcacgcctatatagattgagacaatataaattgaggggctgttgatgcccatacagattggtgaaattattgtcgatatctcgttgttgatgcacatgacatctaaactaaaaagaacaattagcagtaagtacaaagcattacccgtaaatacaaacattggtattaagtcaaatactctaattaaccataaatataagcactaacgttatgtcgagacttttttttaatgactcgcactagatagtgtgaagttcataatgatagagtagaaaaaaattacaagattataatcatgtaatgtcgtaacaaggaaaacgaaaaaagaataccaccatccacgtaccgataacatcaacacatagacataagagaaaagctagcaccgaaccggccatcgctaatcgtgaccagccgccgctaggccaataaaggaactacaatcaagatcgcccaaaacccaaccattacaaccgacatgaaactttgttctatccacatctttgggatcaaaaaagttacgtcggagacttgaacccatgatagcaggttctaccgaaatgatttacaattttggccgtgtttagatccaaagtttttcttcaaacttctaacttttccatcacatcaaaacttacatgcacaaactttcggcttttccgtcacatcgttccaatttcaaccagacttttatttttgacgtgaactaaacataatctttgaaaagtttgattttgaacacggtggcagcaaagtgacacgaaacttttcagtgcgactagtagcagaatctcgggttttggcgcattacccctctgagcctcaagctcactcttggcctctccccttccctgccgtcgtcacgaaggaaagcgaaacggttatcgcgttaaccaccccgccctttcctt

SEQ ID NO: 30070 - DNA, 6472 bp, Oryza sativa
agcttacacacctctgtgaaaggatctttgatgtcatctcgctcaatgctgctctcctggggaaaataaataaaaattagatgtgaaacaggctacatcctcaacagaaaatttattctgcaactcacatagttggggaagataaccatgtcaacattatcaggaacatctaaaagcaatcgcctcagagagtactcccgggcaccagctggatgaattagctcatcggtatcaagatgaatgatccagtccatgccagcatcctacgataatcaaacagggagaagctcaaataaagctaatcaccaaaaacagggtttctggagaactaaacaaacaacatcatgcaaaatgccttcgtgagtaagcatattattataatcttgtgtgccaactgccaacaacggttgatgtaaaccacatcattcatatggcattggcacggtagtataacatgttacaattattgggatttcttaactttttgctgctagcagtagcaattgggctaacatttatagcggaccgtgaaaaaggatatgtgaattattgattatgatgattaactggtgtgtgtatttgtttttttttgtcaactttacatgcattagttgtaccatcccattactcaccctacacgtgagtgagaagaaaacaatataatgacaaaaaggttgattagttaattataccagagatattccccttttgttactgtagtattgttacacaaatcacctcatatcttacatgtttgtgctgtattatgctacacagttcaacagcgaggctgaacatgatatggtgataattatggttccccttagaaattgaggggaaatagcatggaggtagctgaaaaatgggtaaaacaaaaaggctatggtgcttttgaatcaaaattgtgataattatcatttcacaagagcatgattgtgaatattgaatcaaaagcgcatgaacatgcaaaacgaacagttcatacccttgccataatgatagccatttccatgttcagcgactgtttgacaaatagttcataattgcacggtttgtaaaagaaacctgccagccaagtctcattccaaatgcgactgaaaatgtttaacagtagaaattcagaccacgaaaaatatcaagaaaaatacaggttaacttgttagcaacatacacatatttcactagcaaaagggaaacaaacatacaggacccaaacaacatgaatacttcagaaataagaaattgcaaatcttgtaaaatgggttcgatcaacaaaaatgttatagaagcaagaaggtttggttccatctttactactagaactcaaccacatcatttgaagcaaacagtataagacttaatcactgcttttctaatctatatcttgttaaagcagtgtcctagaagaattaaattttagattgtcagtggaccaatctccaacaaaacctcatcttttacaaaaaaaaactctaaacagcttctcagtacatcacaataccttctgtcctgtttctctttcaattctttagttctgtaaatgatttttacaccctaaattagaaacaaaaagaagtcagaactagatcctgcaaaagtcatacaagtacagaacgaaatggtgcagagttgtttacccgaatggattcaagaactgaggtaacagctggtttcgcagcctctccttcaacaaaaaggaaaaagtgtgaaacaccgatgaccttgtggtagtacaaccatggaagaatttggtgtaaccctgcagatgtgcttcccgtgatacagatctgcagaatcatgaagatatattcaggggcataatcagttaacataagctcatcccatgataaacgagactcgcataccacattctcacaaataagacaggattaattttgatgttcagattacaaaaaagcgaacaattgtacaaccatagtagggtgcatgaatcatagttgcaccatccatttcaatgcaaaatacaagatgttcaaataccgaaattttaatggctcacacaaggaacatgcaagactgcgaatcaaccaacacccacaaaccctgtcaaccaaagttcttggaagaatgcaccaccccgacattgctctgtgtcaaacacgtttcctatctctgggctacagaattcggttgaaaaagacaatctctaagtgaccactaacctctaaaatctaaatcacatcaaataggactcaatttgatgcagtagcgaaggagcaagtcaggaacacaacaatctacaatctacgacaaataaatcagcattgaagcatcaaaatactctagaagataggaccttgcccgcagaacaggcctacacagaaagcaagagtacttaaaccctagaataaccatttgatgccatcgccgtattgcccaaactgcaaaatattgctacattccacgaagatgactatctcatcctcgcaggacagaaatgcgatctcaccaaaacatttcaggctacttttggatctcttaatatcgcggctttcaaattggattcacgtctaaagcaaagcgcaattcagcggcacgaggttcacatcgaggccgctctggagacgagatctccacgcgcagatcagatcggggagcggaaacctcaccttgggggttagtcccgcgtcggagtcgaagccccacccgcggtagagcgagatgccgccgtgcgaggaggacgccgcgctccggccgaggatctcggcgcagtctgcggccgcggaggaggactgcgacgaggtgacggcgaagtaggacccgccttccccgcccccgcccgaggaggaggaggaggatccgagcgggctgttctccatgccggggaacctctgcgtctccgcgggccacgccgcgcccgccgggtcgcgcatcccgccgcgccactgcagcgcgaaggcgaacgcggccagcgccatcggcagcagcgtgaggagcagcagcacccgcgtcgcgaacgccgacgccgacgacgcccccccgccgccgccgcccgaggcggaacccccgccgcggtatcccgccatggcggtggttggttggtggactggacagagacgccttcgccgcttttagttcggttgtactctctcccagcgtcgcacacgcgaagacgacgagaggagtgagaggtgagaacgagatgttgggccgagattaatgggccggatgggggtaagcagatgggataagtttactttgggtcactcatcgtggtgccgagttctttgaaccgcgatactcagatataatgcatttctcaacttgtaataccgaaagtagctaaggtcccagcctcccggggcaatattatgtctggtttttggctgacgttacgagttgattgtggttaacccggttggagtcaacatgacagggacagagacaggagtagggcaggttggccatactcctgatcctaaataaatattcattgaaattccattttaaaacttcaaaaactagaagataaagtcaaaattatatacattcaaccaattgagccctaggtttggaaaaattctggctctgccactagaacatgggatctacgtgttagagtatcctcaacagctcctctatctagtcatccatccggtgtttggcgcatggaggagaaaaacagtgctccagcagagtctccattgcacacgccatttttagaggtcctccaaaccgagcccttcccaagccaaatatggcggttctctctcctcacaccatcctcaactgcttacctcacaatcgaactcgcgccaccatctagactacataacgcgagagagtagcagtaaagaggaagtgcataccggagtagaggcggagaggtggtggatctggaggtggagagaaccggagtagaggcggagaggcggcgaatctggcagcgaagaggtgtcttcccactgctcttgcgaccgcgcctcccctccgaccggccgttcctcggatcgacgccacccggccatccccgccgctccgagtcaacgcccgcgccgccactcctctgaccgcgtcaccccgccgctcctccgactgtgccgctccctctgaccggccgctccttcgactcatgccaccccgccgccctcaccgctcaggtcttcgcccgcgccgctccccccgatcggcccacgtcctctcggctgtagaagagagagtggtgaggaagattttttttaagtggtgaaaagtgagaggaattgagtaaaaatatgtggtggttgaaaaatattaataaaatataggatgttaatatatggagaatgtaatatggatgatctgttgaagtgaaaagtaatatagagtgagaatctttttggatagccatctaattagaaatatggaagttgaaatttagatgagctgccggagatgctctaaatagaaatatgggataagcaaatctgcaagcacagtacatttgtctacaaccactttgctatcatcaccaggcaaaaaaatgaaaaagggaaaacttgtgaatccaatacacgatcatggcgatagtgcagtgccatgttacatgtctccaacaccatgacctaccaacagcctactctgctactcaccccacatgcactactctgctcacctgtattgatttacggcaaatccgaaatcagcaacgcacaacagccagggtcccagggaattctaaaaagaaaaaaaattactgcactgccccatgcagattttacaagcactgcgtatctctaccttatcaacatggttttttttcccgagaaatattcggtttcctagatgccacagagaactatgaattcctatgtctttctatcatttctgtgaagggatagatcaggtatctgaagaacaccaagaccaaaacgttcacttcggatgtgttcagttcacgctaaaattggaagtttgattgaaatgggaacgatgcgacggaaaagttgaaagtttgtatgtgtaagaaaattttgatgggatagaaaagttggaacctaaaccagcccttcgtcagaaaataatcaagatagaaagtttgttcctgctcctgctcctgcagtcctactaatcaaaagtaacaagatgcagccatggaccaattcagatatgtacattttcagatggcacatacacacacacgtacagtggtaaatatataaatatacagatcatatgatatgagaccatataactatatgttggttagttttcagaattattagctgcatttgcacatgttgtgtcgcctcgccctgatgagtggctgtgattggcgccgcgatgttcggaggcccgggatgcacgttgtctttgcatctgacaatgatcctgtccgtccaaaatagcaattgttttcaacttaattaactacgtgtgataattggttctgctgattattgtgccgcataaatgttagtatattagggcactgtcatgcaattgtggcaaatatattcagacatttgagctacttcttcatgcagaaataggagtacatgttttacatgtcacttttggatgaattgttttttaaaggtctagattacttctaatatcaatagataaacattgtaaaagttttatttcattcacaaaacaattcatgtaatcaataccaacataatactagttagttatagttaatcaataccagcataatacttctagtaattatcactaggattcaactttttgttttcggtgtttgtatcgggcagcgccgatatggtgaaatttccgaaatttggacccaaaattagtcaaatttgaacaaatattaccaaaattcacgaaaaaaattttaaaataaaatttttggccaaaataatatcgtatccgggggggggggggggagtccgaaatgactgaaatatccaaaatttcggtccgaaatgtcaaactctagctatcaccaccatggcataataacgacctaaccaacgggagtatttagcaacctacagctagaagaggcactgctgatgtttccttagtgatcagagcttgtggttcaattttcatattatcataatcatagcactgtcatgtaaattgggtagatggcatacatgcatcacttgctacatcaacagtgacacttgctactatatcatgacacaatttcttgtacacactacaagcaaggacattcagggataacaagttttcttgccagctatatcaatccaatccatacggtgtgggtgtcacttgggctaacctttaataaagttcaactcacccactaattacatgctactacttggattgtttataaatatcagatatagtaacatttgactaattaatttgagccgttgtgttaattttcaaatgtcttgattttctcggctttacgaatatatcgataagcatgttgggctgattgcgttgtgtatcaaacactctgctttcttctaatataattgacgtgcaattattttgtgcgttcgaaaaaaatgaatatatc

SEQ ID NO: 30071 - DNA, 1121 bp, Oryza sativa
tttggccacctttccggccagagccaactcggcctgctgtttgttgccccagaggaggacaacatggagacgatcgtcgtgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtagaagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggt

SEQ ID NO: 30072 - DNA, 476 bp, Oryza sativa
cacatatccagaagtcaatgtcgtatatttagtcaaaaacactaaaacagagagtactatacactcacaacatgctaacatgatcacaagctggcttggaattgtaaatccagcaggctaaagcatagcattgatagtgccagggcaggaccacatagaggaagcaagcaagcaaactgacctttcatcaaaaggattattattccagtgccttggtaggcatcactaggtactactagtagtggatgctgctctgcttggtattatgtcaacaagtactacacagcaataccaggggcaggcaggataaggaaagaattgacattgccacacacactagcagattaactgaatgaatgatatgcaatgctccacatccatcttctctcacaccgagccacttggaatgaacagatggtaaaccctaggaggggtagtcgccaccatctctgcatggtataaattcagcgctagaa

SEQ ID NO: 30073 - DNA, 3295 bp, Oryza sativa
acggtagaagaaaaggcaacagcagccttgcatgatagctcatcaataaacaaaaatgaattgtcagatatatttggcagcagccctgagccattcttccaagaaagagtagaggataaaggaaccgtgaatgatttgatggctggtttgaaccttaatggaactggccaagctcagcctgggattaaaacagaatctaacaatactgtcaatgtttcacagctctttgacatgaacagtcagacaacaaatgtggctaattctgcagcaatgactggtattcttggccaaagcttttatcagcaacagcaggttcccttgcagtacaacttgccatcacagatgctgttaaatccagcatttgctgggcagcaattaaactatggtgctatgagtgttcttcttgctcagcagcagcagctgctgcaaaatctaggaaatttcaatgctgggttgggacattcgtctttgaatgcaatgaacagcggaaatgcatctgtgcttcctgatatcttcaattcaagtaaccaacctcaacatgttgctgtgatgagcaactcaaagaaggatgaaactaaagcttttgattttgtttcggtatgcgctttcatcatgtccctaatttattcttatttcatttcatatatagacgtgccaatattaccaactgtcataatgcgtgggcagtatgaatctatggctctatgctagttgcataagatgttacttcagtttttgacatctgaagcaccatcctctggtgttaacagtcctagttttctttcaggatcatcttgcagcagctcgtggttcaaaaaagtaacccgagagcgatgggtatgttcagaatgtagcaacaatgcatttgtttggcttcacgcaaacttcactcgtactccatcgattagctggatcaatctcaggacaggttttgcatgttgtgctgcaacagatgacccaagaaagaaagaaaagaattcacgacgggggattgtgttgtatcatgtatctagacaaatgtcgatttttatgttgaaataagctgtacttatcttctcagtttcttttgatgccttgcctttttttttttcttttaaagagtcggacattgtagattgttctcgggcgggattttgtttttgctgctgtacaacagcatatttggttcttttgacgggaattgtaaagcttgctacgttaataacaggtgccatacgggaataatgatgcctcttgaaccatactgctcacatgttgagtacattatatctacgaactatctgcattgtgcagattatgaattactccctctgtttcgaaatgtttgacgccgttgattttttaagcacatgtttgaccattcgttttattaaaaaaatttaagtaattattaattcttttcttatcatttgattcattgttaaatatatttttatgtaggcatataattttacatattttacaaaagtttttgaataagacgaacggtcaaacatgtgctaaaaagtcaacggtgtcaaacattttaaaacggagggagtatgtattagcagcactagtatctagtgagataaactttggaagaaaattactgacaaatagacttgtagctgagttccacattgttaaaaccttgtagtaatgatgcttatggttgtaaggtaattgcgatttagaaggaattggaatttattcttgcattgtgattaatatttctcggaagaatgtgttaggtaacttcatcaatctcaagatatgttggtccagtttttcgtagatgttcataaggataaattgtgcgtgtgttcataaaaataagtgtacatgtactatggacgtctgcgtttgtaccgtgtaacatttttttctctcgttttgagaattgagaaaccttttttctcttgttttgagaattgagaacaaaaactttgggttttgctagttaattgtcgacaattttcagctttcaatttgttggctgttcgatctggctctagattcgccaagattcgtattggtggaggaagatccggctctaagatttgccaagattcgtgccggtggaggaagatggaaaaagtttacaagcacaccatggggatcgaacccaaaacccgttcgatttggctctaagattcaccaagattcatgctggcggaggaagatggaaaaaatttgcaagcgtgccatggggatcgaaccgaaccctgcagtatacacacttgttccattaattagttgctccggtgcatttttatgagagttactgatcgaacacgtactataattatataataatagttacatttcaaaagctttgattgtttgtgctggttgcggcagcacctaaaagtttttcatccaaaaaaaactttgttgtatagctactcccaaaacttttccaggctgtttggcctaccgtacggttcctcctactcaccctcaaaccaacgtgtcgaataaacggcaccagtacttctttccccagcggggaccacgccacagaagatcataggatccggggggcccacctgcgaccaggtttccctgacagccctggcccacaccgtggactcaggctccaactcgccacctcgcttcccttccctccctccccgagttacacctgaccccgtcgaaccggagtcgccctcgccgaatcccctccgctgacgagtgggccccaccgcgtctctgggcccactggtcagccgccgccgccgcggggtgcgaaccccggatcgcataaaatcactacgcgcacgcggtttttccgcctcggccgcacccgcactccaaccagcgcgagcggcgtcctcctcctccgtcggcgtcggcggcggcggcgacgtccatggacttcgggtgagtcggccccctcgtcgccgccggccgaccgaccggacggcggttctcctctctccggcgttgttttgggacttatttttatttttatttatttattttggaatgtggtgtaggtacgtcggcgtggggcaggggagctcgtcgtcgtcgtcgtcggcgtcgtgccgagcggcggacgtggcggcgtggggatcctccacccagcagcagcagaagcggcagcggtgccaggtcgtgagtcgtgaccaccccggcggcctgttccgtctcgtccccgtaataataaatttcgctttccccgagtttgatcttggcgttgcttggtggcgagtgcggtgtgcggtgtcaaaatctgcgatcgaggtgcatcgcgtttaggggggtttgggcggggtcaggaattgggggttttcgtgttggggggggg

SEQ ID NO: 30074 - DNA, 5746 bp, Oryza sativa
aggttcgatcctcggcactagggtttgggtttttggtagtggtcttcgcccgcacacggtttccgttgagttctcgtgtcgcgtgaggctaccagaggggaagaaggtgatgccggagaggaggaagaaagcggcgtgggggcagtggccctgcggtggggaatggcttgctggcttgccggtgctggcacctatggcgcattacaggcagacgcgctcgccaagcgtctcgcgagtgcgagtcatggggaattggggattgtgtgcgatggcggctcagtggattggggaaaggtgggattactgtttgagtctatgtgtttggaggggcaaatctaatccgttgtattttcatctgataatcggaaattcgactgatttaggggttaagaacattcaaataataggtagtcaatctattaatcgttttggaatcaaggggcttgcagattcattcatgcagcatctagcctttttggggttgattggtgcagtaccagccataacatgtcattactctgatcttggcttctgtaaataatttgaagtgcaactacagttctccaatctccacaattttcaccagcacctttttatcttccctctttgaggactgacaaccattttattgaagaaatttatctttttccccaaagttaattagtaggccatctattatttgccccatgtttaagtgaaaactatatcttttgcctcaattgaagcttttacccctactggatgacacatcttcagaacaagtggctggagaaaacacccaaaatacaaattatttgcacacttcatagtctcatagatatctgtctgctgcagagtcagccggatttctaatcagccggtcttacttttttgtgacttttcttgtcataactaggaaagtagtggagagtcaatacattttacatcatcaagtactggttagcctaacctataataacatacttattcaacagggttcttctgatgaccaagttggattgagcacaagtaattctttgcaaatgtcagaaccagagcctcgagattttgataatggagaaaatgaggaagaagattactatctggacgaggacgattgcatttatgatgatggcgatggatatgattatgaatttgatggcggtgactacttcaaccaacgtcttgctgataaatttgatgatttggatttgcctccaggcgtggaggctactgtaccttggcttcagaaaattataactaacgaagagcaaagcagttccaaattgacagttgaagatgaaagcgcaaataaaagtgcaaataaatctcagttgttcaaacagtttgacactgttaaaaatttctctgatcatcattatgcagcaacatcaggggatgtggtaatatgttgaatttgttgtttgcttttgttttatgcttgttttagatctgttatttcatttttcctccatgtttacattatattagacaaagagagactgggtgaagaggattcagcatgactggaaacttttggagaaagatctaccaggttagctatttgcctactggcatagtgagttagtttcttctctgcatggctgcacctgtgagttgatcgttaagtacccctttcacactaaccatgcattttgatgcaattagtgctaatagtttgctggtcaataatccagcacaagcattgattatgctgcttacactatttggtttattgactatatatgctcgtcatgtaagtgccatgtaagttgaacacaactgttcatggtttaaatatgtaacctgaatttccctttgagaaactagtatttcatcctgtccttttgataaggcttcatgtagatgtgatgctatttcctttcatttcctcttattgttttattctcactgtggaacttatgtctgcctgcacagaccattatcttttactactatctagtgagggtactaaagctattttccttctcaatcttagaacttacatctttgagccttgttaaagtgcaccttataagaaggaccagatttgatttttcttataacactatcagttctcaagtttgtttccaaatgttgtttatgttacacctgcttttcgtctgtaaaatatctttgggaatcctgtggtgggtttgtttccaaatgttgtttacattatgctgatcacctgccttttgtctgtaaaaattcttgggaatcctgcagtgagtttggaaatagtgaatgatgcttatgttaggatttagcatcctgtcactcaccattcatagctcatagatgttgaacatatcaggaaaaaaactttagaggaaattggacaaactatagctttctttgttgcagtgtattttctcattgtagaaatctgaatcctgattatttttgttttatgtagcatctatttatgtccgtgttgctgaagatagaatggaccttcttagggctgctattatcggacctaagggaacaccgtaccacgatgggctcttcttctttgatattcaatttagtaactcttaccctgctaatcctccagtatgtgcctaagtctcagcactgcttttatgacattttcacctttttattttgttgaaatatttgttgttgatgatgttgcagtcagtatactaccactctggcggactacggattaacccaaacttatacaataatggaaaagtatgccttagtcttcttggtacctgggcaggtagtggttgtgagacgtggaatccatctcagtcgaccatgctacaagtgctcgtttccattcaagctctcattttgaatgagaagccctacttcaatgagccaggatatgcatcctacgccaatagtgtatctggagagcggattgctatggagtataacgacaacacatttttgcactcatgcaggacgatgctctactcacttcggcggcctccagaggtaatatttttgttaatttttgcatagactctaaagctgaaaagaaaggatatttgtcactttaatgcaacctggaaaccctgtccagtaaacaatgcttgtgacatggcagtactttgccacaattgccatatagaagtattccctctgttcaaaagaaaaggcaacctaggaaaggatctccctctgttcaaaagaaaaggcaacctaggaaaggatctaggttcattgtcctagaatatgtcacatcctatattcctatcctaggttgcattttttttagacggagggagtactgattatggttagcacgcagaacatagagattgatggagggttaaaggttattttttcttgaaaataatgattataggtggaggatgaaacggagaagtttgctgaataaacacacatgatttgatttgactatagcttggtgctggattatgttaccaaccctacttccaatttttaacatcacaaagtagaacagaaatcaagtttccaagccgctttaacactcctctctttgccccctcgcagcacttcgcagaccttgttaccagccacttcagggagcgcgggcacaccatcctggcagcatgcaggtactacatggaaggccacaaggtcggatcggtggtccccgaagagaaggagccggagtacggcgacgcgggagcatccaccagcagcgccagcgccagcgccgccgccgccgctctgaagccgcggccggacaaggtggattccgtcagtagacgccccacgttcaacgacaacctcaagacgctgttcgaggagctcctgatggagttcaacgtgaagggcgccgacacggccaagttcctcgccgagaaggtgaagaagagctctggtgcaacaactactgcgcctgtaggaggcgcccgttatgcagcagaagtggtggatgagtggatggattagtctgctttgcctaactgcagagaagttaatatctttctctctcttttttatttcgtagtacataattagcttatggttgctaggactggactgggctgaacctgttgaccaagatgatgaattaaatagatatatgcctatccatctcaaggctcttaagacatcaaaaggttgtccgcaatctcatgttaacatgtacgtacatatgatcgatcgagattgacgtgttcctacttcgtagggtgcatagcaagtgtcatgtgtaacgacgtacgtatctttgtttctactctctgaatacatggagcaaatcaagcttaacatcaaaatctgaaatgataaacattttgcactgaatccagggtgcatcatccaccaatcatactcatacatgcacatggaaacatctcatacatgcacatggaaacatctctctcactacaagtacacccaaaaaccaaggcgatttcatatagatctacctatgtttatctgtcctagttgaatgtgcaatctacccttcttcactcacactaccatgcatgatcactcttaacttacaaagctaaacaccaaaaaaccttcttgtttacatcagatgatgacccaggtgacatccaaaacatcacattgcatcgagcggcaagcgatcgatcgatgatcacctgaaccaaggcctcgcattttttgtaattggttttaaaacacgattaagtttatactctttatcgggtaatttgcatatgatgaagatcatggcgtccggtgaccacctatggcaccgtgatctgcacgccgccgtcgccgcggcgaggagcggttcgggcgaggaggaggaggccgtccgccgcgccgcgctcccggtagctccagaacgcggcgtcgttcacggccgccggcggcgtgggctggcctcggggccggcggagcagcagcgccatgccgaggccggcctcgccgcgggactcgaggcgcgcctgccacgcggggggccggaaggcgcggacctcgacggcgtcgccgtcgtgcatggcgtggcgcgacgcgaacagcgaccactgccccgtgagcggtaggagcggcaggtcggggagcggtcgcgcttgagcgccatggcgtaggcgcggcccaggcggtcgaacgccgggacggggaggccgccgccgtcccccgtgagtaccaggtggcgctcccccgccgtcagcatgcccagcagcggcgacgtcctgaccagcccctcggggaggacgaggcgggccttctcgcggctgcggtccgacggggtcagccgcttcgtcagcaccagcgccggccgcgagatgcggaggcggcgcagctcggcgcgcagcccgtcgtcttcctccacgccgggaggagtaggaacagccggccgcttgcccccgaaccctccctgttccctggcatggttcgccatctcctggatcgtccacgccgccgcgtacgggtggtaccgcagcagcctcttcttgggagggagcatctccggcgggacgccggcgaacgcgccctcaccgtcaccgggcacgcgcccctccacgtgcggcaggtgctcgacgaaatgtcccctcaccgaacggcacacggaggaggccgggatcgtcgccgcgccatgccagagcgggaaccggatggcgccgggcggtggagggcatggcggcggcaatggcagcccgacgcaagggacggagaggtgggggcagaagggaggcgacggcggtggtgggcggcgcgtcttgcttggaggagaaggtgggagtggtggggtagtaggcgcaggggaccagaggaggaagggagattggagatggagaggccccattctcattctctctcctcgtctcgt

SEQ ID NO: 30075 - DNA, 2102 bp, Oryza sativa
ggggggggggggggacaccaccattgcaactataaagattagcacgtataacgatggtagtgttgtctcgccacgtcaggtgagacggtgcgtgtgaaccggttttgtatctttgagacgcgcatgggtttatttgtaggtttcctttttaaaaaagaggtttggaaagatctaaatgttgctaaaccgagcgtgtaaagttggggttattgggatggagaagggtggtagtgtgatatggtatgcgcgagaaaatccagcgaggatgtgaaagctagcactggccacgggtagcacctcggattagagcgaagcttatcgggtcacatttgtctggtgcgcaatagaaaacaactccgacacatcactcaaatatgagggatagatcatatgcatcggtctgatggttattttctcagtggaccccatatttaatacccaaggtgatcatataaaacttactttacggtgctctctaatctaatagtgttgtgttacaagtagaaaatgatccaggttgttgatttctaggctataatgtatttccctacatatatgctttagacattttgatcatgcacataacctctgttgcatactgattggcgatacaacaatgtaagacctcgcgatataggttactctagttaaagttactaatacattgaatataaaaactcatcatatctcgaatatagtgctaggattttcaactctaaaaattaaaactttagattttagaagtccatcccctaatgaaaattataaggttacttgacaaacctatttttctcatgggcagactaactcatgaaccatataggtaatagctttcattcttcctccttccttttctctacgtgacgaaaaaccatcaatttctgaagagcgtatattcttctattatactccctccgttttgagttataagacggtttgacctatttcaagtttgattaagtttatagacaaatataataatatttataatactaaatttgtttcatcaaatcaataattgaatatattttcataataaatttgtcttgggttgaaaatgttactattttttctacaaatttaatcaaacttaaagcagtttgatgttgactaaagtcaaaacgttttatagcatgaaacggagggagtagtaagttatatccctcaaccatttcacttcacacatgataaatatacatgaaaggaaaacatatatcagaggtctcttatcttatcaccgaattacaaaattatccctcaactagcagaccttagatatttgggttttcggttgaaggacggttttgtaattcggtgaaaagatgagggatttcaatgtactttttcctacatgaaaaatagaggaagaagagaaagtcaaggcccaacaaaacctgggcacgagccaagcccaaaaaggtagaggccctaaggcccaacggcccaagcccaaaagctactctcgaatctcgagctagccaagccaagccaagccaaaaaaagccctagccgcctcgtccccacccaatcttcttccctcgccgctcgccgtgctcccgctcccgctccggccggcgaccaccgggaagaggagagctcgagatgagcttgcggccgggcagggcgcaccccctcgccgcgtctcccctccacaccccgctccctgctaggcctaggccccagctgaggctgagcacctccaccagctgcgccgccatgaagtcgtacaggctgtcggagctcagcgacgccgaggtcggcggcctcaaggcgcgcccccgcatcgacttctcctccattttcggcacggtgagatagagacgagatggagagagagagagagagagagagagagcgagctacactagccgtggtcactgcgtgaatttgtgattgattgtctctcaaccattgggcttagtcttttttttcttttttttgggtgcgagtaggtcaatccgattgttgaagacgtgcgcatgcgaggcgatgctgcggtcaaggagtaagtgatgatgatgatggtgtagtgttcgatccttttggaccatgtatagcatgatttttgtattgacttcctgggtttggtttgctcagttata

SEQ ID NO: 30076 - DNA, 3113 bp, Oryza sativa
  unsure (1)..(3113): unsure at all n locations
atatgacaacatttatgccttccacgtttcgcaaaagttgcctgaaaagactgttgagaatatgaaagtaagacccatttgttgatcccatttagctctaattccatccctgcctttaccttcctctcataccttttgacttgtgaactcttccctggatgtgttgaagggtgtaagatgtaaaagaataacaagatgcattggttctgttggcctttatgtcccaggtggcactgcagtattgccttccactgcattgatgcttgctgtggtatggtcatgttttcttaaattgtgttaactcatcattctcttctcattgttttttacaatttaatatagtaaatctctttctgccagcctgcacagattgctggttgcaaaactgttgttcttgccacaccccctagtcgtgatggtagcatatgtaaggtacaattttattggatgcaggattgctgctatttctgagaagttgatatgtttgtgtttctaatgttgaattatttggaatcggttgttgctcttgtcctccgcagaaggttctttactgtgctaaaaaagctggtgtgacacatgtattgaaagctggaggagctcaggtaggacatttgatagttcatagtactatcttgtgttccccaatatggcgttgagttaaattattgttgttttctttcaggccatttcagccatggcatggggaacagtctcatgcccaaaggtacttggaatcttttgttctgtaacttgtaggggctatttttaggtgcaccatgcaggggataggggctgtggtcttctctttactctatatatgattgttatagaactgcaaatatgagtatatgacttaaccagcttgagcagtttttgtgattgtattctgagtggattcgtattcttctaatacaaactagggaaatacatatgcactattgattctgtttggctggcttattgtcactagtgttaacttagcagacttcagaaatgctttagttgcactagtatttttctgtactcatttattcataacaattgtgtcatttccattatttgtggtgatcaacttatatactgtctttgtaggttgaaaaaatatttggacctggaaatcagtatgtcacggctgcaaaaatgattcttcaggttctattctgatcattctgtaaaatcctgaacaatatctgccctggtgacaatatttttcttgtttgatggcagaacagtgaagccatggtttctatagacatgcctgctggcccttcagaagtattagtgatagcggataaatatgcaaacccagttcatgttgctgctgatttgttatctcaggtatcttctattcttaataccctgcttcatactggtgaaatgtgtacttgttattgaacttcctttactctttgaaatgccatatttgagaatctgaggcataggaattacatgatgtcgtgaagctttgttaagtatcatattatattatataacagttgttcgttcaaaattttaggcggaacatggcccagacagtcaggttgttctagttgttgcgggagacggtgttgatttgggtgctattgaggcagaagttagcaagcagtgctctgctcttcctaggggagaatttgcttcgaaagctcttggccacagtttcactgtttttgcgaaagacatggttgaggtaattcttcattcctgcccactctcgaattatttataatttgtaaggcacgtactatacatcactggagtttgaggtcgtagaattttgcagcatgcatgaaggtaaatgaaaattatctgatctattgccgttcccagggattgttgacaagccccctctttcttccttatgtaggcaatttcattctccaatatgtatgcccctgagcatttgatcatcaatgtaaaggatgctgaacagtgggaggatcttgtcgagaatgcaggtataggcatacctgtcagcgtcttaatcttgacntgaacattttcatactcaatggtaaatctcaggcgatcgttttttcatcacagggtcggtcttcttgggacaatggacccggagagcgtgggcgactatgcaagcggcacaaaccatgtccttccaacctatggttacgcaaggatgtatagcggcgtgtcactgaactcattcctcaagtacatcactgtccagtccttgtcagaggaagggttgagaagtctgggtccgcatgtggcaaagatggctgaagtcgaaggactagaggctcacagaagagctgttaccctcagacttcaggacatcgaagccactgtaaccgtgtagatttgttaccatgattgttctaggggccaacttggatgcagagaacaagaatctgtgaacaccctaatgagaagggatggtccagctgtttctcgaaataaggctcatccattttgatacatctttgaatataaagtttgtttgattgtgttacactttcaagtattcaagaggacgaaatctgtgaagactgtaaggaaaagggatatgatccagctattactcgaaataaggcccatccattttgaatctttggtccgtctattgaatgcaaagtttgttgactatgttactactactactcaagtattcaagaggggtaaacctatgtgcaaatggtatacaatttcagtataaaaatattgacagcagggtttcacttgcattatgtttctcggtagataccgtgatgatttgcacttgataatgccaatctaggtataacatatgtgattttacatcagcacaagacatcaaaaattgcaagattatacaatgtccatgttctaacatccccagtgcttatctatacacataagtgaagcggcatacgcagtctgcagtctataataatctcatcatctttgtaaggttagcgatcttaaatcaccgaaacagctgccattggcaggcatagcggtctagtttttaactccggaatcccactcagcttcacgatagagcagtttcgacggtttgatgaaggaaaccgggaggcgacattggtggcatcgcttcttcctgggcatcaaccatttctaggatctttcttactgtggcttgcaaatgatcacct

SEQ ID NO: 30077 - DNA, 7105 bp, Oryza sativa
aacgacaatgataatatagtggttatgttttgtgaacccttactgtatatgatcagtatttggtagtttgtagttgtgggcagtatactgtaactgaaagcgaaatattaatgaaagttatatatttttaggaaatacagtacaaatacatacgctcacaacacgtgcacactcacttctatcaatacacatatgcatactctacttcaatgaaccctcgaaagactgggccgatatatatcctgagattacgaaggtatcatgagtacctcgttgttaacgggtgtgtcgtctatcactgaaagaataataagtttagaacttgaacttagggtgtttagatcacaattttttttttgccaaaaatgtcacatcaaatgtttggacacatgcatagggtattaaatgtggatgaaaaaaaacctattacacaatttgcatgtaaattgcgagacgaatcttttgagcctaattgcgtcatgatttaacaatgtgatgctatagtaaacatttactaatgatagattaattagatttaataaattcatctcgcagtttacaggcggaatctgtaatttattttattattaatctatatttaatatttcaaatatgtgcacgtatactttaaaacaattttggccaaataactaaacacggccctataggtggaatggttccaccgcatgtagaatctaactagttaaagattaaaattttgaaagcacggaaccgctaattaccacggcgttaagggcgctaaatggtggatctatttaattaaaatcgtttataccaaaaataaaaatgctgatcagtactggagacttgagtaaatccaaatcaaagaaccttgaccggataaggtagtaaggctcttgctggtaactgtcaccaaccaatacttaattaattgtagttgagttatcataagaaccaattaactaatgccaaccctccataaactgctcccttttgcccagaaattgtgtgtcgcacatagctttcccgatttctgttgataaagcaaaagtagagagagagagagagaggaggcttggaaaaaaaatggacatcacaaaagcaggagaagaattgcaggggaaagttcagaaatgaaaggagtgaagcaaaaggaagataaaacaaacaaaacaaaagcccagattcctctccaaacatgccatgcccatttcccctccaatctctctcatctcctctctctctctctctctcttggttctctctctctttctctctctcactagacccatctctagaaagataaaggagctatgaaagaaagctctaaaaaaaggccatgagagaccttaaagattgacctgagatttgcacaggaaatttgcaacaacaacaacacaacgagatatatcaccttgatatatatatctgttgcaattgcaagaaaaattcttttctccccttgcaattattctgtgctcatctcaatcaagctagcatgctgagtagtggaggggagttgaagagctcctccttggtgcagcagatggtgtgggttggcacgggcaacagcagcagcagcagcatcatgggcagcttgaggcagctgccttgttctgaggagcaagatgcagcttcgtcttcagcctccatgctctttctcccccagcagctgctgcttcatgcatcttctaattcatcgccatgtctgaacattcctgaggtgaatctcagcactggtcttcatcctcttgggagcttccatggcgatgtgcagcagcaggagatcatcagcggcatgccagatcagtcatggagacaactgcttctgtaattaattaccctctctccatgcatctctgaattaattctctgtggtctagtcatgaaattgtaggtgcactagctaatttgattgttaaagtaattgtaggttaattacttcaggcgaggaaagtagttaaagcagttgtctgctgcttttattccgcttttgggtgctttgctaatcagcaattaatcacatgtacatctcacacatgcatggcactaacttgacactaattgtttcttcctgcatatgtgtgtatacatgtactcctacttgccttgggaaactacaaatcataagcagtggtggattagttggagatcacgagaaatacagtgtggccacagctctcctgtccaaagggctagatgatgaggcctctatgcctcacgaggcatcagctgctgcttatgatttctatggacatggcggcggcgccggcgatgggatcctgcaggcatcgccggaggccagcagctgcaagtcgcagctgagccagatgctcctgcaggcggcggcatcctctcctaggtcatgcgtcaccaccagcggcctcggcagcagcatgatggatttctccaacaccgcggcggtggcgccggcggcggagccggagttgacgaggaaacaccatgcaggccagtcagataactcgtcggaggtgagaaaaaaaaactaatcaagactgtactgtgaaaattcattttgtaaatttgtatggaaatttcttctttctttctacattctcacagatgtgatctccttggtaattgtgcagaatgactcaattgagctttgctataatttccctcctttggtgaaaagctactacattttccatgtcccttagggaaaaaaatcactttttgtttgctgcttatgcatgtacatgtgccaaacctgatcccatgtttcaaacttttcatttgggatcttgctttcatgatgatcccttgctaaggttgtagagagatggatacactttaattgcatcatgccacacgggcaaagttatttatttttacatccataaagtcagtgtgtactgagctagctaagctatatatattttcgaccttattagctagctatatatagttgctcatcttgggacaaggatggaatggcctcatgatggttcttgcttttgcattggcttgtttaatttgttgtttctctgctgctgcagtgtaacagcacagagacaggttcagctcttaagaaggctagggttcaagcctcttcttcagcgcaatctaccctaaaggtttcttcacgcactccttttcatatctcactttatcatctttggagtatatgttcatcttgtgcctagctaaccgcattttggaatctgtctcgtatatacaatctagcctgtaaaacaaaagatgtaagggaaattaacattaacactttaagattctctggtttctgatggatttaattttgtcgtaggtcttgtgtatgtggtcacgtttacatttagaaagtgtacgtgtcctcgcagaacaaatacatcaatggaattgaagatcgtagcttgctacattgcatgcattacaatacataatttgtatctcttctataccaaacattttatttcaggtcaggaaggagaggcttggggacagaataacagctcttcaccagatagtttccccatttggcaaggtactacagcaacttaattaaccacaaatcactagttaatgtaatactacctctgtcccacaatataattatattcaaatttgtcttaaaataattgtcactgtacattactaattgttccatatcattttttattcagatttattcctattttatcctcaactaccttcccactcttacctatacatcatttaatgagaagtaccatagtctttcatcttaaaccttaatatatgctaaataaattagaattacaattattttgaaatggatgtagtagtgcactgcattatatttgtaaactgcacacaaagaggctagcctagctagcaccaaatatatctactaccagtagattttatactttgcatgtgcatgcatatattctagtacctaggtagttctagttcatgcacaacatgtcaaaaatattcttacgcatggttgtttgtacatctgaatctcttgtgcatgtataggctttgaactctggccttttcctttttgcaactgttgttaacacacacacaatgacacaaatgtactgctaacaccgtaacacgtagtacaaattaacaaatgtactactggagtagcatagtgtagtttctgcccatctcctcgcttttgagctgcatgcagcagcttctttcactttataggagtcgtgtgagtgaaagtaaagcaagtctctgacatgtatacgtgttccttcttttgcagactgacactgcatccgtactgcaagagaccattggttacattagattcctcctgggtcaaattgaggtccaaccccttctctcaccctggctaatcaattagccactccatttctatcatttccatccatatatatacatagagagagttctaattaacttcagagtgcatgtgtgtgtctgtctctgatctataaagctatatatgcatatgttaataatttctgataattgattatatcaagtatgaatgattatatatcgcagtaccaagctatccactaattaatgcatatgcatgttttctgtcttgataaaaaaggaaagctcaaaactttctgtttcagttttgatttgtctctttgaatcattcgtttgtgcaattaattaacttctgaagcaatgcaagcatatttggatatatatatatatatatatatatataattaccaaatgtgaggttagcagcaggatgtggggcttacacgtatacatgtgacagaaattattatgtaaataggtgaacccccctaaaaaagaggacttatattgaagggtactgcatgtgtggggctgggtgtaagagcacgctgttaaagctcgtttgcatatgcatggcatggctgggtcatcgtagcagctgcagcctgcgcatcaggctgaagccacagcagcaagttgcacacatgcatgtacccttcagtagtacatgcaacatgtgtgatgtcttgttctatagctagtaattcagatacatcagtaattcagtagttctaaaaaaaaatcagtaattcagtaatactgtagattccctcttgttgattgcatgcattgacatctgccctctctctctctctcttaaattaaggaggagaaacttgatgtcgaataataataataataaaagtatgattgtacgtgttaagaattgaacacaaaattgatcttggtgttggaaccaaacatccttcatcgttattatttcagtggcaaatgcatctccataatatataagcaagtacatgactagtactcgttgtctaatttgtaggctctcagctacccatacttggggcaatgctgctctgcgaaccccatgcaacagcaaactgtaagtctctctctcagtgatgcaagtataatatatatagacgcacaatacttaggtacgtgaaagtgtacttgcagttaattaagaagcttagttgggcacgtgcaactaaaggttatgtgccttagaaataagggaaaattggttccacgccaccgaaagttgtccagttttgctttgtaccactaaaagatgccagtgcactttaataccatccaaaatttgctccgttagctttcataccatttccgtgtaagtcagagtttctcccgttaagcatatctaaaatgcccttgtttctggtcaacaaggtcaagcctcaagcgcaaccaatccatacatggcgttggcctgtatgtatgtccgccgccgcgcatgatgcaaccggagcacgaagctgtgcttgcgccgaagccgctcatcgtcctggccacagcgtgcgcctgtagctacgcgcctcctgccggagtcgctggtcctccctggccgccgaagccgtgcagccgctcgtcgtgctatatttttatataaatttagcaaaacttaaaagaagtttaacttcaaaaaaaactaattaaaataacttatagagggtgtagaaactgaaaacttggcaggaaagcactagcagtggtggtgacctggtgggtgcacttaacatgtcgggaaattaaaatggaatagtgtggtctagcttatcagtccaaatctggacaaacactgacagttacttatgacggagacgatgagctaatccttccatggacagtcatcaagaaatgtctaaaaaaataaagcagtggtttatctcgaccgagcaatttttttcccacagattactagcgatcgacatgtcacgcagatgcatatcatcctcagggagaaatcggggtgggaagtgtttatcgatcgtgcagtggtggcaaagctaagatgaataggacatacatatatttggtcacgtttattttcttcaagggttctatgatcaagttcagtgtactttggcgccattggttgtcaacgtacgtgttgggggtttgcacatcagtttctgatgttgcatcaagtgaaattaacttgtcttaaaaaaagagaggtggaattaacttggatcgtgcatgcataccggctgtagagattagagagggtggcttggctgtggcctgtggactgctacggtgctaccacatgttgggaaggactggcagatgctgtaatccttctctacaaatttctctccgtcctataataaatcaatctatcatctctatctaaaatataagatttttttagattaaacatgttaattaaaaagtatgtagaattaaatatatgaatgttataatgggatgagaaatgaaggtaggtacgaaaaatgaataatgcatggttataatttattggaaagaaaatgttggtggaaaagttacttatatttttgaacaaatcctgaagaccgaaaaaattattatattttagaaagaaatgagtaatacaaaaatgtaacaaagagcttaaaatgtactcacatctcatatagaggagtgtttggattcagggtgtaaagttttggcgtgttacatcagatattatatatatggtgtcgcatggggtgttcgggcactaataaaaaaactaattacaaaatctatgagtaaaccgcgaaacaaatttattaaacctaattaatccgtcattagcaaatgattattgtagcaccacattgtcaaatcatagagcaattaggcttaaaagattcatctcgcaaattagtcacaatct

SEQ ID NO: 30078 - DNA, 1318 bp, Oryza sativa
tgttgtagacatcgataggttaattagcatgtatatatggagaagcttttgcaaaggaggtatgcatggtatatatgagtagcaaaagtaaataaagctttctggtgtcctctcaaagaactatacatacacgttaacacgtaccatttgttttcactctttttgaaaggaatccctttgtgactcaaaagaaaaagaaaggatataagcagtactagtatatgataattatacagtatatacaattatctatgagagaggagaaattacatgcaatatatagctaggaggatatatatcaatattacaatatatgtactcatcagtactacccaagaaacagaaggaataattagtgtgttttggctgtgtttagttcagcgcaaagtttagattttagttaaaattagagatgatgtgactgaaaagttatgtgtgtatgacaggttgatgtgatggaaaaggactgaagtttggatccaaactttggatctaaacacagcctttgtcgaaacctgaaaggaatacacgtactagctagctagcacgatgcccatgtatgcttttatatattctcacaaataacactacaacaaaaacctggtatagaggaacttttgtagaggcgttttgcaaattgcttctaagatcagaagttttatagtgtagagacactttataaaggcactttacaaattgtctagaaaacttttactctagagacatttttagctcagtttgttagattttatcttgtagaggcattttttcggcactataaaatgcgtctaatatgtaaaggcattttgttgagacattttaaactatatagagacactttttagaatgataatgtgtactaaaggactaaatataagtaactaaaggaactaacataaaagtaatgatatggagtctagttggttagtgcatttaagataaaaatgatttaaccgagagatcgtgagttcaaggcttgacaaaagaaagaaaactattttattctcatttttggattggttttatatgtttgtggtacaatttaatgtctctagaaaatgcctctaccatcttatagacactttataaaatgtccatttgtttacagagacaattcaccataagacacttattagacattttttaaaatgcctctacattgttgtaaggcatttgaaaagtgcctcgacagcactagaaaaatgtctctacaaagtctttttcttgtagtgtaataaaataatatatgcaccttttttactcattacacatattggacaattatattgatcgatctactgtacacaatacacataac

SEQ ID NO: 30079 - DNA, 707 bp, Oryza sativa
ggaaataaaatataacataacaatattgtgcaaaatgtgcattctagactcatccaatagtcgaactagactacagttttattgacaataagatgttatctgccatttcaatatgattttggtagacaatacagctttcagaacaactattagcttcagagaaaaactattccttctgtttctaaatatttgacaccgttgactttttagcacatgtttgaccgttcgtcttattcaaaaacttttgtgaaatatgtaaaactatatgtatacatataagtatatttaacaaggaatcaaatgatagaaaaagaattaataattacttaatttttttgaataagatgaacgatcaaacatatttaaaaaaatcaacggcgtcaaatatttagaaacggagggagtacatgttgatgtcatggaaacgaaagagagaaatgcttatatatatatatatatatatatatatatatatatatatatatatatatatatatatactccaccgttctttttgtatgatgttggttagttaaaaatatactaaccaacgtcatacatttttggttggaggcagtatttactaaccttcagttctcgcttctcatcacttgtaggtgctaggtttgagctggtaaaggcatcaattataatgtctgattaagtaaaaggaagtgaaggaacaacattttgcataaaaaagattg

SEQ ID NO: 30080 - DNA, 7118 bp, Oryza sativa
  unsure (1)..(7118): unsure at all n locations
gcaacattgtcgccgttatccatgtatgccggcaaggacgtcttttggcggtgaacatcgtgatctggcagatttgagcaagcaaagccattcgatctgtataaattgcaggggaatcgatcaggttgcgtgtcgctgatagagttggttacaccctctcctctactagtagtagaactgaatttcttgtgaatatgcaactctggagccaatcttcaggacagaatgcagaggtgactacatgacatatgacaccttagtggacctcactgtgatttgtctccgagcaaataaactgattacgatgaccaggtaaacttgccatctgtcgaaccaggattgctcaaatcgattgatcttttcctttccttctactgatccaaggccaggagagcagacagacagatgcaaataatctcaattttctctccaaagattgaaaggaagaaaagggaatacgaaaatgaaaatgaaaatggaaagggacaagaaatattctgacgttttgcttccactctgttgagttctctgaatctgaatccagtgagtcgcgctcctcgtactcaagcttgctcgcacgtctctgcttccactcagttgaattctttcgatctcgacgtcggtctagtgacgttctcgatcgtaatctcgttgtcaggcactaattaacctgttccaacttgtcggaagctgatatacagtaacatagtagtactatagactacagtgtatcttgttgagatatcagtctttgattgtttcggagctcggcgagatcgaccaatcgatgcaagatggagtagtagtaatagctgcacgaatgaataagcttcaatgttcaaaaaaaaaaaaagaatatgcttcgagtactggtgatcgtcgtgtcactctccactggagctagattactgctgacagcaaccggataggccaatttggctgcatgggcttcatgtcttgtccttctgctgttaagtgcctggatttttcacattttggttcttctgaaaaacttattttataaatggacccttaaaaaaacttatcctagaagtggtcctttttgaggccgctgcatgtgcttcatgtcctgtccttctgctgttaagtgcctggatttttcacattttggtccttttaaaaaacttatttcgcaaatagacccctgaaaaaacttatcccagaagtggtcctttttgaggcgccagagtggctggcgccgtcattcaacgggacggcgcccgttctcctgccaccgtggcacacgcgaaccgacgtggcaggacgagggcgccagcatggctggcgccccccacccctcgccttcattcctgtttctctgtatggagttgcaacagtatcatttttgttttattttttcggatgttttctcacacttaggatcacgatacaaccaaccacaaaaaaaatttaaactcgaactaccacttagctaagtctgaaaatagctagcataccacttagtctactttgcacattcactaaaattagaccataactcctttagtaaaaccctttgatcaacatgttacacataattcactctatcactatatgaaattacttaatttaattcaaaatataaccacatgaaatgatagccataagttaaacaatatacagagatgcaattttttttatttttatttcatttttttgatatttttttcacacttaggataacatagaaaccaaccatataaaaaataaactcaaacggacaaaatatgtgacttgtagaatttttcaaaactctaccgaaatggacaaaatatgtcattcattaaaatatgcgtaactttctcatacggactcggaatcaggaaaataatatatccactgacatacatatccgggttcgacgatattaaaacctccgaattccgcttgcaagattgtgttttcgaggagagaagtttttcggtagagctttggaaaattccacaggccacatatttcgtccgtttgagtttattttttatatggttggttcttgtgagttcgtaagtgtgaaaaaaatatcaaaaaaaaaataaaataaaaataaaaaagttgcacatctctctcctttgcactagttcggagagaggagaggagaggaaaaattctacaggtcacatattgcgtccatttgagttcattttttctatggttggttcttatgtgtccctaagagtgaaaaaatataaaaaaaataaaagaaaaataaaaaatatcgggggaggggggaggggcgccagccactctggcgcgctccccctagccacctcagcatcgccccgccacgtcggcagggagacggcgccagagaagctgacgccgtccagttggacgacggcgccagccactctggcgccccaaaaaggaccatttctaggataactttttccaggggtctatttgcgaaataagttttttaaaaggaccaaaatatgaaaaatccaggttaagtgcagtagcaatgtttcgttcttatctaattaagatgtacccctctgtcaaaaaaacctaatcctaacaacgagtctggatacatgcgtgttcagattgattgctaagattagttttttttggacggagtagtatattttggtttccgttagaatttttttaaaccgctaaacgattcattttcttcgaaattttttatagaagttgctttaaatcagcatataatttctttttaaaaataatataacaactaaaaatcaattaatcatgtattaacgttttgttttccatgttttaactttatctccagtataaacgaatgctatctacgaaaatcgagtggtggaccgtctccgtttagctcagctgttggatcagcccgtgcgtcggtgcgtgcggacaaatcgatatgaggaattctcctttttcactgacacggtgtcacggtgacacctctatagctcgtcaatgttcttcagggactatcaagaccgattccgattgctcaactatatatacggccttcattaaatgtttccaccgttttacgcgaaatgaaattatagtattgaagaaatagcatataggcttatagctgcagttctttctttttaaaaaatggcatctttttgaaaaaaaaaatcaaatggcacaacattggttcatactagtagtacaggaaactcaaatagagagtgataaagacggcccaatttcacagtccaagccggacctgcccttttaagcattcttagcccaaccaatggaaggcttgacccagaaccaaatctagcccaaatgctaattatttaacctaaaattcttattcaataatccaaacgagtagaaattacatgcacctaaaaaccaatcacttctcatacattcattatttttactagctcgagatcaaagttattattaaggcctaattaacttagaagtcgccgtcattcctaggaagcggctcatggccgggcgggcccatgaagaggccctcataaaccagcccagccaaaggcccacctataagaggcccaacccaatagatccagtggtcggcccattcgccggcggcgagggccgggccgaaggagcgggccgggttcatggaggcgccggagtagggcccgccggcgaggatgttggcgccgacgacgaggccgacgaggagcgggccgagcgcgccgacggcgcggcgccggtcgacgacggtggcgtagacggcgaagaggagggagaaggtgagcacggcctccatggccacggcgcgcgccgcgccgacgccgggcgccggcgcgtgcaccgggacggcctcctcgccgccggtgagggcggcgaggaggaggcaggcgagggaggagccgagcagctgggcggcggcgtagagcgcggagcggaagagggtgatgtggccgccggcggcgaggccgagcgtgacggccgggttgatgtggccgccggagacgtgcagccccgcggagaccatgacggcgaccaccagcgcgtgcgccgccgccaccgccgtcagccccattatcgtgtcgccgccgccgcccagcttggctgcaccgacgcaaggacgacaatgtcgatcttgattgagatgagaagaaaaactaggagaagaaatgaagtaggcaggttaccggcggccatggcggagccgacgccggagaagacgaagaggaaggtgaggaggagctcggcgacgacggcgcggaggcagccggggtcggtggcctcgcggtggtggccgagcgcgagcttcgccatgtccgcgccgtacgtgcgtgcgtgcgtgtgggtgacgtgtcactcgcaagctagctaggtgaggtgattcccgcgagggaggacaggaggagatggtgagttggatgctggagtgtatcaattgacgcctagatatatagtgctagcaaggttggtgactagagaaactaaacatggtgaggcgatgagaaaaatagaacgtgcttttcgtcgatcggtagccaaacgttagattcaaaacatattatcttagggacgttttaatcccacgaatgaaaaaaaacgaaggaataaagaattctgatagaaatacaaatgttaaacagaggattgcaaaacgcatgaaatacatatgaatgttcgtttgattagactgtatgaaaagattgacgctcaatgaaaatttttcgagattgacgctcttaataagttttctctaaaatctctacagaattatctattccatattaattttaaaggataaggcacgattcaatcctctgtatcaaagacgttcatagaaaattttttcataggattaaagtcctccataatgttattcctacaaattaaagaagcccttaaattgaaacacacaagtagtttatctgtgctaacactacggtaacatttgataatacaactcaaacaagcaatggtatatgttttagcgagcatagaatgaggtgatggaataaattgatacataaaattattatattcagtaagcctagctaatatttatcaacctacagcttacatacagatttgtgtccaggttacaacgaacatattttatagcatcctcgagttgtccagccaaatgccaagagaaactggaattattgcaataagaaataatatgtaatacaataatcagacagcatgtcctatggatatcacaggcgtgcttgcaaactaaagaccgtagtgggcaccatcaaacagaacaccatgcgcactgtgttcacatgtaaagaggaaaaaacggaattttcgtatgcgatggtgtcacccgcatgaaaaaatcgttatttccatgcaagacagttgcatgaaaaaaaatagtttttaccgtacgtaaanatgctttttaatagtgcgacggggcaattaatttacaggaccgatcgggctagcactagcagatcgacgtcgtccaagaaccatgcgtcactccgctcaatctcggcgatctctacccgcagttcgtgcgaaccatgtattatccgattgggtttcatcgttcacgaacggattgctcgatatattgtgtggtgagatcgaaagaacaccggagaaaacaccaatgtctccggtcattttcgaggcagaaaacgagagaccacactgacagcagcatgcatatatattgtggatttgtggtggcatacaaagacggagaaggcatttgctgtgtacgtgcgcgcactagcagctctgcgtgaggagataagttttcaatggatcaggagtaagtaggtggtatgtgatatttttattatttaaacccttttgttttaatattttttttaaaaaaaaggtccccctcaaactttattttaaaatctgaatctttttgttggcgtggccaattaaccatgttatacaacaacaacatgcaccggcgttacagaagacatgtagccacgtcagcatgctaccacgccacttatattggagtaactatacttctaaaagtgcaagaggtgtttgtgtgattaaatgtttaaaatgcctctcatctccacaacccttcacctggcatgcttcctatcgaccggaacaattaataaagaacaatatatttagttaacccctctccttaatatttatgaaagctactaaaaactcaagaaatagctatattttggtacatagctcagcctcccaagttgtcaaagctactcttcctgaaactacaatacaactacacataataatcgtatggctaggcagtctctctcaagtcagagaccatattggcaacaaatggatcagaccctgtttagatgagactagaacttttaagtccctatcacatcggatgtttggatactaattataaatattaaaaatagattattaataaaacccatccataatcttggactaattcacgagacgaatctattgagcctaattaatccatgattagcctatgtgatgttacagtaaacattctctaattatactcctagattaattaggcttaaaaaatttgtctcgtaaattagctttcatttttgtaattagttttgtaagtagtctatatttaatactctaaattagtatctaaatacatagactaaagttaagtccctgaatccaaacaccacctgtcaattaactatcacgaagctgccattatattgcgccatggtcagtgaggctgacattgaccggacatgcaccgcaggagggtgaagctgcgatggatggcgtcgtccatccaaatcctcaccgttgtgtggcgcacacactctccgtttcgccccgtctacttagggcagccacaatgtgaacataagagtagaccttaagcctctaaagtgaccttatatattgtgagagtagttcttataggtggcatttgcttgagctagccatatgtataaaaaccacccacaaggaataaaaaattatattactccttcctctctcatggcagtgttactttctctccctctctcaatggctaatcttgggtttgtagggtccaccttaatatccactcttgacatatacattgtggacatgataacatgttttagtggatcccaccataatactaaggtagtctatattcattaagtatgctcttagtgaaatagttctcgtctacgattcgtgaaatgaatctcgtctgt

SEQ ID NO: 30081 - DNA, 1045 bp, Oryza sativa
gagaaaaaatatttaaagagaggagaaaagaatgaaaagaaacagctaggcacatacgttataggacagggttcattctcacatgcgcttgtttagacatccgatttttggtgtgatgccggatgtccgagccgtagcgctctccgtgtattccccatctccagtacggcctagcgagtggcggcagcggtgcaacagcagcagcaagaccaggcagccagcagggtgggcgcggcggcggcggcgacgactgcgggtcgacgcggctcaacagcgggccagcacgacggcggcgaccgttggccagcacgcaggaggcgcggcggcaaccgtgggtcggcgcggctctgctgcgggccagcgcggtggcgacaaccgttggccggtgcgcaaggaggtgcggtggcagcgtgaaggagaggcgtggccttggtcaggtggcctgttggcaaccgcgggctagcacggtccggcgcgatggggtgctcaggactgggtgagtaccgttggggaagggaaggtgcaaaggggaaggttggcgcacgggcttgctggggccgacggtgcttgaggaggcacagatgcaccaaggcgacggtgctagaggagatgcaagggtggctggctggcgctactggactttatggtggttgctatagctgaaattgtgttgaaattcagtgaaatctcttgaaagtatgttgaaattttgtgaaatgaaatcttgtatatttattgctgaaatcatgttggaatcctgttgaaattttgtgatatttgtcaagctattgctgaaatctagtcattttttttataaatttcaagtatagcaaagttcacttcgaaacatttgtaaagttcagttcaaagctgaactcaaaaaagggcaaatacacaagtgggcacatatttgcataagggtatactcggcgttgtatctccgatctaaccccattagctagttttaacagaacagggggcactctgctccttcatttcaaaaaagcatgggcaaaattacaaaccctaaaaagtaatggcaaaa

SEQ ID NO: 30082 - DNA, 861 bp, Oryza sativa
tcaaagaatccacaagaggatcttatgggaggtaaaggtaccactaaaaatcaaagtatttatgtggtttcttcacaaaaaagtaatcttgacaaaagataatctcataaagagaaattggaggggaaacaagcaatgttgtttttgtaatacacaagagaccatccaacatcttttctttgactgtcatgttgtacgttttgcttggcgatgtgtcttctttgccttcaacatcccccctccccacaatgcaaaagatatatttggtgactagctaaggggagtgcctagacccacaaaaaaaatgattttatttggagctagtgctttatgttggtcaatttggcgttgccgtaatgatatagtttttaaccataaaaaaatgcctaacatcatgcaggttatcttcatgtgttccaattggctccactcttggtgtatgatgctttcacaggaacaacaggatactatgcgcaatggtgctacacgcttggaaatagtaagagatcgaggcgaagcatatcttgattcccagcccgatgcagtaatcctggaaatcggtgctgatgaactgggagccgttgtcggttatgatgcggtgcgatagtccgtatctgcaaaatatccccttgatgaatttgatggcgttgtcggccttgatttccccgtgggtactgcttcgatctacttagtgaatttgtcgatcgccacgaataggaaccctgttaccgccctgtctcgttggaatggcccgagtatatctagcgcccagcacgagaatggcccaagtagagggatagtctggagcacttgcgccggtagctttgtgtgtttactgtggaattgacaagcttcacatcg

SEQ ID NO: 30083 - DNA, 3649 bp, Oryza sativa
aagtggtcaaacttgataatcaaagttaactctgtcagatatttattaccagagggagtacttccgtttggagaaagagcgccgaagattttgtttcgagcgaaaaatatcgaaagattagcaaatacaatacaagaaccatacttactagccaacctagtctggccaacctggccaaggacagaagctttgaagtttgaactccctagctgaggaggatgtggttggcagtttcaggcttcatcttgtccatcttacgtacactaatgcactctgtttctccattttgcacattggtcaaacttctagttctagcagaaatcaattggtgatattcaaactctgcttccggaagaggtagggaggcaatgttgtgcttaatatctattatcaccaaccattagattcccgcatacataacgcatttcaccaacccatttgggttctcacgtatagccatctcgcattagtcattcttcagtacttagtagtattaggtatggtggaggaaacaaaaggtgtatcaagtgggatgacgtaaggttcgattacatttcatacatctttgatctttgaaactaattaatttaataatgagggtaatgcgtcaaactaataacataatgctttaatggcctattttggcctgtgtctctctctgtattgctttatgtaaaatagaacgagaaacatgtgacaacattcgaattgtgaaagttatttttttaattagacactttggtttgatcgctgacgatggtcaatggatataataattatcttttcgaggcaatatgcttccgtacgtcagggtgcccgattcatggagatcacaagagtagcttttggttcatcatttatgggattattgcccacatttggtgagataaattcatttctcataaagtctggtaaacatcaaaagtccagtaaacatcctcatgggcactcctatgctgtcacatgtcatgcctcgaattagaaagaaattctttaaaaaaaaggtcataagtttcatattataagacactttaattttttaattaaagttaaacttgtttaagtttaattaagtttatgaaaaaaatgtagcaatgtctataacactaaactatttttattgaataatctagcattgaaaatattttgatggtaatattttgtgttgaaaatagttttcttttaaatttgatgaaacttattaaagaagtctaatataaaaaaacaattcaaaacgttttacaatatgaaacaaagagagtggaccaataggctaattattttaaatcattagatttatctagactagaaaagatccaaaattcgatctctcacctcacccacccttccaaagcacgcacccctcccctctgttcccccatatcattccttttctttagctatacagtagaagtagttagtaagatgcagtaagccaataatcatcacataacaaaaacaaaagttaaaacaatcacaatttttaaattgttattgaattttctgtccttctatatcattggattcatatcacgggtaaaattaacagttcaaaaccagtattaattatattttgacttgtaaagacatatgttatattcggtcagatcttaacccttttaacatatgacatccaaaaagctatagtaaattacaaagaaaattgaaattagacgttaattatcatcatatatcactttgtaaaacatgcatagttaaattagatttacaatatctcgaaataaaatatcaaattgtgagcaacattcaaaagatatatattctctatgttatttttgaagcagagcgacctcccgagcaggttaggtggccacccgagctccactgctggcaggggcggatccaggaacaaaaaaaaaattgaggggctcaattacacagtttttttaaactccagtcatatagggacctttagtttattattcatggtgaaaaaattgaaaggggtgctccaggggtatccatgggtctggtgtgtagaggggactcgaatcccccctgcacccacgttggatccgcccctgactgctggcgtctcctttatcaatagccgtcgacacctataaaaagttaaaaactagtcaatcaccgaaaaacactattagtcatccggatttaacgatatcgctggctctgccactagatgaccctttgcatcattgcatgccatcccaccaatcataaaaaattatcaccatatcagttctcaaactaaacaagcccttaattaattagttgctaacgggatcacatccataacacaaatgcaagctgcaaatttttactatatctttggtatgtaatagtagactgcatatacagtgaatctctgcgctgtcgttagtgtgttcaaaaaattgaaaaaaaaatacagcattgcttatctttcctttataaaaatgaaaaggagaaaaaaaaggaagatggtgcacacaggatgagttcataaaacactccagtttgcaatcaaataagtatgtatatctatgggctaattagggtccctgtttttgaccaaccgctaattaagaatcattgtaactgcaagaagtgtcagcaaatgaaaaggacgcatcactaatcccaccaacgcggcgttgactgaaggagcctataaaacctgctgctttatagtagttgattcactagttctcttttcactcccacccttgtctgcttggcggatgtcgctcgtctctgataacatggcgtctgggtctattagccgtggtttttctgtccactggttaaatgaaggaataagtccagtttgagtccctcaaatatatgttagatcttattcttatccctcaattgtaaaaacaggtataacgactccctcaatgttaaaatcatgcaaaataactccctcaatggtttttagagcggtttttgttgacatagagtccatgactgacatcaccaccgcaacagcatggacaattaggtagctcatgagcttaatttacttgcactcgccgtcgccaggggctgccacatctcgcaccacggtggatgagtcgtgcggattgttgtgatcgtgttgttgcttctctttctgagcttggtttcagctttcaatgggcaggcaaccttctcttcacaattctccatctaactctcctgtggcgccggttggaatgttgtcgtgaaatccgattcaccatagcgcacattcatcccaaacgatggcaatctattaggaaagttctcccacaacgttaccaggttcagtaaccccgacgcgagccatttgtacactctttagccacaatgcgtgtaggcacgagcaacttctcatactggcttggctacctgccaccgtggtgcccgacgacaacacaactctagtcctccgccttcacttcttaccttacgcatcacaatcgggcgacctttccacggcactgttcaacgtctccatcatggggaggtacgtcctgcattcttccttcttgtcgtcgcgcactggcgcggtgagggagttcatcctcgcgtccgatggctctggtgtgggtgggcaggaacgaaaatcgttgggcacctagtttggtgcgtcccaccgcttgttcttcacgcttggcatgattgtctgccgccaccgatcgcttactgtggacaccccttg

SEQ ID NO: 30084 - DNA, 8773 bp, Oryza sativa
  unsure (1)..(8773): unsure at all n locations
aaaaacgaggtccacctttgtcgttgtgctgcatgctttgacagtatggttagcacggtacttccttcgaaccaaaataaaatatactccctccatccaaaaaaaatcaaattcaacttctaaagtttaaattttatcaaaaaaaaaaacttctatcattctacccacccttagcacgtaaaacgagaatttttttcccttcaataccctttatctacatcactcttactatttttttcaattattaagggtattttagtcattctctatatccactaattccacctcgggatactaggaatgtattttttgtgggacggagggagtacttccttagtcctaaaatataagcgattttggacgaacagacagggaggaaatgtctcatccttctaaaatctcttatattttaggacggagggagtttgacgcaactgccactaagctaaagattaaaaaaatattattatatcaccatgatatacaccacatacactaatggaattagatatgttaagggtggagtattttagaaaaataaacttataggaaaaaaagtattagttaattgcatgtatatatatacgtgtcttgtattataaaacatcggaaaaatggttgcttcttatatttttttatatgggagtactattttctccattttaaaatatactgtactaacctaggatctaaatagaacggaggtagtaattactttgatgcggttcattatgaaatttgtcgcatactcactgactcacacgtgctatttattgatgtgtattccctctgtccaaatatataaaggatattgttctaatattttatctaaatatataaggaattttgggatccctagacaatattttatcttccatccatcaactcatgtgctagtttaaataccactccaacctttacttttacttgtttatttcctcaatgatcaccatcttttgtcaatgatttgacccccttccactttcttaattctttctaaaatagcataatcccttatatatacgtacagagggagtattcattttatccattacggtttctgattctttgctcgccgtaaacggctaaacataaccgggcatataaacaatactgtactaacttcgtcctttaaaaaaaatctagacataatttggccaatcctaatcatcagccaataacacccctatctcgtgttttgtttaatatcaacttattgccctaccaaaattttagtaactttaataatagcaagtgcatatttggtttgttaccaaattttgtccacaatagtttaaattcaacactacccaatttggtagtgctaaaacttaccaatattttggcgctaccaagattttggtagggcaaaaattgacttcaaaccaaacaagcccttacatatcgaagtttattgttccctgctccctgtgcgcacgcatgccatcggcggtcctcggtgtgccggtcacccagacgggtaggccttgtgcaattgtgcaggtaggttacatgccggttggtgcagttgattgtataaaagattgtacacatttgtagtactaaatatcatatattatatttaattttttataaggacagagtaaatactttttttatataaaaaaacttaatagaaaatataaccccttctatatagcaaatctcgataaaaaagattgtctattttaccaggtggggtcatcttttagttcgatttttttttaaaagaagggagtagagttaatccgtcgtagtacagcgcaaattccaagttatcacgtctcattgacctccacgcttgccgaccacactgctccagtgctcagtcaaagcactgcctcactctcacccctctggctattctcaacaggccaatcagaccaaaaaaaaaaaaaaacactgacgtcgatctgatccaaacaacgcgcggaattaattgagcacacacggagaaggagatcggccggctgttttccggcgcatatccatccacccgaccgcgaccagcggcgtcgtcatcacgtacgcggcgggcgagtggatgtggatttggctgcgctgcggtggtctcgccgaccaatccgtcgagcagcagccgccgttccaaaaaaccggataataagcaagctagcaaagcaagcgctggcggcttggaagggatacttcaccgatggtgtccctatcgcattcttcccacttgtcgcggtttatgggggctcgcgcgcggtttgccgcgctgctcaggtgtcgggtgcagtgatgggatcagactctttcaccgggttaaatgcagatntgagtcaaaaatgttcacctccactagacaggaaaccacacacccgggtttctgcgtactttttctactgtatatttagagtctcatagtaaataggtaatggtatctcatggcatcttcttaagaatcgtaaaattgcttttatttagctagatttcaactatggttgtgtttagttcacactgaagtttggaaatttggttgaaattagtacgatgtgatagaaaatttgtgtgtatgaaaaggtttgatgtgataaaaagttagaagtttgaaaaaaaaaatttagaactaaacatggcctatgcacaacgggatttttcctgtgtttcaggagtagggagtactgtacttgtgggcatgaattcagtgcgaatttggccctggaaaaaaaatgaatgggaaagaaaggagcagcagtaaatgcggcgagaagacgacacaggatgtgttcggatacgacaaaggggattcattacttcctcgtcgtattgtcagattcgctgtgcttgagccattccagaagcttccaaacactgcgatctcgaagcagagcgtctccgctcgaggtaagcagcttgccttttgcaacgaaacggtttctagaagccacgaacattccaactgtactgaaacaaacaaacacaagctgcgaaaaggcgtgtgtttgttacaaacacacactgtcatttgatcaaaaatttcaaaattgatacactcgtttaaccattttttttcctcgcaaaagttgctgtacaaactcgaactctgctactcacacatatgtgatatgtacatagatggatacacaattatacacggaatttagtttctgtaatacgcttcagatttctagaaggcaggcggcctggacgtgcccggagaactcgggcggcgccggcgcgcgcgcccacgacgcgggcttgccggcctcctcccgcagcgtgtacaccgtctggtcgccgccgtggcagtcggacccgatgaccacgacgcggccgtcggggatgacggaaacggccgccgcggtgcgcgcgtcctccggcaccggcgccacgggccgccacgccgcgggggcggaggagatggcgccgtggcgcgccacgaggtgcccgtcgcggagcatgtacatgcggtctccggcctcgggggcggcgctgcaggttctcgggcacgcgccgtcgtcgacgaagccttcttggacggcggaccaggtggacgtcgccgggtcgaaccactcggcggagccgacgaatcgcccctgcgccggcgtcgggtacccgccgacgaccaggaacttgccgtcgacgcagagcccgcgcggctcgtcgcgctcctccgccatgtcggggagcgcggcccacgcgtcggcgtccgggtcgtacgccagcgccgatcgaagggcgttcttctcctcgtcgtggccaccggcgacgaacaccttcccgccgacggcggcgcacgcgaagaacgaccggcgcgggcccggcatggccgcgccacggcgccacgcgcccgtgaggaagtcatacacgagcaccgagtccgtcggcgcccacgtctccgggtcccagccgccgacgaccaccagccgcttcctcccctccacaccgccatccaccgccgccacctggcagaacagcggcaagctcccactcgctccacccacctccggcagcggcgtccacctcccctccgccgggtccaacagcaccatccggtacgagttccccggcacaccgccggccgacgactgcttgtccgccgccgggcccgcctcggcgagctcacgccgcgcctgcaccagcgcgagcgccgggcgcgccaggccctccgccttcctcaggcggttgtacgccggcgactccacctccgccttccactggcgcgagatgcggcgcaccgccggcagctggtcgaaccccacccggatgaggcactccctcgccacctcctccggcaaccccggaatcagctcgttgtaacccatgatgctcaatcgagctggaattcgagcaagaaatgcgtgagatgatgatgatttcttggcttctcttctcttctcttgtctgagcttggtgtgtttgatgtgttttgtgtaaggcagagtggcgggagtggcatccgctacttatacaaggggaaagaagggaacggactgcggatggagggatggatggattgcgtgatttttttggggggtttatgtgggccccgttgcttgcacggctatggtttatgtttctttcagtttggctttttctagttttttttttgactctgtgacgtgtaaaattgagtagattagctcttttgagactaatctaccagtagatgatatggtttgttttattttgggagactctgtttcgggtaagaatgccacatcggatgcagtatcctttttatgttggccgaggtaaagggatgaggctgtttgtgggaattgcctgtttgtgtggaggtttatctcaaccgtcgtcatgcttagttcaacttcgtttggctaacgaactgcttagtactccactatacgacatggaaactgttgcttcgttctgcaatctgcaccaggaaaacagcaaaaatccttcgtcgggtgttgccaacttcacaggaagtaaaacaagaacgacatgacacgaccattacaattttactagtagtactgtacacgcaaatgcaacaaaagaccgagctgttatagttctacggacacctgtgccaacaaattgggcccacatgacctccaaaaatccgtgcgcttggatttggggattccggattccccttgtcaccctcctcacactttccgccggtcttctacaaacacacgtactagtagcaataagagtagtaaacacgctctgtgcaatcatgtttccatatttcaatttcactactgctactactagtagcacggtttttatttcggttagcactgtctcctctccacgcagtcgcacacgtgtagggctcagcgcaggtatcgcgcgcgtgccgcccgtggagtcgcgccactgaacaggttgatgtgccgcgtcccgtgaagctgtatacgctttgcggcgagccgggtgccgtctctgaacgctacggttttctctcctcctggccacacgtcggagactcggaggctcattattgccgaagagtgtgcacgcgtcacggcgtcaggagcagaagccgccgcggccaagctaaggtcagaccgggttcggcctgcctccatgaacgaacggatcgatcccgcgatcgagcagccgcgcggccgccggccggcgccacacgtcaagtccagcgagccggacggcgcgtgaacgtgcttgctgccgaactagcggcgtcgtgtcaagttcattgctaaacgccgggaccgggaaggattactatagtagtactaggcatcatgaccacaccgagaattgtttgctgtgcctgtgctgtgcacgcagttccgctacaccacgcgcaacgtcgcgccgcccccgggatttttagcgacagcgacgtacgcgagattagactattagagagcgaaagaaaataaacgggaggagaaaaacaacgggtgggtttctccggtgatccggacagccgcctgcctgcatgcctgcctagttgccctcgcagggcccggtagtaacgcaagtggaacggaatcaccgcgcgcgcgttcgcgggtggtgtcgggaagtggtaagccctatccgctaatcccacctcgctcgcgctgccttatctcgtctcgtctcgccacgccagggcccaggggccccccgcgtctcgcgcagccggcctcaccctcgcgattgattctggctggctctcgcgcgcgcgagcggtggggaagggtaaaaaagaaaaatctggaggcgcgcgacgaggcgtcgccgtcgtgggcgggggaggctgtgacgattgacgaacggtggcggagcggtcgctagctagcttgccacgcaatcgcgcgtggtgatgcggcgcgcgcgtcggatcgatcgaatcgaacggcggcggcacagcgcttatgtatccggaattccggatccaccatacggcctgacggtttcgatacggctctcccgctgttttttctcttcgtttttttttatgacgggagtgtgctgggagcctgcgatttctgtctcttgccacgccattaagccacagcaatcttttctaataactcgcgtctttttccgaagtctagcttaagtaagaagcgtattcttagccaacatatggaattatggataacgcttggaagaacagaagccttgctgccgtcaaaccgaaatgggagacgagcttgggttgccaagttgtttctagaatcattgaaccagctagttcgaaataaagaacgagttcactgagtgatattatctggagtccgttggtctcaagtaagacaagctgactgcagagtatgttaaacagagcaagcaatacgaactggcaaacagagtatggctaacccggtggtgttgattagtgcattaaccaatatcaaacattatgggacgtgggtatgctaaaaaatttaaaagacccaaaacagcgatggaatcaaaaaacgaagatgtcgtaaaagacgggctcgcttggtcgattcaatggtcgtcatctccatgaccatccaaccgtgtgattggtttaaggggaactggtgaagagggaatgaaagtttgaggttatgtaggaaccagaggcggctgaacctcagaatgtagtggacggccccgctcgttcgcgggtggtattgagaagtggtaatcctatccgctaatccccccgacctcgcgctgccttatctcgtctcgcctcacgctctcaccaccacgcgcccgtgttggcgcgcgggggaagagaggcgagaaaaagaaaaatctggaggcgcgacgaggcgtcgccgtcgggcggtcgggtggcggagcgcgtggtgatgcggcgcgtcggggtcgatccgctcggcagtgcgcctgccggtttcgttacgactcccgctgtttttctccccttcgttttcccgtttttcgatccgttcctagcagcgtgccgcccctttccgttgaaagccaccgcaaacctgcgtcgttttcggaggattagcttatgttggaagcgtattctttagccaacatatggataggcttggaagaacagaagctagctgctgtcaaagctaaaacaagagagcgtcctaaggtttgccacgttgttcataaaatcgctacagctcaaaataaagaatgagttcggtgagtgacaactgcgaatccgttggtctcaagccaaacaagcggactgcagaagtgcagagtatgtcaaagtcaaacagagcctgtttagttttaaacttttcctttaagctttcaattttttcaccacatcaaaactttcctacacatacaaactttcaacttttccgtcacatcgtttcaattttacctaaacctccaattttagcgtgaactaaacacacggggagtaagaaaaaaaaccgtgaagcagagtatgttaatggcttctacatcggacggcaccaaattcagatttcccaaaaaccgtatagtttcaaaaactaataagaatatcgtacccggtaaacatgattgccataagcgaggtagaacttcatcgtttggcctaataaatcaaaacaaaagccaaaatttaaatttttaaaattaaatttaatacattttcaacttaattcttttaaacattggtttttaagtcgttacgaacaaatatataaaagtttaacctagaaattaacttttattttctaataaactattttgccttattagaaaatatgggtaagtaatgaggctcgtattcgcgtgatattgcaaactctgaccctatgccaatccaaagtaaagaggtgcatcaaactcagaggatttcctttcctcactcttgttttatgaagctctttctactaccacctggaacatttggaaggagaaaaataaacttaaatttaagatattttcaacttaatttttttaagtattggcttttaagtcgctacgaaggtgtaaattgatggaatcgagaaaagaaggtgtctcgattaatggtcgttgtctccttcatccaagcgctctacacacggggcgacgctaatgggcgatcgatccccatcccctatacgctcctctcccccttcctcctccccttcttctcttcctactacaccataatttttttaaaaaaataaaaaatataaagttggaaaaaattatgtatagaaatactataaataaaaaatatttgaatttaaattcaaatttgaaacgggtatgtaaacttttgacttataaactttgggtctataaactaatatttgaattcagattcaaattcaaatttgaatcgggtatgtaaactttgggtctataaattttaggtgtatagaaaaactatatataaaaaaatgtgaattcaaattcaaattaa

SEQ ID NO: 30085 - DNA, 525 bp, Oryza sativa
agatatgaataaccttgtaaaactgcggcattttgttgtccaagatgataaactctactctgacattgctaatgtgggtaagataaagtgtttacaagaattaaggagatttgaggtcaaaagacaagttaaggcatttgcactaagccaaatagggcagctggatgagctaaaaggatcgttgggaatttatgatcttgaaaatgcaaaggcggcagaggaggcaaaacttttaaacaaaagtcacttacacaagttaatattagattggaatgttaaccattctacaaaggattattcacaagaagaacatattcttgaaaatcttagaccacatagcaatcttcgggagctacatattcaagggcatgggggtaccacttgcccttcatggctgggtcctaacttatctatcaaaggtttgcaatcactttgtataaacggtgtatgttgggacaagtttccacctctaggggggttgtggttagttaacaagcatggtgaaaaattcctggcttgtgcaag

SEQ ID NO: 30086 - DNA, 1431 bp, Oryza sativa
catgaacttgagaatagaaaaatgtcaaaagataacagggcttggtgtggcagggcaagagatgatggcaacgctagcatctccaccatcactttcttataataagtctgaggatgcacagattgggaatgatcagcaacaaccaagaggagacaatggaatagcatcggtggtaacaggactactgctcttgcctcaccaactacagaacttggacatcagacactgctcaaagctgatcctgcagctcgattcatttgtaggcgacacaacacgcaacctaataagaggtgtaggaggaggattacaatacctgcgctccctccaatcattgtgtataaagcattgtcccaattttctctcctcctactcaccctccttgtcttgtttcccatttccatcctcccttcaagatctggctattattgattgtgtgagaggcatggaaactctggtacaaaacctcagctctctcactagattgtccatatgggactttggggatttaagaagcgggagcatgtgttccctcctcacccaaggccaccttagagtgctggctgtccataaaactcccgaattctttgttgggtccaagccatcggggctgcaacagctctacatggatgacatcgtaggggtatttgttgagcctacttgcaggcttctctcttcatcactcaccaagttaagcttaagcatgaaccacaaggtagagcgcttcaccaaggagcaaaacatggcccttcagctgctctcctccctcgaggtccttatatttgtgcaatgctcgaagctgcagtctctccctgctgggttacatagactcaccagtctcaagagattagagatcgcatactgtccaaacattcattcgctgcccaagggctgttttccgagttcactagaagtactacatgtttatgaaagccaaagcgaagagctcaaaaggcagtgccgcaagctaaaaggaacaattgcaatcatcgaagatgaagactacttggaactggtaacaaatactcacttatttgacttagcccagttcacgttttgtttggcacaacactagtatgtcatagacgagcgcttaacatttttttttcaattagcgtgggaacttgtgacttttctagttaatatgggagctcccaagcttctagaaatagagttatgtgagaagtacacaccaaatctatgcatgctgagcttaatgaaagtaatatggtcagaaaacaaatatttacagatcaatgtatggacacaggatgctgaattgatcagaccaacttgatcacctatttgtcatatgttttctgtcgagcaaagactccatcaagtttgaaaggttaaaatcaaaatgagaacttctccatgggaataattacatttaactagaatgtgcactacttatatgtaatatgttcctct

SEQ ID NO: 30087 - DNA, 6303 bp, Oryza sativa
  unsure (1)..(6303): unsure at all n locations
acacatatgctacataaaagaacttttaataaataataaataagtattaactttttatatcatatgtaaaagtaaatgtatcgcaaataatatggtgcatcacatactcataaatataatagtatcatccaataaatttttacattccaacaatatacttcattaatttattatgtttcttcatagcaaagggcaaaatggactttttcaaaagaatttaacggtcaactaacggtcaactagcggaaagggcatggaagggatccaaactaaaattcaggagtatgtaagggattgagcaaaattcaagggtatagaaggaattaggtgaactttcatgcatacataggtgattttctcaatttaatactcagggtggccatgcaccatggacagagatgcagaatcaataatttcaactcaagaaccttttatttttactgacaaaggaatgcataaaaaacaagtatactcttttttttcaacatattataagttctagtgagtgtttaattatgatagacatcatgttgttggtgctgtttatacttatttagttggatgcataggacaaactattatttgtaattacaccgaataaatatataaggctgccactagtcagaacacaatataaatgttacacctgtatggtgataaataggatggtcttaattccgagatgtgatgattgatgatcgcaagtagtaggagatttccccgcacaaagcaaattttgcgcgtgctaattgaatcggatttgttatacaacttttagctcatgcttacgtatatgcaattatatttaatatcttaactaattaaaacaatcgtcacctcgtccgtgcgctttttcatccgtccaccccccccccctcaaaaaaaaacccagaacacaaatacgagtccacatcaaaatctaaattggacccaaatcatagagaaaacactactccaataacacaagaacaggaacaacattaacacaagaacacaagaagaaaaggggagaatgctgccatcgccgccgtcacagggacacatggacatcggtccgccgccagcttccctcccgctggatccggcgaaggggaggacaccgccgccgggtcgccaccgcctcccctcccctcccgccgtatctggcacaccgggccgccgccgcctcctcccccgctggatccgcggaaggggagggcgccaccgccgccgagacaccgggccgccaccgcctcccctcccctcccattggatccaggacgtcgggccactgccacctcccctcccactggatcggtggaggcgagggcgccgtccctgcccgccgcctcccctcccgctagatcgaccgccggtggtaggggagggcgctgccgccaccgcctgtgatgagggaggacgccgtcgccgccgtcggtggtgagggaggacgccgtcgccgccgccggtggtgggggagccgctgccgccgctcgcgggggaagggcgacgccgccgccgccgccgtttgggggagatcgggggcgggggggggggggggtttgaatcctagggttagggttaggtttcgggtatatttatttaggttaggattaatctggaccgtccattcgattggacggctcaagctgctcccacgtcgggctgcctattgggccgccgaatggaggacacaaaatggacatcaacgaagaaaggaaacaggccagaaacttaggctgcgttcgagcgcaggagaaagagagaaagatagttttgttttccgcgcgcacgcttcccgaactactaaacggtgtgttttttgtaaaaaatttctataggaaagttgctttaaaaaatcatattaatccatttttgaagtttaaaataattaatgctcaattaatcatgtgctaatggctcacctcgttttacgtatctttccaatctcctcaatcccttttttctcaacacaccctcagggcacccacaatggttatctatagactctctataaaagatccatgtaagcatatttttctacttggaagagattaaatgaagagagagagcaaagctatctactaacctgaagatagtttatagagaaaaacgaggcaatttattagagagctatagatacccatgtagacatactattgagattgtttattattaatctagtctattgctgagatgtacatgttttatagatagcaccttactttaccattgcgggtgctcttagaatagataaaagggaaggaatataaacttttctatattcggcccaaacctaaaagggaggattttgattcctttttccaattaaataattgctaaatgatgtttgtattatttaaattagcaattaagctctgaaaattccaataaaatttcaaagagtgtaactaatcatggagaatttaataaaattaaatttaaccatgtcattttatttctcacttactttacttgtaaattgatttaattatacacctacctacttaaaaataccaaatatttcagcaaatttgtattttaattaattacataatgtaaatttttcttaacttttcctcaattttttggtctgtacattttccgttgcaacgcacgagcacttttgctagtatacaatagatattaaaagtagggaaaagctggaatacggtgcccccaactgcattcacaatttcatcctgaccgccctgtcacgcacgtgagagggaaaacagaagatttcccctttcctctctactccacgtcgcctccaccgccagttgcacttctcccaccgtcggtgcaagaagatgctcgacatcaaataatactcctgttcgcgtggaggtcagcttccgaaccaccgaagaaatcgatttgtatcggtttttaaagtaaagagatacgttatacctagctttgtggttgagggatacaatttgctggtgagggatacaatttgaccggcaagagatgaggaaggcaaaatagacttactcctaacaaaaatgacaatacattgctagtacttcagtaagtcacaaatactgtaatcatgatattatttattggctcaataatcatcatttttatccttgttatttcttattgcaacataacagggaaattgaagagggtattccggtaccaataatattacatgtttgctgtgaagatcatacatttaactcagcctcagcagctaatggttcaaaaactgattccacctcacccttgtccacgtcttccagagttgctggcttccactttggattctacaaattgaaaaggaaatttagctatacgtttagtaaatatatatctatagagttcatctccaccaagtttagtaaatattatttctctcctctcttattaagacacatcacctcgattatttctagccctttgataattgatatgtggtccaaataatttccctccttttcttctcttataagtcaaccccctagttttgtcccccttttttttttttgggaaaaatttgggaaatttttttttaaaaaaatttccctttaaaaatttggggtttttaacccctttttttccccntnntnttntntntnttttntntcccctttncttcttcattctaaagccacatcacgtaagttttgcttttgattgatcaatccatatatgatttaaattgttataaaccacaacattttaattgtttatagctttcttttttaatagtcgatcatagatgaaaattatacaaagtgtagccatcttacatgttatttcgactaatatcatacaaaactccgcagcaatgcgtggggttttatctagttctattaatcctaactctagagacataacaccattagttaaacaaaacacaccacacatgtaactatgtgcctttttatattattactaggtatatggaaaaagaacagctatgtgcctatgtctagcaaggcaaaggagagtgaactttgcaccgtgccacacatgctataatgtctgtatccctctttcccagaagtcgcacagtgcgcaagacatggttgaattctaaggtctacctctactggtttacttcttattaacaactcagagaaatgttcaaactctgtagtacgaagtgttcttcagaatttcattgacagaagtttcgatccattagtggatagctccgcgaaaagtagctcaaggcttaaatattagggagtggcaaataaacaattgattttaaacaattaagcttcttaagtttaattacaagttgaataagctggcggatgatacgccacaaaagcaactatttaatgtgacattcatagtttgtaatttgcaacccatgtgctagacatgtggccctgggacccacagacacaggaggtgtctaattatcactatggagaggcaaatgtcagaagatggatgtcctttgaattatggaaatgtgatcctaaaacatttactatacgctatggtgattataaattgtccgccaaacaatttaagtaatcggagagtaaagagatactaagtcacatggataacttgcctggtccttgtcaactaagacagcacgtacaccttcaacaaaatcatttcgaaccgatgacctcaaggcaattcgatattcaactttcataacaccagccaactgaacaaaccaaatgtcagaattagcaatgtccttgcaaaagaaaaagagaagcctgaaaataaaatagttaaccaaataaaagtattcaattgtacaggatagcagtcataccttcgatagatagtgttcattattcctatatgctgatgcaacttgagaaaaatgtttttgagttaaacatagagaaaatggagccccttttttgagtcctgccaaggcctcgttggcccattctgccactgcagacaacaatgaaaaggatacacgtgcaactagtcagtactaaactgaatttataaaacggtctcaatatagaaacactgttggcacttgtgcataaatataacaacattctcttgacgccttagcttaaaagcagagtacctgcagcatcatcactttgactacacttcttaagctcttccacagattcagcaactgatttgtcaggaccaaaggaagaaatgatatatggtaaaaacttatctagctggggccctgactctggctcgttcttgaactttgtcagcaatgactcaacatctctgtgaggatcatctgtgctgcaaaaataaaaaacacgatatcagatgtcaagacactatcaaacagaattataaccgagttttgaatgtgtcactattattctattaatgaaaaattatggaatttatacttctttaaaagaatggaatggtggaggcagtgaatctgacatcccacctactcccattgtaaattttgcaaattgccccttgaatctaaatggatagccacatataaaatcaaattaagatggatgttccctatagaaaaaggatgggtaacacatatcatggaaaatatgtttttatttattttcagtagcaaagcaggggcattcagctagtagtaattaaaagaacataatgatcttgctagcatttagtaagtttttaccaaataacagttcggaacatacaagttagcactcaagagggattccctgagaggtcccaggttcgctgaaggtacataatgagttccaagaccaaagaaaagggcatcagcaggtgatgatatccttttccctgtcatcccaaggtaagatcctgaaagaagcagaagtgagcagtgacccgtgttattaagcgggtatggcgaagtatgccaacccagcaccgccttaccgcaatagcgataagacgtatggggtggcgacggcttaagtgcattgaaaaataagaaagtattaagtaatatggcgcctaaaaatactaatggggtactccattcatcacagcccagcccaatagtagcacttacctagcttagtccaaatactttgctcttttgacctagcaaacaacattttaaccttacccaacagcttccctcccagcagccgccacctcaccttcatctagatctctctcccccattgtgcagcacggctcctctcctccacctttcttctctccttgtgcacgatgcagcaagcatacaccatcatcctatcctttctctcctctattgcagccagcagcctcctctcctccaccttttctctctcatgtggcacagcagcagcaggtggtgcctctcttgatctccctgtactccccatcagcacaagaagggagagggcgatgctagggaggaccagcagcaagacaacagacttttcccctctg

SEQ ID NO: 30088 - DNA, 1595 bp, Oryza sativa
aaaatgtgtgctactgcctactaggactaatcatgcctatagccctgtaaacaccatttgttgtgcaataataagatgcaaatggtgtctcagtgctcagcagcctaacctcaagtcatttgcaaaccagctaagcatgctgaatttcagttcccatggtactttaattaaaagaagaagaaactagcatggaataaggttcagaaacccctctacgactgactactaattacctaaagttggcatcaataattaaatatgccaccagagtcatattttagattatttatgtacaaatcagctggttatgaatcatatagaagttgttctgcatagtgtgggggaaacattaagtaatttacaaaaataacaatccatttttttttcaaatgagtcgaaatatgttttgcacaagtgcatgtatacatacatgatagatgtattatgtgaattaggcatggttaatccaaagcaggttattggtcacaagtcataaccagttattttcaaacaagtgcatgcatcaaggagcacaccaaacacagcttgtagtttgcagcagatagaagtgattgtaactgtgttggaaaatgatagtgcttcaaagtgagttggtggcggatcagatggtgttagaaaagaaaaggatacaacagactacgatggattaaacaactgaagtctttcaactgtatgtgcattgcacaacttgagaagaataaataataaatgtcagttactaaacccacagatcagttccttctttctttttatttttatgtgtaatatgaacgcaccaataatatgttttgacaacataatcaaaacccaccaataatatgtgaaaacaatgccagaatttttagatcctcatgtctcagtaggagcaggaggatgtacttgtatttttggatattgcagaatcatcagttaaatttaattatgtgttaaatctcaattattgtttagatgtatcaactacaatattaaactgcaaatcaaaattttcagaaaactatttcaatattgcatgactttcagttcgttatgaacttcatatacaaaaaacctattcagctctcctctcaaattatgattgcaatatcaattccgatatcttatatacactttttcagatacaaagagggcattataatttttagaaaatcagagcaaaatagccgcaatcaacaaaaggttttccatcatgcgatggaaactatctccaggaaagcattaatcatgctattactagacctctattatctctggcattgtgcaatcattagcaagtctcttcacatccccacctgcagtttacactaaacaatatcactatctgagcaaagcaacgattgttaacaacaccgttatactgtcacataaactgttgaacaacaaatagaaaagaaatatgagctttaaaagtaaaatcagatcaaaaacacacatgacaaaggtaaaaaccttttgcacaagtggtgtgctcttgtccttttgaatttctgctgcaacacccttaatatccatccctgcattggtcatgaatcttatttgcaaacatctccaatgctccggaaataaaaaggcgcaaa

SEQ ID NO: 30089 - DNA, 6789 bp, Oryza sativa
catgacagcgctagaattgtacggagtacatgaaacccatgtaagtgcagtaagctttgcaaattcccagctccaaatgtgggtctagggctctatgctactaacggaacgcatgaaatctgtaactgagtgtcaattttcaaaacctcaaactaaaacaatcaactggatgaaatatttaacatgcattttgactagagtgccaactgtaccaaacttcacttagctgcatgccattgagcagcaaattattttgattgctttcccatcaccactttgagctcacaaaccggactaaaaagccgcacagcatccagttaaccactaacactgtacagacatgttcaccgcacgagcaacactgattttaattcattattcgcaaccttccaaactagtgggaacgccacaaatcgtggagacctccgccgcccggcccggtcgccctactcccagtaacccaaataggaggaggaagagagagagagagagagagagagagagagagagagagagagaggagcgaccctcaccgaggttcatggcgttgagggccttggggcggtcgagggtgatgacggcgacgccgttgggggtgacgcggcccttcacgaactcctccgcggcggcggcggccatggcggcgaagcggcggaaggtgagggtcggggctagggttttggaggcggattcggcggtggaggaggggcactggaggaaggaagtggtggagatcgatccggggccgggcgggtggatgcgggagaggagagctcgcatagtgacgtgagagcaacccatgtggagaggaagaagccgagagcgagagggggggggggggggggattaatgtgatgaaattgactattgagaattggagggggtgtgttgttggagtacatttttttcccccaaaaaatgcgctgaactcgcgactcgcgaggaactgatgctaaaagtcagggaaaagtctaactgtcaattttcaaaaacgaaccttccgtctgacctgtttcactacatcgctaagatttgatttaaaaaaaaagaaatataattaaaattcataatgcccaaaatacccttgaggaaaccatacccatctttaaccctatccacatgtctctccatgtctctctcctgccagtgagttgcggcggcggcgatgtgtgcagcggggagggaggtggaggttggcgcgcgaagcaaggagggaggcggaggttggcgcgcgaagaagggagggaggggcggcgcgacggcagctggcgccggagggaacgcggaggaataaaggaggcgacgtcagaagaagaagagagaagagagaactgacgggtgggtcccacatgtaatagggtcaaatgactaagggtaaaatggaccttttgtgcttcagttaacaccgttagaagcctttaacagaatagggtcataccgtatcttcaattttaaaaagaagggtcaaataagcaaagttgaaaaaagaggatcaaattagtagttagctttcaaaagagggtcaaatgcgcaattgcccctaaaagttagtactaatattataaattatttgacttttttaagtcaaactttgttaaatttgattaaatttgtagaaaaatttaacaacatataaaatattaaattggtttaattaaatcttacattaaatatattttgataatatgtttgttttgtgttgaaaatactgctatatttttccataaacttataatatgaaatgaaggggtactggtttaccgctaatgctaaaagggagcaggtcctaagcgtcatccacaatgcaatgataattaggccattcatagtacagatcctctacttacaggtcactaatatgtggatccgctggtagagggtccatatgtcagtgacacaagttagaggatctcaatccttgcagtgaggtggcgtttggtctaaatacgccactttcgagattcccttccacgtaagcagatgttgttcatagtgagtccctcgtcctcctgttaggatttggtggccttgttagagaaaagtagaaagacgtccagcgaagcagaaaacatgagagagatgttgccatcgcggagctcccatctctgcaccctgcttcgcggttgccgttgatcttgcctagccaaaggtgcctccggcagggagtgccctcaataactagatctcgcccgatccacctttgagaggttgctgccttgatctaaattgggaggacctcgtcaacacggtgccgcttggcatcctcgctaccgccataatgtggagagaggggagaggaggaggcaccaccttgatccgcactggctaccccgatgtgcgaactgtcatgagtttgtcggccgcaccgccacaaggctatccacctcgctctgccgggccgagcgcaaatgctaacattgtcgacctgcgctggcccgtctactcattgctccatctgctccattaggaagaagggggatggttgaggcaagaaggagtggcaaaaagggcatcgacaagagaccgctgtcctaatctgtgagttgttaggagcttattgggagagggaggtgaggaggttgtcggcatcatcgggcagccgggcaggagggatagtggaaggagatgggattccattgttctgtatcacaaacaggtggggcagcagagaacatctttgatatatttttgtttagaaaaaggtcctttatgtaaagatctaactagaaaaaaaattaatatataacaagggttgaaacaaaatatgcatgggcttaaatgacaaaattgcatgggccaatggaaacacggtgcaccgtcgagatgtgtggttctatttactttcttattatgtagaagttgagtatccagttaggtgtagactacaatgtgagtactcttatctagtggtctcatgttgccagctcggagattctaatccagatcagcactgcgtgccccacgagagcgctcgtgccttgcaggggcacggatgccttgacagccgtgcaggtctcctcctctattgtgcacgtttctttcgcgagatagctagagagagaagttgcggccgaaaagggaaaagaaaatggccggagaggacagagacaggtctagaacaacctttaaacttatcaaaatgaccttaccaccgtcaccgtcaccgggtgttgagctcgctagttggagctgtctagttccttttacgcggatctggaagtatacgacgcatatctagtatttaaacggtggcgatactgatgcaacacctacacagtggtgctcaatgattggatgaggcaacgccaacaacaatgatgcgtggaaggtcggagacggtggccctcgcctatgttcaaccttctcattgaccgcgcggtgcactaggcgagacccagcatcaactccaccaatcgccttcaactgccattgccattgtcgctgggttttaggtaggagataagcaccatggggaggggagaggagaacgatggcggtggaaagggaataggataggtgccagtcggagcccaaaggggatggggggacgggggaggggggaaggggcacgggagagctaataacctagagatggggtgctatgtgcaagcgtgctatattcaagcgcatgccccctattgcttgcctagctgcttaccaatagtacaagcgtgctacatgttagcttatgataagtgttgactgtcaaaagcctagagacaaggacaccgaccctttataattgactaaatggtaagatttgtttgaattaaagaccgtgttttttcatcccatcccagggcaccaaaacctaatggttgttctatactcaacttgtccaaacattcagcacatgtctctcctcacattacattagtgcttgagttgtttaactaggcaagaagcttaatagccgagtaggcagacgtatgaagagaagatcggtccaatgtataatactctagacttattttagtcatcgtaggtaaatttagtaattagtagcgaggggaaaagtctaaagtacttctcgttaagaatagaaaattacgtagtaggagtatcagtgtattaccacgtgataggtaagtgatattgaaagtataagacttctcgattttgttgacgtagttaagagggtagaaattaattaacttatttttattaattttgaatgctaaaaattatgttactaatgtacaatttaagattattttaattttgtcactaacttcacgagtgtattcccgcctaactaccgcatatccatttgtggtgttcattgatcttatagccaaaaccaatcattagacgagacttgatagctccattgcatccaatctcacttttggaaaacggtagttggaacctgatagcttcatctgccaatcaaggcccccccgtacgttcgtttggtcaaaaagagatacatgttttccttactagaaaaaaatgtttgtacgttgcaacgggtaaaaatattttttatcctacgcactatgctccctttaatgcccatgcgttttggaccaaacgaacgcacattccttctgtccttttcagctctagtcctagtacagtccgctatctctctctgctcggtctacctctctttggctcagtccataaatggagttgtaggcccaagtcgaacagtattatgtccgtaccattacaaagccgatcctcccatcaaatccggtaatccgctcgagctcccatagtcttataccatgacggagccgatcctcccatcaaatacggtaatccgctcgagctcgcatagttccgtacccatacgatgactaacgaagccgatcctctccatcaaatccggtcgaatctttctccatatccaaaattattgagggatttttatccacttgatcttccttttccttttttttaccaaaattaaagcaatcagcaaaacttgggataaaaaatgacgacgattaaatggttcatcaaaatcgaagcaatctgcaaaacttgagataaaaaataactatgattaaatggagattcaatctgatgaattaaagctgaatcaaaaggggaattcatggggaaaataatgagagagtagtggggaatcaattattgcaacgaataggaggaggaagcatatggggagtaaaatcaacgtggcggcggcgctgggtttggcccgataaaaaaaccgcaaaaaaatatagcgataaaagaaataaacagaaaaattggtgaaagaaaatacgcaaagaggggaaaaagaaaacggacaaagaaaacaggaaaaaaggtgaaagaaaaaaaaagaaacgggaaaagaaaataaaaggaaaaaaacaggaaaaaaaaagaaaacgaacaaaatgtagttttcttttattttcgccactttcttatggggaatcagacttttttattttaggtttttttttctatttttttatttagacggacgaaggaaacatctcttaaaatttttaagtagtaatagatacaagataatgtaattttttttattgaacttgatgattacaccaaggtaatatagaccggtggagaactcatttttattcccggttaaaaacccccactagttccggttataacaccgtgaccaacaaatcgagactaaagatctcgatcttcaagtatcgactgaaataaccggtactaaatttgcatatcaagttaaaaaaaatatgtgggatgtgagagattcgaactcaagatctctcacctcatcctacgttaccgtccctcctactacacacatctaacttggatagatattaactaaccctgtagacatcttaccggtattaaaaatatctttagtacaccaaccgagactaaagagctaccaaccgagactaaagagctagagagctctttagtcttggttagtgttaccaactggtgctaaagatgcatttttagtactagttggtaacaccaactaggactaaaaaagtttccatgagttaaatttttagaaccgatactaaagcatatttagtaccggttcctaatctaatcaagatatttgtgattttgggtaccacaataaaagattaattctctagtagtaataactaataattactccgagaatgcgctcggcctctgcctaactaggatgtatgtagctataacagaaaccaacaagtttaaaagaaagaaagtacaagcagcattaacgactaggcaaagtttgctacagaacaccgcgacttcgtggttttagctgtaggacaccgcacgaagtcacttttgagggagcgcactatgtaaatgtggtaatttaccaagggacactacatctattaaattaatattttcgtgctgactagacgagagggggcccacttttttacacagcttgaccaaattacccctcttatctcattctgatcctctcttcttccttatctattcccatctctctttcattctctcttttacacgacagcggatgcccacttagcagcggcagcgtgtgtggcctactcggcggcggctgcggcggcctgctcgacggtggtggcaaagcccggagcacatgcagcctactcagcggcggcgacgcacgcggcggtgccaagagcgcggcctactcagtagcggcggccggcggtggccgtggaccacgccagctgcaacgtgcaggtggcctagtgccggacgagcacccgctgctccagcgtgtgcttctccttcctcaacgcgacgacctctgaccgcaaccgtcatagctcgtcgcaccggtggagctcctccacggccgcccgcttcttc

SEQ ID NO: 30090 - DNA, 328 bp, Oryza sativa
aactccttgccgttgtcggttcgaatgttcttgatcttgaggtcgaactcgttttgggctcttcttgcaaacttcttgaagattgcttgtgtctcactcttgtcatgcaagaagaacacccacgtgaagtcatcaacaataacgagaccatatttgttacctccaatgcttagataagcaattggccctgtcggtgacatgggaccgggggtatcgtgactagaggcttgggtagccgcggtcgcccacgtggcctgaccccctcggggggggggggtcgggcccgagggtgacgcggccacccctccctctgtctccccgaggggtc

SEQ ID NO: 30091 - DNA, 7188 bp, Oryza sativa
  unsure (1)..(7188): unsure at all n locations
ttgaaatttgtagagatctttcttacgctctttctccacttcagtccacttgcggttccaccttatgactctccgatgataattaggatctctagagggagcagtgataaagaaaggcccttcttcctgagcggcttgctgagcggcaatgtcctcttctaaatgaatctcttcctcaaaggatggtgcatgagaaccactaccttgacccggctcagaagaatccgtaggattgcctctccttacttttttagcaggtgcacttgatctttctccactgactcggctgcggcgaggaggaagaggagcaccatgctccacattagccacttgagctgcttggtcagaggcttgagcttgcgcgtcaatggcatctttgcgagattcggacatacgccgtatagcatgacgagccttggaagcgggagagcgacctcgagaactcattgtcccacggcgagagtaaacttgattcttgaactgacccgtgatcatgaggatacactgatttagaacagaggataatgattaagaagaagtggaagaagaatatttaaatgtgaagcaaggagaaatttggactgggccaaaaggaggtcggatagtctgatttgacgtcggactatccggtgtacatcggactatccgacagcatatcagacaatccgacggccttttgccctagaccaacaaatctcgattcacacaaacatatccaatggaatcaaaggatcttctaggtactagatctaggcactaaaacaagaagattcaccgaaggaatcttgaaataatacaccatgagggagatcgagggaaaacaaggaaatacctcaagaaccactaagagaatcactggggaaccagtgatttggaaggagttgagggagggaaaccaccctaaagtgaaggaatagccatcggagactccgaaacgaagatttttggtggcctataactagggtttggagtggagaagaggggtggagagagaaacgactgagacaaatgactgaaggggtaagaaagaggtacccccggggaggttaagtccccttgcccttggccccacgtcggatagtccgatttgaaatcggactgtccgattgtagtcggatagtctgacttgatgtcagacagtccgacatcctttgtggcagagacaataaaggatggctcaaggaagatttttttcaacaacattttgataggatgaactcgatggctagactattacttggacaaatgcagcaaaagaaagaaaactaggcaccctcgagagagggaatgtacgaatctatagcaaattgtgcaaggaccaagattcattagagaatgagatccccgtacacatagatttcaagttatccacatagattatgactagtgtttattcatgaattgaatgttcactttgtcatgatatggcaagcaaacctattctagtaaatgaaaaacacatgcatgcaaaagatcaagccacattccgagaatccaagatatttagctcacttctcaactcacaaaacctagcttcatctagaggcttggtgaagatatccgccaattgtttgtcggttctcacatgttggatgtctatgttgcctcttgtggaatggtctctcaagaaatggtggcgaatatctatatgcttggttcgggaatgttggatggggttattggctaacttaatggcgctctcattgtcacataagagtgggattttggacacatttaggccatagtctctcaaggtttgcttcatccaaagaagttgagcacaacaactccccgtcgaaacgtattccgcttcggcggtggatggggcgacggagttttgcttcttggaagaccaagaaacaagggacctacccaagaattggcaagtacccgatgtgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcgggcttagatgcacaaaggtaaataagtgagccaatgatggaacggtataccttttggtcaacgtctttaccttgctcgttgaggtcgaggtggccatttgatggcatgggagtgtggattggcttcgcattctccattccaaacttcttgagcatgtccttcaaatactttgtttggcaaatgaaggttccttccttgagttgcttgatttgaaggccgaggaagaactttaattcacccatcatggacatctcaaaacgtttggtcatcatcctactaaactcttcactaaaagacttgttagtagaaccaaatataatgtcatcgacatatatttggcacacaaaaatatcattatcatgtcttttagtaaaaagagttgaatcggctttcccgatctcaaagccgtttttcacaagaaaattgtgaagacactcataccaagctctaggggcttgcttaagcccgtagagtgccttgtggagcttgtacacgtggttgggatacttcggatcctcgaagcccggtggttgctccacgtataccaactcgttgatgggcccgttgaggaaggcgcttttaacatccatttgatatagcttaaaattgaggttagtagcaaaagcaagcaatatgcgaattgactcaagtctagctattggcgcaaaagtttcaccaaaatctaatccttcgatttgggtaaacccttgcgccactaacctcgccttgttccttattacgaccccggcctcgtcttgcttattgcggaagatccactttgtgccaatcacattttgccaaggtcgctccaccaaagtccacacttcattctgggtgaaattgttcaactcctcttgcatcgccatcacccaatccggatcattaagagcttcttccacccttagaggttcaatagaagacacaaacgagtaatgctcacaaaaatttgcaatacgagaatgagtggatactcccttgttgatgtctcctaagatgttgtcggtggggtgatctcgttggatactttggtggattcttgggtgagctagatttatcggagagggtggcacttgctcgccttcttcaccttgatccaagcttgaagtggagggattgtcggcttgggttaatgtaggtggctctacttgtgttgaggaagaggccccttgttgtggctccctaggacgcacgtctccaagagccaatcttttgattgcttcgctagggtcctcctcttcacctaacacatgtgagtcgacttgctctacttgagagccgttagtttcgtcaaatgtcacatcacgcgcgatctcaacaataccggaggtgttgttgaaaacgcggtatgcgcattcatttgacccatgcccaagcaagaacccctcatcaactttaggagcaaactttgaggatctagccttcttattaagaatgtagcacttactaccgaaaacacgaaagtaagagacatttggtttgttaccggtaagaagctcatagggagtcttcttaagaaggcggtgaagatagaggcggttgatggcgtggcatgcggtgttgacggcttcggcccaaaaacagtccgatgtcttgtactcatccaacatggtcctcgccatctcgatgagagtcctattcttcctctcggctactccattttgttgaggtgaatatggagccaagaactcgtgcttgatgccttcttcatcaaggaaactctcgatgcacgtgttcttgaactccttgccgttgtcggttcgaatgttcttgatcttgaggtcgaactcgttttgggctcttcttgcaaacttcttgaagattgcttgtgtctcactcttgtcatgcaagaagaacacccacgtgaagtcatcaacaataacgagaccatatttgttacctccaatgcttggataagcaactggtcctgtcggaaacaagcgagcaggggcacngtaanaagaggcctgggnanccgnggtcnncnagnnnnnnnnnnnnnnnnnnnnnnnnnnnnncngnnnnnannnnnnngcggccacccctccctctgtctccccgaggggtcgggccgcacccgtttcggccccgagggctggggcgccccgaccccctgtggttttggcgccacgtgtgtgggttaggtgagcacagcaggcgctcacctaaccgcatttatagcgggttagacgagcgcgccacgccgcattcaatgcggcgcagcgcatgcttatccggtccgtgaccagtcgcggtgtgtgaccggtcaaagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagacttcagcgcaagaatggcaaggaagtcgccggccattaaatgaagtttgaaatgggcgtcctccggaaaagctgacgagcggggcaggagacgagcgcactgcttgtcaagggtcacttccggctgtagactagccctcattgtaaaaagcatgtttcctttcttaggcagctagaggcccctgtggtgaccgctgaccagataaaaaggaggcccaggcctagaagaagggggattttcttgggggatttttgaggaggagcctgaactctctctggctctcgagctctctgtattccttcacatacagatccaccagaacacaggagtagggtattacgcttctcagcagcccgaacatgtctacgtcgcccgcgtcttgtgcgatccttctcgctgacattcctctgatcgagggcgaagaacctcacatagcgccctcggccgaaccggcaaaggggggcctgcgcggtcttccggtgaggggccccacgctccgtcatctggcgcgccaggtagggggcgcgcgtgtttttcgaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgcgacatcgccgcccgcgggcgacgggggaggacggcgagacggggcgcgtcgccgcctcgactacggcgatggcagcacgccccagggcgcgctccaggctgcgggtgcgctcttgcgtcacccgcccgtcgtccccgatccagagactccagcccgacgttggctggatgacgtggccgacttggtcatgacggcgcagcagcgcctaggcgccggtgggcggccctccgcccccgaggcctctggcgctgccgccgccggctccacgtcgtcaaggcggagggcgcggcgagcggcggccgtcacccccgttcgtccgccattccctcgtcaacgcctccgacccaagaagatgagcgtggggggtcggatgcccggctcgatatcgagcgccagcgcgacgatcgtcgcgccgcccacgcaacggagggcgctttctcgtccggagcgccacttcggtccgggcacgggggccggcccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcctgggaggatttgtgccagcagttcaccacgaactttcagggcacatatccgcgcccaggcgaaaaagcggacttgcatgcggaacagcgagggtacgatgagtctcttcgctcgtacattcagcggttctgtcaagtccgcaacaccataccgtgcattcccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggctctggcgtggcagctccggccgcccccgagtccgccgctcggtcagggcggcgggacaggaggagaaagaagaagtcggcccgttccgacgacgagggtcatgtactcgccgtcgagggcgcttcgcgggccccccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaagaggcaggagcgccgtgagggcaaggccccagcggctcccgccggcaaccggcgaggtgaggccaagcagaaggcccccggcgaggatattgacgatggcgactatgacctggggttctaggagcctgaggccaccatcgccaccgtcgatgggggagcgtgcgctcacgcttctcgccgaagcctcaaggccatgaagcgagagcttctggccgcggcccctacccatgaggcgacgcggcgggcgtggtggtcggaggttgccctcaccttcgaccagaccgaccacccgccatgcgttgcccggggaggacagatcgcgatggtggtttcccccaccgtttgcaatgtgaagttggggtgtgtcctcatagacgggggtgcagccctcaacatcctttcccctgcagcctttgacgccatcaaggccccggggatggtgctccggccgtctcagccgatcatcggtgtgacgccggggcacacctggccgctgggtcatatcgacctcccggtcaccttcggtggctccgccaacttccgcatggagcgggtggacttcgatgt

SEQ ID NO: 30092 - DNA, 830 bp, Oryza sativa
  unsure (1)..(830): unsure at all n locations
agtcgcacttgcttgtatggagcagcgcgcgtaccacctcgccgcggcgtccaagcccacgggtggcgacgaaaggctcggcacctccgtccccgccgccccgaggcagcggatggtcacgtgcgacgaggtcccggtcaaggaggttgccctgggcgacggcccgtccaagaccacacgaatcggtggtcttctggacgataaataggaagacgcgctcgtctccttcctgcgggcaaatgccgacgtcttcgcctggagaccggcggacatgcccggggtccccagggaggtgattgagcaccgtctcgccgtgcggccgggcgcaaggccggtccggcagaaagtgtggcggcaggccccggaacgtcaagccttcatccgcgaggaggtggcgcgacttctggaggccggattcatacgtgaggtcatccatccggagtggctggcgaacccggtcgtcgttcccaaggcgaacggcaagcttcggatgtgcatcgactacaccgaccttaacaagaatgcaggtcctacttttcaacgtactactcgaatttctttgggtagccaaataggacgtaatgttgaggcctatgttgatgacttggttgtgaagacgcgcaaccaagagaccttactctcggatctagcggaaacttttcgaaagtctccgctccgcccgcataaagctgaaccccgacaagtgcgtgttcggcgtgcctgcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30093 - DNA, 4504 bp, Oryza sativa
tccatggtattgtccaaatagcatcaatgagtgcagttttccaacatctagtctcttacttaatgtgatgaaatccttcttgatgttttcaaaagtcactctatcatttacgtccatgtcatcaaccacaatagataagtgtcttatagatggtagaatttgtatagatttgacatttgaactacatatggtaagacattcatacgatgaaaccttcaatgctaactcatgtagtaggtcatgcataacgtagtatgaagacccatcttctacatgtttttcaaaaaatccatagctaaccaaatcattcaatcggctcaatccaatgtcttcaattttcttgttttgatcctgtgaatgtaggatgtctagtcctatccataagtgaattatctcatcactagcaaatttatggtcttcagggaacatagcacaatatgtaaaacattgttgcagatgaaaagggagataatcgtagctaagctttaatgctggcataatatcattctcaccggtttgtaattcccattctttactttccaggacacttgtccaatgttccaaatcaaggtgatttttcagtaacctcccaactgttttcgctgccaaaggggaacccttcagatttttttgatatcatttttccagtctcaagtaaattagcatgatcatttgctgatttctcatcaccaaacacagatgctttgaataattcccaaaactcttgaggatcaagcccttttagttgtattggactatcaattgttttaaccatttctaccactgctagaaaatgagtggtgactagaattatgtttcccttggtttgtccttttttgagagatgctaatagatatttccattcatcctcgtggccacaattccacatatcatccaagacaagtaaaaactttgatcccaagctttgcacaatcaaatcatgcggaccactgtttttctcatctttgagttgagggatcgacttggcaatgtcttctttcaatctatacacattgaaattgggagttacacaaacccagacggtaacatcaaagtagttatgtacttctttgtatatatactgtgcgagagttgtcttccctatcccccctggaccaacaattggaatgatggtcaggtccttgtcacagtaatcaccatgagtaatgtttttaatagttgtattttttttcatccattctcccataaactgtaggatctgtaaactctgaagtggtcataggccgactgatagcaaaaccgcttggaagaacaggtgcatgccctggtttcttggaaaactcggcattgagactcatggcaatgtactggccaatgctgcgatttgattccaacaactctagattgagtatggtagagactttggcacacaatggcttcagctgttcgacaatgcgcttcattctttgggacagatccaccctatcgaacttcagctttggtgttttcatcgtatcctccctctgcaataccctgccgcaggaacaggtgcagcggaggaactggcttcctgcatgtgcacatgacgctagagttagaaaacttgtacagtacaatatcctagcagtatatagaagggcatgttaggaatttggtagaaaattagagatggattttacagcaatttatagtttatatttaatccaattgggaggagtatttagtactggatctcatcgtgcactagggaagaacgttgctagagcgatttgacgagcagcgaggtggctgagcccggccaagaggttggcgttcgcggcggtctggcaggctcgccgtgcgctcgtccttttggccgagcctcacggctcattgctagacacggcgacgagctgatgtatatatggtcaagagcaagggctgtttagcagggtgtgttctttatttcttcactatttttttttcacgaacgcgcaaaaagattgcacgtcaatatattagaaggaaaagagttcttattacacaatgcaatcagctatataggcttatgccaaggggggaagagagaaaaaaacaaaacaaaaactgcagctaggtttactatggcggctaaacgcaactccgatcagcgggaaaggatagagccacactacttatttcttcactataatctggttgtttacccagagagacatatttgccttttttttcaaaaaaaaatgttttaaaaagttttactcattaaatagggaaaaggaatcaatctacaccgttaggtcgtcatactggaagtataaattagaattgaattgtactctagagttatcaccaccgtaccgtcatgttaaggtgcaaaagagaggcatggaaagtgtttaccgatgtgatgggtgttgccgcgagcactgggagagagcttgtgcatgcagcagttgctggcaacagcctcctcgtcggcggcggcgtggagagtgcgcgacggcgacgagccgatctgacggttcatcacttgaccaccaccagcacacgaggagccgatctgacggttcttgtcttctcccgaccgccgaccgtcagcgtcagggtgatcatcaccagcgcacgggaggagcactaggttgctcgcgacgctgagggctgtatggcgagtgttgaggaagaggttgtggacgacgcagcccttggcgtgctcgtcggcggcctcgcaggtgccgtcgagctcgtcctggatgcggaagtagtcgagctcgtcgagcacgtcctcggcgtcgacgcgtcgtgggcgaggccacgcagctccaggagcagctgcctcagcgcggggctgcgggcctccctgccgccggtgccacgggcgttgtcgagcatcccctgcgcgtacagcagctccatcttgacggcgccgacgttggggccgagctccttgctggccacccacgcctccacgaaccctccggacagcgggctcagcgccttgctgaccacccgccgcgccgcgttcacggccaccgactccatcgctcgatctcccccccggcgccggcgattgagcggccggagagcgcagaatgtcactgcttcgatcgtccacgatccccggctgccaccaatctccaagaatgtgcaggaacgaaagagacgacaatgcgcagagaatagtagtggcaaagcacaagcttaagctttcgttttgattccattctgctctgcacctttactctgatgaaagacaagcccccctggcactgcacgggatgccggcatcggcatctgttcgcttcgttcgagatggtccatgtctgggcacccgatgccacagcaagccaacaagcaagcgcctgttcgatgccagctccttccctttgtgctgcgtaaccaagaattttttgttcatcttcaggcttcagctgcttctgaggaagatagacaaagctggtttgcacagtacaaattttgcctgccttgagagcagcaatggagcctccttcccggttcgagaccaacaaagttgtttcacagtagatgaggcgtttgtgcaaaagtactgcagctaagcttctgttactccaagcattatccataagttggctaagataatggctcctacctaagctaaacttcagaaaatgacacaagttattgtgaaaagcattgcgacgccgaaattgtgacggagtggctatgtgtgtctggaatttgaaaaaagaatcagtagaatgctcttgaatgtatagccaaatttctttttctactagaaattgggctagttgaaaaagattaaattttctgattctggcagacaaagccagcaatagagatatagatagatctgtagaaaccaaagtggaagccagcaacactggaaggcgtggacatgggtaaggtggcatcagttcttgagccattagctgctgaggttgagttaaatgtatgattttcacagcaaacttgtagtacctgggatgcctaaacatgccgaaacttaccatctcacggaatgtttgggctttatatccgactcattttctcggcgcgggtttgttcagcccatgagcctcctacgacgcgtaagcccattggtagcgatccaatcttggctgtttacgatggactccaaagcttaaccggaccatttgcccatcatgcggccgaatggcgctcaacggctcaacccaccagcggcgccgcgggacgctggttctaccacttcggctgcgggccgtgatcgaatggtcgtgtgtagcaaaattcctgttgggctatcgatcgccctgggcgtaggggtgggcattcggtcagaccaaaaattcggtttaggtctttggtcttttttgaaagtttggtcatctatagtgcaagaccgttcggtcttgaaaaatattgaagaccgatcaattcggtctcagtctcggttagaccgaaattttagaaatattcagaagaatcgcacaaatcctcaataaatttcagatccaaaaaaatcatacacatcaagaaaattcataaaaatcctagatcagctttcttcactatcatatactca

SEQ ID NO: 30094 - DNA, 750 bp, Oryza sativa
gcagggccgcgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctctttctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaacc

SEQ ID NO: 30095 - DNA, 5311 bp, Oryza sativa
  unsure (1)..(5311): unsure at all n locations
gcttacgggcagaggccggagatgtaacacatttccattatttaaaaaaaaattattaaattaagaacagtacactgaaagtactccaagaagtataacaatagtccatgcaaaatatgatttggtggggtgactagcagagctaatatagcatcatgcatgatttaagcaagattatatggagatatatcacttctacacgactacaccggcaaaatgtacaagttagtgcgttctcggtctaaccgcacgacgacgcccatgtaaaccgaatttaacagtgtgaaccgggctgcaaaattaaattaaactgtcgcaagttttgtagcaattccgattaataaatgacgttatgacgcaacgatagaattaaaacaaatcaaatgacgttattacgcaacgatagaattaaaacaaatcaaattaagtcagcctggtcagtgatcagtgcaccatagcgcagctaaacaaagcaggttaaacgtgcttaattaagtcaacacaaccacactacctccctgccttatttttcttttcaaacctctgaagaaaaagttcagaaaagacatggagaacaaaaaaaaaagtgtactcctagctaagtagcgaagctaatctgcttctataaatacccagcaaggcatgccgtgtcacccaccacacgcacacagttagctctagctttgcttgatttgcagcagcagcagcagcagcagcagctagcttgcatccatgggcgtcttcgccgtcaccaaggtgtccgagggccccgtccggccgtccgcagcgacgccgtcggagacgctgccgctcgcctgggtcgaccgctacccgacgcaccgcggcctcgtcgagtccgtgcacatctacctccgccgcgacgacgccgccgtcgaggcgccgtgcgccgacggcggcgtcatcgtcgagggaaagaagaagaataataagcccgcggcggcggtggtgcgcggcgcgctggcggacgcgctggtgcactactacccgttcgcggggcggatcgtggaggacgaagcggtcgccgggcgccgctgccgtgctgtgctccggcgagggcgtctacttcgtggagggcgccgccaactgcaccctcgccgacgtcaaccaccttgagcggccgctgctgctgtccaagaggacctcgtgccgtgcccgacgccgaagcagtggcccgtcgagccgcacaacagcctcgccatgatccaggtacatacgtgaattaatactgcattattcctgcttgctttttttttcttttttctttttggcttctagattttgctttgcactgttggatctcgttatgtttttcatgtgtccttgaaattgatatggcaacaagcatgcggcagtttgaatctatcaatcaaacatgcacgtcaaacttaatttcgtgaaaagaaaattaaattaatactactgctagctcctgttgtgcattgtgagtgtactgcacttgattagtacaggagttaactgcatctacgactctagtaccaacgtgattgcaacacctagctagattaaaaatacctttttcgtctcctttgccacgaatttgaattgatgttttattctcatacctatactatgtactggagtactcctgaaaaccagtgtagcttgcagaaaaaatgtcgaggtcaaaacctgggtacagaaccaaaaacaaagcaaaaaaatgacgcggactcatcagtcagttgattaattagttggaggtcacgtgatttgcaggtgacgacgttcacctgcggcggcttcgtgatcgggctgcgcaccaaccacgcggtgcggacggcaccggcgccgcccagttcatgaacgccgtcggcgacctcgcccgcggcctcccggagccgcgggtgaagccgatctgggcgcgcgaccgcttcccggacccggacatcaagcccggcccgctgccggagctccccgtgctgccgctccagtacatcgccttcgacttccccgccgcctacctcggcaagctcaaggcgcagtacgccgccaccgccggcgccagcaagatctgctccgccttcgacatcgtcatcgccaagctctggcagtgccggacgcgcgccatcgccgccgaccccgccgcggccgtcaagctctgcttcttcgccagcgcccgccaggtgctcggcctggagaccggctactggggcaacgccatcttcccggtgaaggtgtccccgccggcgggggaggtggcggcgtcgtcggtgatcgagctcgtcggcgtggtccgggaggcgaagcggcggatggccggcgagtgcctgcgctgggcggaggggcgcaccggcggcgccgacccgttccagatgacgttcgactacgagtccgtgtacgtgtcggactggagcaagctcgggttcaacgacgtcgactacgggtacggcgcgccgtcggcggcggggccgctggtgaactgcgacctcatctcgtcggtgatcgtcatgcgggcgccggcgccgctcgccggcacgcggctgctggcgagctgcgtcaccaaggagcacgccgacgacttcgccgccaggatgagggaggatctcgtctaatataccatggccgcccccaataacattattagtcacgtacaatattgtcactgaatattaatttgttcgtgtatatctattgtggtatgtattttttttttcataggaaaaaagtagtagtacgacaataggtagctgggagctacctaatatcgacctctggtttgagagtaagtgagcgagcgagagatgtaaaccacctcagtttttaccgtgctttgtgacatgcgtggtacagtactggtactattaatcattggccgtgaaaaattatctacccatatgccactgtatttatggttgtttgtggaggattacgtatactaatttatctatgtcttacatttttcttttcatggacgcactcttaaggccccctttgaattggaggataaatggaggaaaaacaaaggaatggaaattctatactattcatgcctttgattcgtagaaatgagaaaaggaaaaacgtaggaaactttcctattcctatgattttagaggaaaaaagtagaaaatttaacatccactctaacctcttggaaaaattcccttgagtgtatctctctcatctggttcctacgtttttcatgcggtccaatcaaacggtcattcctatgtttttcctgtgcttttgcaatcctttattttacacttgtattcttatcagtcctacgatttaaatgggtcctaaatatgtgtctgtgtgagatgcccgttaggtttcttcaattcacgccactatttcaagtggctagctacatccactacatgagttttcccttggagacaaacctnctatcataagaccaaccgtcgacaccagacaccagtgacgtcctctattactgtggctcacctnccacgccacctttcttctaataaaaagggnggcaatgggagttcctcgtaccgctctggctctcactcactacgcctcctcaccttcactttaactttcccgtcatgatgcatggacgcaccgcgaccgccttagaatatcaccaccagtgaggaggaggaaaacaacgatggtaagcgacaaaatgcatcttgttcgaggccaaggacaagatacaataaaacgaaaagaattgtgaatgcctagcccaatatgcgatttaagtaataaaaactgatccaaagtacaattcacttcgaaataaattttgtgctcgaccaattcgatcatcttcctttttgtgatgattcgggtaaagtgtgaaaggtgacaatcaacctgcaagtacacgtacgagagagtgacactcctcatatctgatatctgtgttgaaatactcccttcgtcctaaaataagtgtagttttacactatttacgttcaacgtttgatcgttcgtcttatttgaaaaaaattttatgattagtatttttattgctattagatgataaaacatgaatagtactttatgtgtgactaaatatttttaattttttcacaatttttttaaataggacggacggtcaaacgttgggtatggatatccacagctacatattttgggatggaggtagtatattactactgtcaagtcatatacttaagataatttctaactctgccactgacactgggtctagtcacatacacagccatgcatgatgcacgtacgtagatacttggattgtgtacggctcgatccatgatgcggacccagcatatagtaccaaaatagtggcagtagtttggcattgcacaggcagtacgcatacactaactcatcgttgaataggagtaataattatactaatccatatagataacccttacaccgttttatattataaatcattaattttaacctttttctggttaatttttttaaatgtttgactaggtttatagaaaactttagcagcatctaaaaaactaaatttgtttcattaaatctcacattaaatatattttaatagtttacttattttgtgttaaaaatactactatgtttttctataaatttggttaaagaaaaaagttaaaatgatttataatatgaaatgaatggagtagtgtactacacggatacacctgcttttgcaattttcatgcagctttcgttcatttatttatacatacttcacttacttctctctacgtaccatatatataaatatatggaaggtcttcctacaacaactattatttggaagttagtagttcacatcagcttcataattgtatgagtgtctggagtaaaatctctctcggcaatcagcttatcagcataaacatactatatatctatcactggacttttattacaacgttctgctcactttcttgcaacaaacgccaagccgtccgtacaatcttctataattgcagggaggcaggtgaccggcaaaactgaagatctcaaacaccaaccgacactggtgtactcatgcaatattaagaaaaaaataataattcaagctccagttaagctagctatagcctacaggctatatattgctaacgcacattatttttcgttgacctccttccttttgctgatcgcgagaaattaagctagagcaagtataagagaggctgatgaaacatcgcatcctactgcttatttccaagcgtcttaaggaccttgtttttgttttttttttcctcctcgccgacctaatattcacctagctagcataagatatttacgtacggcaactgcagaatcatcctctcgaattagcctgacgcaacatgtt

SEQ ID NO: 30096 - DNA, 15454 bp, Oryza sativa
  unsure (1)..(15454): unsure at all n locations
atagtataacaaatctggatacctttatatctaaatccattataccaagttggtcgtgtcacatcccccaattagattgggtcttgttttaagacgtgaataaacactaagttaattagtgtgagccctccttcaatagatagaaattttcctttccaactatggaagagatgcatatgcgtgtccaaacaccaaataatagtacattagcccgggagcaagccattggagcatactccctccgtccaaaaaaaaccaacctagaaagagtttgtttagattcgttgtactagaaagggatcctttaaggttgtcttaaaaatacccaacctaaaaaagatttgtccagattcgttgtgctaaaagagaaccctattagacttgtttttttttatggagggagtacgagactaactacaaaattttcagtctagacaatgaccaagcgggggggacatatgtcgctggactcaaactccacgacggaactggcaaacagacgacaagatctcgaccgaatctgatcgacactgggtaaggtcaggaagaacagtcttactcgtcttttttctaatccaacttaagctcagtgatgacgccaactaatctggaccgtgtttagttgtttaggtgtaaaaattttaaagtacacgggcacacatttaaagtataaaacatagactaataataaaacaaattacatattccgacggtaaactgcgagacgaatttattaagcctaattaattcattattggcaaatgtttaccatagcaccacattatcaaatcatgacgcaattatgcttaaaagattcgtctcacaatttacatgcaaactgtgtaattggtttttttcgtctatatttaatgctctatatatatatatatgcccaaacatttaatgtggtggaatttttaaaagtttaaaggtaactaaaagcaacgctggttgagttcgtggatgcgacactgccatctcgaactcttgtgcactcctctcgctcgccacacgaaacgccacaccactaacagataaaaaatagctggccaattgccacccattttgcctatgcgccatagctgagctgagctagagctctcactacagctagctaaccgagagccacacgtcggtgactcgtgacctgtggagccatgtcgccgacgccgaggccgcacttcctcgtgctcacgttcccgctccagggccacatcgcgccggcgctccgcctcgccaggcgcctgctcgccgccgcccccgacgcgctcgtcacctttttcaccgccgccgacgcgcaccgccgcatgttcgccgagggggagggcggcgacggcgacggcaggctcgagctcctcccgttctccgacggcaccgagaacgggttcgtcaagcgcggcgacgccgcggagctcggcgcgtacatggcgtcgttccacgcctcgggccggcgcagcgtcggggagatggtcgacgcgctcgcggcgcgggggcgccccgtgtcgagcgtcgtctacacgctcctcctgccgtgggcggccgacgtcgcgcgcgaccgcggcgtgccgtccgcgctctactggatccagcccgtcgccgtgctggccatctactgccactacttccacggcctcggcggcgtcgtcgacgagcaccgccgcgaccattcgttcgtcctggagttcccgggccttccgccgatggcggccggggacctcccgtccttcctcaccgaagccaccgacccctccgactacttccacagcatcttcaccacgttccgcgacctgttcgacgccctcgacagggagacacccaaggccaccgtgctcgtcaacgtgttccaagaactcgaggcggacacgctcgccggcgttggggcgtacgacgtgctccccatcggcccggtgctcccgtccggcgacgacgccgcgctgttcaagcagaacgacgccaagtacatggagtggctcgacaccaagccggccggctcggtggtgtacgtcgcgttcgggagcttaaccgtcatggcgaaggggcaggtcgacgagctgctccatggcctcgaggagagcgggaggccgtacctctgcgtggtgcggaaggacaacaaggccgccgtggcgaaaacggccaacccaacggcggcggcggcggcgcccagaaccggcgtggtggtgaagtggtccgaccaggtgcgcgtgctgtcgcacgcggcggtggggtgcttcgtcacgcactgcggctggaactcggtgctgaagagcatcgcgtcgggcgtgcccatggtgggcgtcccgcggatgtcggaccagcagatgaacgcgcggctcgtcgagcgcgactggcgcgtcggcgtgcgcgcgaaggtgtacgncgncgacggcgtgctgcgcgcggcgaagctgaggcggcgggtcgagaaggtaatggtagacgggaagccggcggaggtgcgcgctcgtcggcggcgtggaagcgagcggtggcggaggctctagggaaaggagggtcgtcggatcgtaatctgacggccttcgtggagggtgccagaagtgtcatttgaaaacgacataatttgaaaacgttataagatgtattttaatttgaaaacgatttggggatcctagggtcttcccttgttggtttggctgtttgttcacttgtatgtacaacctctactgaactactccctccgtcctatgatataagggattttgagtttttgcttgcacggtttgactactcgtcttattcaaaaaaatttggaattattatttacttttttgtgacttactccctccgtcccaaaaaaaaggtaaaccctggattttcgtatccaactttgactgtccgtcttatatgaaatttttttataattcgtatttttattgttgttagatgataaaacatgattaatattttatacgtgacttgtctttttaatttttttcataattttttcaaataaaacggacggttaaacgttgggcacggaaactagggtttgtctttttttggacggagggagtactttattatctaaagtactttacgcacaacttttcgttttttatatttgcataattttttttaataagacgagtggtcaaacactacaagtaaaaactcaaaatcccttatattattggacggagggagtagctgccaactgggctctcattttttatgggcttttgctatattgttgggccaaattattaccaccgaactgaactacctgttgggtaagggaacatgggctttctctggtgtactttctactttggggtcccgtgggtaatataccatccctgccctcgcacccagaaatgaccagggcccccacccgcttcccctgcgggttagaattcccacccgtccctgtaggggcgggtactcaccgggtccccaaccccaaccccacgggagaaattaccacccatatatccaatcgttcgtaggctcgtagcatgtttgttctgcacaacccagatatctaattgatgacagtttgctatagttttactagctaggctatttggtgagaagccgacaagtgaacggtgcctacacattcgtagcccaataccctacctatgtactcaaccaagttcttctttagtccatggccatgtttggatccggagggctattaaatagccctccggaatcttgctatttaagagtattaaacgtagattactgacaaaacccattccataacccctaggctattttgcgagacgaatctaacgaggtatattaatccatgatttgctacagtgatgctacagtaatcagccgctaattatggattagtatacatcattagattcgtctcgcaaaatagcctaggggttatggaatcggttttgtcggtaatctacgtttaataatcctaaatagcaagattccggagggatatttaatagcccggaggatccaaacaaggcccatgtatacaatcactcctattccttcttcagtccgtatcctatcgctcgtaggcttctaggtggcagcagaggtgcggcgtaaggcggcgacatggaagcgagcggtcgaggcggctttaaggaattgaggctcgtcggtaggggtgtgtcagggttacgggttaggtataccctttaccctttgatatatgtcacatatcggtatggcatgcccacgcgcatacggatactctctacatacactaaggaaatccttcacagagtttacggacgaaaagagtcctactcggacaagactgggtcgtcaatgtatcgtgtagggtttgatgtctccgagttctacttggaaaccggctgacctgcgatataaaagggaccccccagggaggacctaaggcatcaaatctcaaagccaacacaacccccacagatctagtcgaaccaactcgactacgatcttgtcggatccatcgaattccattgttccctttgtaacctgtgttttccatcatataatcccacgtcaactggattagggctattacctatcaaggggcctgaaccagtataatcttcgtcttttgtttgcttgatgtcgtattacgtggacccttgtaacaacgtactccaataccctctatatccggtctatgggtatcacccgtcgatagtggcgcgccaggtaggggcacttggtgctcaaggttctactactatgtcatccagcttcgtcgacaacagcgtcaacaccaacctcaaccaagtattccctgcttcaacaatgctggtgtagactcaagtcggcaaaatcgtcttcccggtttacaccacgatgccgatctcagccggtccatcagtgaccggaaacgagaacgcagtggatacaaaccaagacgactccatgtcgaaaaatcctcccgccgaggcagagaacggaacatgaacgacatctgagctcgagaaggattccaaggcgaccaaagcttgtcactccgacaagaaccacgagccgacgaggatgacttccaaagcgacaaggtcctggtgtcctatccacaaaaccaggaaacacactttgcaagcctgctgggtttttctcaacgtccgcgctgaaattcgctcctgcaaagagcgtggaattcagcgtatttctccaactcgtgatgtctattctcctattcacaagacaaagaatcacgacctctcaagctgcaaggtctttctcagcgccatgaaggcgccatctcctaaggtccaacagtcacacatcctcatcagggataaagacaaggaatgaggagcgacgccaacttcggatcgatttgttggggtaatcgacatcgatccccacgaaccatcagtcttgcacctcctcgaagactatggatcatcgacaacgagcgtgccacgggagatattggctattgatgatgtcggcacgtcacagcgcaccaatgcagaagcggagaatcaagtagccactccggcccaacacatcagagccgtcaacgctatactgagggaaaccccctacgatcccgttctgaacgatgatctcgcgcgttggacagaacgactacgggaatcagtgaccaacctcagcaacgcgttcgaagaggccgctgccgcagcgcacccagagcagccaccaactggcgatgccaatggtgaaaaccctgaacggagggaatcgcctcaacgagccacccctccacctcgcggcaccggcgatctccgtgatcacctcaacggcagccgagaggcacgacgcacacaagacaacgagaaccgttcccggcgtcatgtctcttcacggcgtcatgataacaaagatcgaggagaccgttcaaacgaagactgagaccgtgataaccgccacgatcacaacgatcgcgaacagcgggtgccaggcgatactggtcgaggacgtcgccataatgacgacgatgatggagaccggcgccgagacaacagcgggagacggcgacaggattctcgagagccaggccgacaacctcgtaatcgtacactggaaccaagcgacccatcgtcatcgtcattatcctcgtcttcctcatcatcagatagacatccatgaaggacacacgatcgccgataacccaccgcccccagcgctgggtgtagagctttcagtcgttccctgcatgatgtccgatggcctgagagattccgacctggagcaatagagaagtacgatgggagcaccgacccagaagagttccttcaagtctactccacagtactctacgttgccggagcagacgacaatgcattagcaaattatttgccaaccgcgttaaatggctctgcacgttcatggctgatgcatctcccgccctactcgatctcttcgtgggcagacctgtggcagcagttcgtcgccaacttctaaggaacctacaagcgccacgcgatcgaagacgacctacacgcgttaacacagaactcgagtgaatccttgagggaatatgttcggcgcttcaacgagtgcagaaatacaatccccgaaatcaccgacacttctataattcgcgccttcaagtcctgcgtcagagatcgctatactactcaggagttggcaacaagacgcatcacaactactcagagattgttcgaaattgttgagcgatgcgcccacgcagatgatgcgctaagacgcaagaacgataagccgaagaccgggggagagaagaaactagccacggacgcacctgagtcaagcaagaagaaaaatcgcaaaaatgggaaaaggaaagctcaagcggaagtcctcgcagcagaatacgcgaaccctcccaagcgcccagacccacaaggtagcgacgcaaagaaagcatggtgccccatacacaaaacggacagacattctttggaagattgccttgttttcaaaaagtcgctcgagaagcacattgcatttgaaaaaggcaagcgagtacgcgtggtcgaaaaggatgcggaagcggctcccaaggagtcggactcagcatatccagactctgacctccacgtttcacacatcttcggaggttccacaacgtactcctcaaagcgagaatacaagaaagtggaacgtgaagtctgttcgacatggcagggggctgcacccaagatgaagtggtctgaacagaagatagaattctcggaagaagaccaccccaagactgccgtcatcccaggacgatatccgatcgtggtcgaacccactattcggaacatcaaggtcacgcgggttctcatcgatggtggcagctcaatcaaccttcttttcgccggcactttggacgcgatgggaattccgcaaagcgaattgacaccaaccgattaaccctttcatggaattactccccagtcatcgtccaaaccattgggcaagattacgttgcctgtgactttcggccaagctaacaacttccgaatagagcagatcacctttgatgtcgctgaattcgatacagcttataacgccatcattgggagaactgcacttgcgaagtttatggccgcatctcactacgcgtatcaagtgctcaagatgccgggaccgaagggaataatcactatttaagggaatgcaaagctggcggtgcaatgcgacaaacggagcctcgacatggtcgagcaaacgcccagcccacccgccacgaccaagccacccaagaaagtgagcaagacaaacaagacgccgaaaccggacggcgcaatcaagatcgttccactctccagtgccaatcccgacaagaccgtcaagatcggggtgacactaagcgagaaataggaactcgcgctcatcaccttcctccgcgacaatgctgacgtgttcgcttggcagccgtccgacatgctgggggtccccagggaggtgattgagcacaaactcatcgtgcgacccgatgccaagccagtaaagcaaagactgcggagatttgcaccagaccgaaaacaagccatacgagaagagctcgacaaacttctcaagcctggcttcatcagagaagtactacatccagagtggctagccaatccagtcatggtgcgaaaggccaacgggaaatggagaatgtgcgtcgacttcaccgacctcaacaaggcatgtcccaaggatcacttccctcttcctcgaatagatcagctggtggactcaacagccggctgtgagctgttgagctttctcgacgcttactttggctaccaccaaatcagcatggcaaaagaagacaaagagaagacaacattcatcatgccattcggggtattttgctatgttaagatgccattcggactgataaccgcagggaatactttccagcgcacggttcagggcgcacttagcgaccagctcggcaacaatgtcgaggcatacgtcgacgacatcgttgtcaagaccaagacaagcgactcattgattgacgatctgcaggaaacgttcaacaacctccgacgatatcgcctcatgctcaatctagagaagtgcacgttcggagtaccatcgggcaagctgctcggattccttgtctccggcagaggaatagaagcaaatcccgagaagatcaaggcaatcgagaacatgaagtcgcccacaagactcaaggaaatacaaaagctaaccggatgcatggcagcactgaacaggttcgtcgctaggatgggagaacgagggcaacccttcttcgctctgctgaagaaacaagacaaatttgtatggacacaggaagccgaagaggcattcattgcactcaagcgctacctatcaaacccccctgtacttgttgctccccaacctaatgatgaattattcctctatattgccgccacgccatattccgttagcaccgtcattgttgtcgagagagagaaagtacaacgaccagtctattacgtcagcgaagctctccacgacgcaaagacaagatatccacagatccaaaagctgctttacgtggtcatcatgacatcaaggaagctacgccactactttcaagcccacagagtcacagttggctcctccttcccgctcggtgaagttgtgagaaacaaaaacgttgtcggccgcattgcgaaatgggtagtcgagctgagccagtttgatgtccactttataccacgaacagccatcaagtcccaggtactcgccgacttcgtagccgattggactatgcctgatgacaaatcagacaaccaagtcgacaacgaaacgtggacaatggcgttcaatggtgcactcaacagccaaggagcaggggcagggtttatcttgacgtctccttccggagatcaattcaagcacgcaatccacctcaacttcagggcgaccaataacacagccgaatacgagggattactcgccgggataagagctgcagccgcacttggggtcaaacgactaatcgtaaaaggagactccgagctagtcgtgaatcaggtgcacaaagattataaatgctctaaccccgagttatccaagtatctcgcagaagtcaggaaactagagaaaaggttcgatgggatcaaggttcgacacgtttaccgcaaggacaacatcgagccagatgacctagcatgacgtgcgcctagacgagaactgctcgagcccgacacttttctggacatcctgacgaagccatcagtaaaagaggttagcggcgaagttagcccggccgccccagacattggcgcggaggccacaaaggcagaacgcgccgttgccgatatcgagatcacagatgactggcacatcccacttatgaaattcatcaacagcgaggagttgcccgaggacgatacagaggccgagaaaataacccgtaaagcaaaaatctaaagtgtggtcagcaacgatctatacaaaaaagcgccaaacggggtacttctcaaatgcgtctcgtccgacgacggcagacacctcttccttgatatacatgaaggcatctatgggtcacatgccgccggtcggacattggtcgggaaagcttttcgacaagggtttttctggccaatcgccctcaaagatgcatgcgacatggtccagcgatgtgaagcctgtcaattccacagtaaacacacaaagctacccgcgcaagtgctccagactatccctcttacttggccattctcgtgctgggcgctagatatactcgggccattcccacgaggacagggcggttacaggttcctattcgtggcgatcgacaaattcactaagtagatcgaagcagtacccacgggggaaatcaaggccgacaacgccatcaaattcatcaaggggatattttgcagatacggactatcgcaccgcatcataaccgacaacggctcccagttcatcagcaccgatttccaggattactgcatcgggctgggaatcaagatatgcttcgcctcgatctctcaccctcaaagcaacggacaagtcgagagggcaaacggcatagtactacaagggatcaaaacccgcgtctacgacaggctcatgtcacacgacaaaaaatgggtcgaagaactcccatcagtactatgggccgtacgcaccacaccgacaacatctaacaaggaaacacccttcttcctcatgtacggttccgaggccatgctccctagcgagctatgacatcagagtacacgagtacagaagtattccgacgaggatcaggaggagtagtgaaacgtcgatgtgaatctactcgaggaacatcgcgaacgagttgccgtccgagcagccaattaccaacaggccctccgccgttaccacgagaagcgcatccgagcacgcatgcttacgatcggcgactacttcctccgacgggttcaaagccaagcagggcgaaacaagctctcacccaaatgggaaggatcttacacgatcacacaagtcttgcgaccaggcgcatttaaaattgcagacggtgatggtcgcgagttggcaaattcttggaacattgaccaactacgtaaattctatgtatgagtcaatgtcatccatacctgtaagacaccttacagcatcaataaagcctattcttaggaccatattacaatcaaagtgttcctgtccgatgatcccttacccagatgacacctaacgttgaaatctatcctcatgtccctttacgccgtcttgacaaggcctccgaggaacctaagggatcttcggctggggacgcccagagccgataaggccttgtcagatcctgtagagacgaaagaccatgtaagacctggtcgtgtaagagttctcgccgtgcgtattaaccaagtcgtgtaatcggaaattaactttccaacttcacggctgggggctaggatcagtgcttattcaaccaaggcaggtcaaaggtccaagagccttatcctctgagaaaactcctccggtgacaaggctgggggctagggagagtgtacgactcaaacaaccgactaaagtcgtgaactgaggacacactcttacacacgatatccggagtaagaaatattttctaaagatagatttcttttctatttcacaaaatactccttacaattcttacacaagtctaaggctatattacactttcccctaagatatctatcacagggtacaaaggctaccaggaaggccaacgccagtccacagattagaagaccttctccgccaatggcgccatcgacttcaccaggtggtctatctctgccagagtcctccgagaacgagcaaaaccttcatggagaaaatcgatgtccagtcgcgggcgatgatctcataggcaggccaacacgtgccccccggcatatcggctcgatcgacgacactcctacttcaaggcttcgtcaatgcgcttgccgacgccctcgagctaagcataggccccgttcagccacgagatgtatctggccgccgactcctcgggatccccacgaggtactcggagctctctacagaccttggccatggacgtgcagcaactcttcaagtacgagttgaaccacacctcacgacctcggagcgtttccacagcttgctccttctttactgctagcattgttctctcaagttccgctacttcaaatttcgtcttccaatattggatacgacgatcttgcccagcaagagcactctcgagatatgctcaatgtgggaataactaagtcaagcttcacttctctttcaagaacacgactgatctaatcggaggagcaaaaagggataaagggaccactaacctaaggaagtcgtcgccatctctatccccgtgggtaggatctggtctacattgtccggcgacgcatgtggttcaaacgcaagagccggaatgatcgccaatgactcaggctgcccacgctgctggacatcctcgtcatcaacatctctacaagggacaaaaagtactcaagatcaaaatgcaagagaaagctagggtaatgactacacgcacaaaggcgatcgaaacccatcgaagttttacatagcacatctaaggagtacaagagatcctactcttcaaaaagggggagaacagattcccccaggtcgccgacttcttccatcacctccttacgcgtgccgctagccgccccctgatccaagatctcgcgcagatcgagtttaggatgcgccagcctcacacacgcaaggacatggcacgcctcggtgtagatcccgttggacgtctcctctccgatcctggccgcatgcttggagggaatctcctccatcgccgccgcgagctccgctagagaagatgtcagcgagaactcatcgggattcgccgggatggtagacttgatgccgcactacccggcgagctggtgcagaccagtataggtgacccgcaacgagccacggatttccgacaaattgttcccgagctttgacatgcggtgctcgagcccctgccattgtcgctcgttgccagccaccaactccctcatcttcttgaggtcttcacgagcttccgccaactcgtatgccagccggtcggcacgctcgtttgccgacgctgccgccgaccttgcctccgcaatctcgcgaccaatgccgcgagcaccagcttcgaggagacaccacatttcgacctggagctcctcccaggtgaggacgacagccggtggaccacgaccagccgcgggatcgctggctgggccgcttggtgtcacctcgcggctcccgggcgcaagcacgacatccgtcgaggctacagcgggagacgcaccggaagtccctccagactcatcctgcaccgccttcgcccgcgccgccctatgagacagctatggttcagacaacgctcggacaaaatcacgaaaacttaaattcacccactaacttctcgccaagtgtcacaagtcgctgttgacgtggaggtgggggagacgcgtccgaggccttgagaacagttgatgcgaagtaaggcgaaattgttctggctgtttgatcagacaacaagatagcttaccgagggggctgatgccttgcgacgatgtccgcttacagaggagaacttcctcccctttgctggaacattgccaccacttgtggtagcagcagcagcagcatcagacgcctccttggcgaccttctctttcaatgatgccaccacctgatggtccgcgagcggcccgatgatgtcagtcagaggaagagcctacgctttataaagtcacaaagcgatctcagaagaaaaacgcagaatgactactgagtacacttacattgatggcggcatcgcgttcggccgcccccttctcgcaaaggggaacgggaacattactcgccgtcgccgggccactgatcatcacctggccgacacgacgtcccacggcttcgttgctcagacctgtgaatcgagaaccaaatttcgatgagccaggaggagcgcgcacacaagcatatcaggataaatgcgagaaagataccccgaggagaaacccgggtcgcatcctccggtccagaatagtcaaaggctaggtgggcttgagcctggagtggctggattcgtctactaatgaagtcaacagcgacttcataccccgacaaaccacgcactcggagatcgtcgaccacatcgatgaacgactgaagagaaggggtcaaagggggttttgcggtccaagacgaaatcttgtctggttgttcctcaggaacaacgaagacaggatccgaatcttctatctgaagatagaacacctcgtctgccatttgctgcgagaggagggacactggaaggggatataacgcgattttaggccatcccgaagtcggaatccaacgcatccagataccctgttggattccatccaacgcaactcgtagtagaagcggaagagatcgagaaagggctctaccccaatgtaggcttcacaaagatgtgaaaaatactaaggctatagaattggggttcagatggagcaaagaaagaccatagaagtttaaaaccaagagaagaaattcagaaggtgtagggagagaaccgcagagaatgtagtcctcgatcacaaccatgcgacctaagatgggctggggttcagtacctcctgcttccctttccatggttccacgacccggaagggcgccgtcctcttgaagcttcttcagcgacacgctagtggaggatgatttgccgagatccatcgccgatcggagatcgccggagaaagggctgaggtcgacgaactagggtttcttgtgggagcggggaagacgaagaacgcttgcaggcgggaggttttcttctcaataggcgggcttcaaaatggatcccccaaaattcctttaaatagacgcactaccgacggtgcgaattccaaggaaaggagagagatagccgccggaaatttctgggtccgttacgcgcggcagtattttggacttcagtttaaattcactcgtgaccgttgggcttcacatggtgttctcgattacgtcctgtctccacggttctcgcaccgggaacaacaatagcctcgacacgagaagtcgcgaatggttacacgagttcatttaagcagaagtcgggggctactgtcagggttacgggttaggtataccctttaccctttgatatacgtcacatatcggtatggcatgcccacgcgcatacggatactctctacatacactaaggaaatccttcacggagtttacggacgaaaagagtcctactcggacaagactgggtcgtcaatgtatcgtgtagggtctgatgtctccgagttctacttggaaaccgcctgacctgcgatataaaagggacccccctggggaggacataaggcatcgaatcttagagccaacacaacccccacagcctacgaagtcgaagcctgcaggagccaaatcgtcgaggatctagtcgaaccaactcgactacgatctcgccggatccatcgagttccattgttccctttgtaacctgtgttttccatcatataatcccacatcaactggattagggctattacctatcaaggggcctgaaccagtataatcttcgtcttttgtt

SEQ ID NO: 30097 - DNA, 11046 bp, Oryza sativa
atgagtaaagactcttgttaggttgcatgcctagaagaagtagggatgtgaaaattagagtttaatcctattaaacatagtggattgtaggttgcatttagacgtttttttgataattctgtcttttcgatatattcggttaaccgaggatactaaccgaattgaccgaacaaaattcggtctttcactgcctaggaccgaattgatgaccgaatttctcggtctcgatcttttcggtctcggtctcggtcttttcagttcggtcttttggttcggtctttttctgcccatccctactcgtcggatcataatctgatgactttcgtggttgggaagtgccagaagtgacatttgaaaacaatttgtgtcaattataagatgtattttaattttaaatttccacctttgtagattttaatgatgaattagtcagataacaagtatatttatacattttttcattttattgattattagtgtgggtgtgggcacgagggagcgagggggagctttctaagaaattataatgtgcctattgcaaaattatcgcccttgaaaggtaggatagaaaaaacacacaagaattaaagttgtattttttaaaaaagtctatagtaaccaaaaacaccggaaatgagaagagaagaaattaactacaccacaggataattttttttctaaaaaaaatcaaaaggtcttatctcttgctttttttttggaatgtaatcctgtggaattagtccgtagaaatgcaattctatggaatatttacaatttctatatgaactaaaggggtctatagaaaaaaaaattagaaaattgaatcctctaaatattctaaaagtttctatgcagacaacataaaacatatattgtatacttggttcgttcagtccataaggtcgcatgctccatacattatgtaggactcatggaagttaaagagtggctgttttcaagacttgatcgtgttgttgactcaataatctccaacgcatagcttgaacattgttagttgtataaatattataccaatagatttacagtgtgcttttacacagcattagtactgctgtcatgaaaagtatgttttctgataaatccatggtcaaaagtttttctagctctagaaattcatggagttggggctgctgctagagtagagttattaaaatgtgacatttaattcatatcttagatcaaataaaagattgaaccattttaattcaatctacaaactctaatttctgcaagcctgcaagaattaatccaggagtttggccatgccaaacaagaatgaactttgttgtgttgtatagtgttaatttgtaaattgtattatgactacaaaagcattgtacagacggtatatatccaagtcactattacatataaaagcattgcaatatataaatgcttttttttttacaggcgatcgggcccatgcctttatttttacatgtctttagtcacagatgacatgatcggtcacctgttaaaacgtgttttggccgcctacgacaaccctatcgtagtagtaagagtataaaaggaattaagcgtatgcgaataatttctgtgcttttttttttatgacgggaatggtcctgaactcctgatccataagttttgagatgcatacaaacaaccatattactccaccacgcaagctgtcatctatggacaaatggtgaatacgtatgtatcttgatctcgtggaggttgagtcgacgtgacacttaccttgttcaatagttgatccatggtgtcgaattcacggcaccttctctttttcacattgtgacacaattttttcttttacaaaataactttatttattttctacccagaccacacataccaatataagtgaaaaaaatagaataccctctattttatcaaatccaatataattgtatcccattttatctagtccaatataattgcttttgaaagatgagttaatttaggataaataagatggtacaaaataaagttatttcggagagagagggagaagtaacctaatgcagatcctagctggagtaacattttttcttaactcctgaatgaagtagtgaatttgaagtagtgaatttttttctacctggcttactaggcgacggccggagatcgctgtctcctggcagattgaacttaattgcttggaggcaatgccgtcgagataagattttaacatgagccgcaggccggcatatatatagctgtgattatctacctgaccggcctgactctttcctactgtttctatcctgtatccacagatcgatataggtcgttttcagttcagctcatggcctagcttatcactataaacatcggtatcgtgttgccggcctagcaagtgtataattaatagtagtataagagttagtttggagcttatgattttttgaaacacagcataggaaaaacgtaatattcaagtgtatttggtacctcaaattttataaatgaaaaacaaagaaaagtattataaatgatcattaaaaaaataccactcttaactcgttactcatagctacaagctagaatactatacatgatcaaattgctttagcctccttccccatcttctctcccaactccaatgtcatatttccctctataaataccatcggcaagccactgaccgtcccgcctcctcaccttcctcctttaagttgcctcggagttggggacttggggcatgccggtcgctgtgtcggagttggaggagcctgactgccgcgccaaggctcaagaatgtcgcggcgatgtgggagtcgaaagaggccaccgttgtctgctcatccctccatcctgctgttgctcatgctccccaaccacgacggtggtgtgccgccacgtgcctctcctgctgcttgtgggcgcggaagaagtgttagagtttatatcgaatatgtgtacgtagtcggttacagtttaggacttggagttgtaaaaggtattaggactagagtatgagtcggactctatcctaggatccctcatagatagaggagcgtgcctgttataaccgcatggtgacttagcataaagagagggagcggttgtcggcatcgaccggccgtaagtcgttgtaactctgatacgctgtatatgctggatcggggaggagcgcccgtaatcagtgccccgaagatgtaggccacggctgaactccgttaccaaatatcgtgtctcggtgtcgtcatcgttttggatctcctatggcattttcttccgcgtttagctaccgatgtcgatttcggggctggttttataacaagtggtatcagagcctgcgggaggtccatggtagaggcgcgatggaggtgctccacaccgcgtagcctgctgtaatgcccagggaggggcattggcgcaaggtggagcacggcggcgatcaacggagtcttgatcggtggatcgaacacttctggcggcggccggaaccgtcgatggctgccttcaacaaggagatgactagacgtggtgctcgggttgatggcggcagaagcgattggcgatccaatcgatgggtcggacacttcgggcgggtggctcggactttccggtgagctactctcgacagggagacgtgcggccgcacgctcgggttgattgaagctggaggcgatcggcgttctcgatcggtggattcgaacactctgggcggggtggcccgggcctttcgaagagttgcgttcgacagggagatggctagacgtagcgctcgggtcgttcggcggctgggaagacggcatgcgacttgtcggcttcggctcgcgactagattgatggcgttcaatcggatgtcggagcgggtggatcctataggctgttttggaggtgttgacaggtattttcacactggaattgctttaaaagccgcgtattagcggtggatggcagaactaagcgtagggcgtctagactagcatatgtgctagttccaaccctagagaggtctggttctactgtttctagcacagatcaagaaaatcacgatgacaacagatcagtggcactagtcattggtgtagtcggcaagtggtgtttggcagtggtgctaggttccgctggagatacgaagaagcccaggaggtcagggtcgcggcggtgtgcgcgttttgcgtcgaagccgagctggcggcggagatcagggtgatgccgagaaggagcgggctgagccaggacgtgcaaggttcggtggttgtcggattcgtgatgtagaggaagactcggccatggagttatctatgtgtcggtcacggcatggacacgaccgaagacaagctggatggataccgcgttcgacacaggagggagttggatacggattcgatttagactggaaatcggacacgtttttccccaataaaagcagcaaagggaccacgggattgttacaacgcagtcgaaacaaatcatctagcagagggcgagattcgtacccgattttcgcagaggcaaaggtggtttgggcggcgaggtcacgggcggctggagacgcatcattgcaggcggcgcacggcggcgtggtactcggcggcgttcgtcgcagctcgggcaggagcttgcggcgccggcggcggcggttcccggcgaggaaccggcgccggacttcggtggcgggcgctcctaggtggtaggccggcggcttcccaaggcaggcgacgcggcggctcctcgcagggtcggcgcaagtgacggcggcggaaggcggcggcgccccaggcggtttctgaggcgggcggcgcagtgcttcttgcagggccgacggcgtgaggagcaggaggcggcggcgcatcgggaaaaagtggcgtgggcacggtttctaggaggagcgaggaagccaaaggaagaaggggaacagggtcgatctgtttttctttgactggtggttgaccaagtaaaagaaaccggtccggttttttggagagagaaaaaaaactggttcggtccagctggtactattcgagttagtcggtgggatcaattaatcagggcagatcaatttaacagggcaacagctgttgagttgattatcgttgatggcggcgacggtggtttccaaatttgaggtggtgaagttcgatggcaccgggaatttcgttctctggcagatgaggctgaaggatctgttggctcaacaggggatatccaaggctcttgaggagacgatgccggaaaagatggatgctggcaagtgggaggagatgaaggcgcaggcagctgcaacaatacgcttgagtctctcggattctgtcatgtatcaggtcatggatgaaaaatcactgaaggaaatttgggacaagttggcaagcctgtatatgtccaagtcgctgatgagtaagttgtatctcaaacaacagctatatggtttacagatgcaagaggagtcagatcttaggaagcacgtggacgtcttcaatcagttggttgtggatctaagtaagttagatgtgaaactggatgatgaagacaaggccataattcttctgtgctcgcttccaccgtcttatgaacatgtggtgactaccctgacgcacggcaaggatactgtcaaaactgatgagataatttcgtcgttgcttgcacgagacttgagaagatcaaagaaaaacgaggcaatggaggcttctcaggctgagagtttgctggtcagggcaaagcatgatcatgaagcgggggtgtcaaagagcaaggagaagagggcacggtgctataagtgtcatgagtttggacatataaggaggaattgcctgttactgaagaagaggaaaggtggcattgcaagtttagcagctcgtggtgatgattcagatagcagcagtcatgagattctcacagtgtctaacgagaagtctggagaagcgtggatgttggacttagctagttcctatcatgtgacatcgaagcgggagtggttctcttcatacaaatctggtgattttggtgttgtttacttaggcgatgacacgagttatcgtgttgttggagtgggcgatgtcaagttcaagatgtatgatggaaacgaggtgctactttcaaatgtgagacacgtgccgggactaaggaagagtttgatttcgcttgggagcctacatgagacgggttggttgtatcaggtggattctaataggaagaccatgaatatcatgaaggacggcaagactgttatgactggtgagaggacaagttcatgtttgtacaagttacaagggagtgctgttgcaggtggagtcatggaagatgggtatgctggtgttgttgtgcacgatcctgaaggcggcaagcctggcgtaggctagtcgagcggctcggtgtgagctgcggcagaaccaactcaagtcctggtacacggaggttcgagcaagtaacagattcaagttggtgtggcatattcgccaaggtagagtttgttagagtttgcgtcgaatatgtgtacgtagtcggttaaagtttaggacttggagttgtaaaagatattaggactagagtatgagtcggactctatcctaggatccctcataaatagaggggcgtgcctattgtaaccgcatggagacttagtatagcgagagggagcggctgccggcatcgaccggccgtgagtcattgtaactatgatacgctgtatatgctggatcggggaggagcgcccgtaatcagtgctccggagatgtaggctacggctgaactccgttaccaaatatcgtgtctcggtgtcgtcatcgttttgaatctcctatagtattttcttccgcgtttagctaccaatgtcgatttcggggctgattttataacaagaagtgagatgtcgccacgggacaggagcgcgatggtgtagacgtggctggactagctgtcggtgaggaggtgggagccgtgttgcgccatgaccgcgtggggacaggcagcgaccgcgtgggcgcccgcaacaggaggatggagcaggcacccgtgatatatatacgtgggatgcgacgacgaaaggcccgcaaccgtcaccgtggcaggccacgaggatgagttcgtcgtcaccatacagttctaaatggagtagtattataacgtctagccacacgttaaaaagtgatattttatcaaaatccatctgcacagtggctttcgagcgatactcacttgtgacaataaaacaatgtcaggcccttcacagtgggaggacgtggccagttccttcagatttccagctcggataatcatctacacgttgacaaaacgcgtgcctctgctcagatgctcgggccttagttgggaagcgagttccttcgcctgcaggcaaggacgcgcggcgcaggagacgtctcacgcgtccgcgttactgagagcgtgcccccgcatatgtttccttcgcctcgcgtgcggcagatattctagccatcaaaaagagatcacgagcgttgtggactgcatggcttatgcgttgctgtacagatgactttggactgatttcactgtacggatgagctaaagccacgttatgcgttgcttgcactggtactgccctcagatttgagacaagggatgaaaggaatattcaaattggcggcttaaaggcctctcacagtgctccatgctggaccggtgctatgggcagccacgtaggaattgggcttgcgtggagctagggcgtgcgcccatggtgagcacctcgcacccaaactgaggcacgcggtaccttctctcgcgaggcccggtagcggctgcttttccgcactgtggagctcgtgccctcgcgcctcccgtgcccttgcgccggcaactaatctacacaaatcgcggcaacaaaagcggcaacaaatcgggcggcgcggtcgacggcgaggcgaggcgcacgacggcggcatccccgacgtgccgccgcagcatgggaggcgagaaggtgcgacggcgtgggaggaaccgctggccgcaagcaccatcgtctcagccttctggatccaccgccgcgtccccaacctccttcgccgcgtccccagcctacttcgctgccgccgccgtgaggagaggggagaggagaggccaccggcggggagaagggagaagccgccggcggggagaggggagaggagaggccaccggcggggagaaaggagaagccgccggcggggagaggggaaatgcagtgtcgtcgaggagaggaggggacagccggtggagttggaagagggtgaggggcgtggtgactgagggaggtgggggattcggtgaagtagtatctgtgggtcccacaccggtgcttgccctgtagagaaagtttccttgtagctttttatcctatgtgtcatcctggtgggtgcttgcactgtgaaggcctcgtaatctggaggttgcacatggccacatggatagatcgaagagggaaattttgctccctttattgaactgtttgtagatgatatggcaacatctaaaatttaatgagatctccaattaaatttgctgttacgtcgactaatcaacatactgattgcgtcaacgccacaccaaatgacaaagctattatctgggaatataaaaaaacaacaataatccagccgttgagttcgccatcgccggcggccgccggcggaatcacctgctcgagcacaccgcctgcgtcacggccccggacgcgaacgcccggagattcctctccgacgacccgccggccgcgaccgcctccgcggcgcgctccctccatcgctccgcccgtgcccggacaccgccgtctccgccgcccgccatggcgagctccacgcaccgctgcagctcgccgcgctcgaccacgccctcgccgtccagccgcgcgcgcacgccggcgcccatgcgcgcctcgaccagccacgccaccgtcggctggtccgtccactgcggcacggccaccatcggcacgccgcgggtgatgctctccagcgccgagttccacccgcagtgcgtcacgaagcagcccacagccgggtgcgagagcaccttcatctggtcgcaccactccaccaccatcccttgcgcgtccccttcgccgccgccgccgccggcatcggcggcgggggtgggtgcgctgtccaaggtcgcgccgccatcgacggcgccctggcgcgccacccacaggtacggccggccggtggcctcaaggccgcgcctcatctcctcctcctgccgcttgctcatcgacaggagggtcccgaacgagacgtacaccacggagcgcgccggcttcgtgtccagccaatccacgcacgcgctcgcgtcgtctcgccggaacatgtccgtgctcgagctcgacagagacgcttcgccgtcgggcaccaccggcccgacggcgacgacctccagatcgggcacggcgcggagcgcgtcgggctccagcgcgtcgaacgtgttcaccagcaccctgggcttgagctcgtcgagatcctcgaacaggtcgcgcagcatggcgagcagcaggtagtgcttgtgctccggcgagacgatggacacggcggaggggagctcgtcggacctgaggaacggcatcccggggaggcgcacgacggcgccgcgggcagggtcgttcgcgcaggaggcgagggcctcgccatggccatggaagtagtggtagtacacggcgaacgccgccgccggctggatccagtagatcgccgaggggatccccagcgcgcgcgccacggcgggggcccaaaccacgaggaacgtgtacacgatgcacgtcaccgggcgccccctcgccgcgagagccgcgacgatggcggagagcgactcggtgcccgcggcgcgggtgcgcgccatgtagtcgtccctcgcgtgcaccccgggcttgtacccgtcgtcgtagccgtcggagtgcgggacgtacgcgacgccggtgtcgtcgacgtcctcgccggccggggacggcagggacgggaacatgaggcggtgcgcggagacggcggtggagaaggtgacgcgcgcggccggcgccgacgccatcaggcgcgcggcgaggcggcgcgccgggttgatgtggccctgtatcccgctcaccacgaagaggaagtgcggcgccggaggagggctcttctccattgccattgggatttctgatcagagcagctttgcaaagcaactgatactagcaagggctacctcaatttatatggtttggaaatggaaatggctgaatattaattgctcttgctgatgataaatccgaagctcctttgaaccctttcttttttgcctggcttttggctaaggatcgcctcccaacaaaacgcaacttgcacaggaaaaccatagtgccgaccccaacctgtgatctttgcaattctgccgatgaaacagctcttcacctctgcttccagtgcccctttgctgtggccttctggggcacgctgaatatgcaggttaatgacgcgacgttagctgagcttgcttctcttcccacaccgattcgagttccctccaagcactttttgggtattctacttgcaatgcttttggaacccgtggaatcaccaccactgggttgtcttcaggcacgaagcccctctttgcgtcgattattagtgctgtgtattgaagatgcgtccctctggagcgaaagactcaaattagaggatcggcatgtaatttcgtcctggaagaccttttttcttgagtaaagtgcacgggtggtccttaaacttgtagcggtgtgtcatataggttctaaactcttaaaatgcatatccaagtcccagaattttttatagtgtgtcatctagatcccaaatcgccacaaccccttcaggatcctacgtggcgttgatgtggcatgccacacggaatgacgtggcatcattttgactgaaaaatgggtcccatttaaaatttttcctttttcttttttcttctattttttccctttcttctcctttctctgtgactcgagcagaagaaaggaaaaaacgaagaatgagaagaaaacgaagaaaaagaaaataagaaaaaaaaagaaaatgacacgtcacgtccatgtggcatgtcatatcagcgccacatagtgat

SEQ ID NO: 30098 - DNA, 2596 bp, Oryza sativa
cccccccccccccccacccccagtgaatttttttttataaaaagagagtaaatttcataaaactccatctattatggtccaaatttcatggaataaagttattttggcacgtgacatataaccctaagtgttatgttcgtaaagtttcaggaaaccatgccattaaccaaattgtggcacactctcaaagaaaattaaaaagttttacttacattgatataacatttatattatggataaacaacttacaaatttgagacgtgattgtagaacttaagagtttgatagatcaaattcaaaaagatcactagtgtggtttcgtgaaattttatagtaataatatctgaggttatatgtcatgtctcgaaacccctgaggttatatgtcatgtctcgaaacccctgtgattttactgcaatttagaccacaatacctgggttaggtgaattgagtttaaaaaaagatcctcattcctggtgtgttttgttaattcagttcttttgagttttgatcagtcacaatatgcttttgagggtttttttaatccgttgcctagtcgccgttaagcactgctgggctgtcagatttttgggccaattcgtcctttatcatcagttctccaaccatgatggccgacatccactgctcagtaagcacaatgtcgtactccttgtggagtactcattacataaaaaacaaatctagtaccggatataatatattctagtacgatgaatctaggtagatgtatatccagatttatagtattagaatgtgttatatccggtactaggttggttttttatgggatggagtgagtactccctcaaatctagaactagatgtgatatgttatagtacaatgaatctaaacagaggtgtctagattcatagtactaagttgtgtatttatattattaggttggtttttttatggtacggagagagtacttcactacgaagaaagccaccatgcggagtagtggagccttcatgtaatcatgtagcgtatttgaacttcgaactgaatcctctttggattactagtcgacagcaactacaaaactaatactaccacagaagtaaaatcttagagatacaaatatttttttggccggctagctaataagaaatggagcagttttggccggctagctattaagaagtggaggtcatactcttaatacttcatccgtttcacagtgtaagttattctaacattttatacattcataatgatgttaatgaatcatactagaatatggatatgggaaatactagaatgacttacattgtgaaacggagagagtagttactaatacagagcaatcggcaatcacaatgtagtgtagatttgtttccccatcaaaattgtagtcctctctaagttgaactcacattgtaacataaggattattgtgtatatccagtggattttcctacgtaatcttacatagagttgtgtttatttcacgtcaaaatttaaaatttggttgaaattgtaacgatgtgacggaaaagttagaagtttgtgtgtaggaaagttttgatgtgatggaaaagttagaagtttgaagaaaaactttgaaactaaacagagccctagatgtaaaattggatttgatatatcactgttagcttttgttttgcaatagattttaaaatccaaattggattccatatataaccgtcatcctctatctcaatagatagagttgtaatatacaatagattttaaaaataaaattggtttttttacaacatacgtataaactagacctaccacgatataacaatacaaaaatttcatttttcttttattattaatgcagtaattcccaagtttttagaacgggcgtggtcgccgtggtggcacatttttaactatcttaataatttaatagataatacataaataaaaacagacaaacataacctcaaagcatggcgcgcataaagcgacctgctaggaaggcagctatcctccagagcaaaacctgatacttctgcttaaacagccaaatccgtacagtagttttctccacaagttatcgtagtgtgactgtatgaagtatcagactatcagtggcagaaacataattatcgttttgataattagcgattcctttagggagagaacaaaaatacagggcgccatacaattctactactcagtgcaatacaattcattgcatcttcttcctgacttcctgtagaacagaaactaccagcatttttttagctattaccatacatctcagttttttatcgatgtaaaacttctcctgaatcagtaatgggctgcaataattatctcccatataacccaacaacaaacatgtccaatcgaagctacaaattggaatgagctaaaatattaaactcattccttgtggtctctgaccttctttctcttccatttgagaaagatttgtaaagagagaccagaaaagaccatcacaacacttccccattgcttcaaggagagtgggttaccactgatgacggaggagatgacaatgctcatgaacttgcgggtggtggtgatggtagtgttagtaagagagccaaatcggctgatggttaggaagatgaa

SEQ ID NO: 30099 - DNA, 8203 bp, Oryza sativa
  unsure (1)..(8203): unsure at all n locations
tgtaaggaacaaaacatattcttttctactttcatactacggagtgaaacagtgccaaaatgtttctgcttttgctttaggctcgtgggatattggtgaataattgaaatagattaaatctttaccttcaacaacgcaaaggatgatacacccccagcaacaagaaaggtgcaaatgtactccggaaatgtgtacttgacaccatacagtatagttcccatcagcattactgtacatattaaatcattggtcagagatatgcgcacatcactatacagactatgaaacatgaaagggctactgttaaaagttattcttaacactgattgctctattacctacaccactctgaccaccaaatatcagcactaatggaaatgctcttgtcatgaaattgatatggttttgacaaaaaaaatgcaagtattgtcgtactaacagctaaagcagccaatattgtggtgccaaaccaaaatccaattttccagtgtacttttttttttacacagaaactgctcagatgagtatacccacccaagctcaaattaatgatcagaagaactattcagatgtagataatgttctgtaaggtacattacatagcatgcatagatcaatgcaactcacctggaatcatcttagaagattttgccaggacctgttaacatagagcaaataattccttagcggtaatgtgctatttaatcaaatcagcatatattattacggcacaaaaatgagacacaaaaatgatattcagaaaacacaggcttgttgcgactgttccaataagttcaaaagataaatcaaattacattgcgcttgagccaaacacattttgatgtataactgtacattggatggttcaaagttcaatcaaaaagtttgatgaggaaatatggttctgtcttcacccatccatgcgatacagcgataagagtatcatggataatcatattttggcatttgtgcataatactcatggcataaatgttttctacgtataaaaattgctaataaacaaatgatctaaacattgtttatatgttcagatatttctgaatcagcccataagccgtctgacttggtcagaccgaaccaaattcaaaactccaagtatatcagaaccagagagtctgaattcgtaatttcactcaaccaaacttaattttcttctccaataatcactcacacatcataaattctccaaatgaccgtatctatcgcatcaatcaaggcaaaaataaggctatagaacattccaaccactgatttacttagcacagttgaacaatccaaaaatagaacattccacttcgcaggcattatactactgcgttgcctatcacccataacgaaaatggaaacatctaattacagatacaatagctgcacaaaaatgcatagagcaacaaagcaagcgaagcgagacgacaaaagggcagctgcaaccaaacctgagctgggtagctgatgaacttgagcgcctcgatccccatggccgggccgacagtgttggtgatgctgacgccccagtactttcgcagcggcgcgcggccagcggaggagctcccaccactcgaccacagcttgatcactgcgcgagcaaaaccagtgtcacaaactcctcacacgatccgcattctgcgcaatggcatgcgatgcgaccgcactggattccacacgacaggggcaggggatgagagagggaggagaggaggctcacttatgaaggaccagacgaagcagacgacgttctgcgcgaagttgaggaacgcgaggtggtcgaaccgccgcgcctccggcccgaaccgcttcgtcgacctgaacgaacggcggggagagaaaacggcgaacaattttcagaaactcgccgaagcagagcccaattcccctccgctcccgagccccattagagagagagagagagagaggaaggaagggagggaggcgggcgcttacagggtttcctggaggacgccctgggtgatgtacgccgaccagatcccggcgacgcagaatgcgagcacggccacgcgcgacaccatgctccctccgccgccgtcgacgacgcgggggcggggagggcctctgcctccgcggcccttgcgcgcggtgaccatggcgcggttcggttcggtcggtgcgccgccggcgaggggggagggagatcggtgccgcggggaggaaggcggaggcgcgtgttatagaagcgggggcgcaactggggagaaggagaaggggtcgcgcgcgtcagaggggtgacgtggcgtgatgcgattggggagatgtgccacgggagacagcttattggttgggttggcgtgccgcgtggcgggggaagggaagggaaagagatccgagcgtgctgtttccgtttggtgtttcatgggccgttctcttttggattaagtccaatttgactcccttaactagtggatgagtctaattcatatccctgaactacaacaccggatatcataaccctctaactattaaaaccggtgcaatttagctctcttgacggttttgcagagcgatttcgctgatgtggcgcctacgtgacggtgttgaactggtctttatacaacgtggtgttgacgtgtcacttatgtagcattagaattaaaaaaatatatgggtcctatttgtcattcacacaaaaaaaattgtgggatccaccgccatgtaggtccacatgacatgtgccaaccactgcgcgggccatggccgtgccaacgacgggctactcctctcgccgacctccatggacctcatcgccaacacctcctcctccactccgtcgtccctgacctatcgttgccatccccgaccacctcctctctgccctcgatccctcctccctactcaacaccttcgcctcttacccggtcctctcccccttcgacttctcctccgctacgctcttcttgggcctcgccgcatcccgcatcgagcaaattcaaagaggttatccgcctcctccacctagggatgacaattttacccatgggtccaggtatccacagatacccgacccgatgggcatgggtgtgagtgtgactttttacccatgggtacgcccacccgatacccgaagacgtcatgggcaacaggcgggtttcattttttacccatgggtaacccatgcccgacccgatacatatgtattagctaattttgactcatttcttaattcttataccctttctattggttcatttgtaatgctaactgatactaagttgtgatgtaattcaaattattgttggtaaccaataatttcgtaaattattgattttatttttctttcttaaattatatatattttaagttattatttatatgagatccattgggtacccgccggacatacccgcgcccaccgggcatgggtacgggcacggagttttgcacgctaactctagtgggtagggtttggacaggcaatattaggcatcaggtcgggcatggttttgctctacccgtgcccgacccgacccattgccatccctacctccaccgacacctccttgccgaggagctccgccgccacccgctcctcccattcgacgccaccgctccgggcctcggcgacggcggcgtgcaggcgaggggagctgggacttgggttgtgctttatcaggccggcctaaggcacgacggcccgacatgctagaaagcacggtctgacacggcccgtaaatgggctaggccgtacttgggctggcacggcacgcgaatggcccgtaggcacgatgatggcccgatggcccatggcacgatattggcccatcaggaatggctgctagcctgctagggcgcatgcgcatcgggccatcagcagaaaatctgagtggcactacagctccggaccccggcagcaagacgctcagacctccgaaaatgcttaggatcatatgttcgacgcaaccaataaaaaccggacggataaactactacctccctattcactccacaaatacatacatgttgtaatggtcttcaaaataatttttctcatgaactacttatccaatctacgatatgatcacaccattatatttgttataattaaatctttataacaaggtatcacatcattacattccgatgaaaaaaaaacatatgtttcaatccgttaaatttaatgtttcagatgcggtagcaatatgtttcaacgtgtgtttttgttatgtttcataaaaaaaatttaaatatttcaacaactgattttttttcactatatataactcaatgtttcaacaattgattttttgtttcaccaatatataactcatgtccctactctctctctctcgccatctattggctttctcccacaccatgcatgaatcatgatgcaagtatttagtgatattaaaatatttttccttctaaactacttatccgatgaacgattcgatcacaccgttgaattcattataattaaatctttacaacaagatatcacatgattatattctgatgaaagaaaaatatatgttttgacaataaaagcttaatgcttcatacgtgatagttatatctttcaccatgtgttcttattgtgtttcacaaaatttcaatatgtttcataggctcatttttctgtttcaccacgtataatttaatgttgcaccaacggtcaactgaaacatttgaccgtccgatttttttttacatcggacgtctgatttatagctctctcctcgtacctcagaggatctcctgcaaggatgcgatggtgtccggcgattcccttccgcattggcgcaatgaatggaggcggccggccgaagagacacagccgtggcgccgcgcagacgcagtcaagtgacgccgcccggccgaatggacgcaattagtactggggatggggacgccggacgggcaaaccgacacattctggcatctaccactggacaaacgctcgacctagtattatggactaggtagtagatgcgtgtgtgcctgtgattcccntgcagccttgctctgctgctcntgcgccctgcctttgcctgccgcattgtggcatgccatcgccattcgccgtaagcgtttgctattatggcnccaatttcatattttgtatgtggtcacatgcacgctgtagctgataatacatgtttgcatgttgctgttttaacttgtgcagatgtgcacgtgcagccgcggagaaaaggcgcctgccttggattgagatggagatgggacgcctggcaccagagaatatgggcatggctaatggtgattggatgtgcctccgtggagcctgcaggcagcacgtgtattgtgtggtgtgtcatgtgtgtgtaagtgcaacgagaaataactagctcatgagggcaatttgttctataaattcctcctcctcctcttcttcccaacacaaaaaaatgcagcacaaaataaacagagcaacatagttatttccctcccacagcaaaaatgtggggtgatactcgtcggaggtcgacctcgtcgagacccccgcaaagacgccgccaatgctcgcctagtcttgaccataggtcggtcgatgcccaccaactatccccgggtatggacgactacaggatggatgaccgccatatggatggtttggagggagatggggatgatcctacggaacagcccatccctaaggccaacgatgacacagtcttgcccatgccgggaagcgaggccgagccatccgcaccatctacagagagagcggagtgttggcggcacttcgaaaaaatcagggtaatggtggactacaacattgtggaaaaactttgtctgcatcttctagttcaggaacaggacatctcaaacggtattatttgacgcacctcaaggataaagcaccggcaggagcaaggcaaacacagctgagcttcggacccgacggttctgtaagtacatggacttatgagccacaactagctcgagatgaaattgctcgttacatagtttcggaggacctaccgattaggatgggcgaaaggaaaaattttgagaggatgatccgaaatgctttttgtccacagtacacccaggtttcaaggaaaaccaccaagaactttattgtttcattatatcgttctaggttggatgagttgaaacgcttgttcagtattgttagcttttcttttgttgtgacatctgacatttagacatccaagcaccaaagaacctcttctgttagtgttgttgtgcattatcttgacaataatcgcacactaaataagagggttatagggttttaaatgatgtcgtcacatactagacgagccattgctgccacactactagatatactacaagaattcaatttacaatctagggtggtttctattactcttgacaatgcatcagcaaatacaatgggcatgacgattttggagccaaatctgcaaagctacattggaggttatgttatccatcaaagatgcatttgccacatcatcaacttgattgtgcaagcaggtattactagtcgttgagaatttattgaaattcattttttagtgcaaataatttatcaattttaatgcatatgtgacaaggaatttattatctatgtaggatttactgttattaccaatttacacaacaagatccgtcaagctgtttctatcatcgagggtcagtcagtgatgaaggagagattccgggactattgtcgagcaaaggataaacctgtgaggatgtttggcattgatgtgaaacatcggtggaacacaacatacctcatgctgcgtcaattgaaagggtatgaggaaataatttctgttttcattaattcattgcactttagaagtaatgataccgatgaggatggtgattgtgagattttgcttcttactgaggaagaatgggacatagcaacatgtctatgtatattcctaaagcctttttataaagctatagtcctactatctaggatttactatcctacttcttgtttggtgcttgaatgtctttggaaatcgtcccttatatttcaagaaaaccgacatgatagagttttagcttctgctgttcaaccaatgaaggaaaatttctcaaatacttcactactattccacacctgtatggttttgctttggtacttgatcctcgtaaaaagttggaggtcgtggaggctgctttcatatcaataggtgatgcagtgggtcttgattattctgaagcttatcaacatgctagagatgagttgttcagggttttccgtatgtaccaaactaagctaagtgttgttcgttgggtgcctgaggaaaccccacaaaaaaagtaaagcaaatcaagtgcaatgaatttgtggaagaagatcaagggcaaggaacaagcttcctcatcaggtagcaggtcaaattggaacccagatgcggagcttaaccattacctcaacaccaatcgcacagaacatgatcgaacactagatggtgaaaatgttgatctgtttgagtggtggaaagagaaagaaaggactcttcctgtgctagctcactttgcacgggacgttctattggttctggcttcctgtgtctcttcagagcatgcattagtgaggttggaagaattatcgaagaatggaggtcatgccttgcacctgacatagttgaggcaatcttttgccttaaagacttgattgaagcatatgcaaggacgcaacaccggctagaggatccagagattgccgatgcagcggcagacgcgttggcggaatttggcatatccactgattgcggcggtgctaatcaaaattagtaatgtaatttatgtaataatgtaagcaagttgttatactatttttcttaccggggaaccctactctagggtgtaaggtttttaacgaagcaacaactttgcatccctattctgaataaatttgttttccctcaatttttacatctcaggttatttgcattcggtgtgagaacaaaaatacaatacatatttttagacgaggtaataaagtattgcagagccatctgggcgaaaaaaaagaagagtgtgaccatattgttttccctactcccaaaaattccctcctcttttcagatttccatcccaaaatttccctcctctatttcatattacaggctgctacagcagtgcagcatgaggtcattagccatcgctaaaggtgcaagcggctacccacaaaacccacttataaactaaactaacccgcgaacttgtttat

SEQ ID NO: 30100 - DNA, 1588 bp, Oryza sativa
gggttgtcggccccttccgtcccgacggcgccggcgacagcgctggacatcgtggaggcacaactccgcgcgcttccgctcggcgggcgcggcgacggcgctggacgtcgtggacgaagacgacgaccccaaggtgcggctggcgcgcgtggagtggaagctgaggctggacggggcgacgaacgagctggaggacctcgtgggggagatggaggagcccgtcgaggcggagaagaaggcgcggtgctgggcgccgtggcggcagcggtgcagggggccggcgaaggtggtggccgggtggctgcggtccgaccctaggatcaaggtcaggttggagcttgacgtgggaaggctcacagtcaccggcgtgtacgtccaaggcggagagctcttggttcttggatgatgtgactagcgacggtgaaggaatagctgcattccagtgaagcgatggctgcgctcgacgccaaccggtcgccatgacaaccaaaacaaccgaaccgagggttacccgacgacgacggacgcgtcgtcctcgccgtcgccgctcgccacggaagtgactatgctagcgaggagaacttagatgacatgtaagtagcgaaattaatttcgcatcgcagagcatatgcatcgtaatttcgtcgctcgctgactcgcttgccatgcattgtaattaaccaaaccttaaactcttgtttgcatgggcctcaaatcaatcccgaattatccagcccggaatgagggccatcccgagaggatgacacgtgggtcccacacatatttattttaaaaggaaaaagtacgaattaccccacgaacaatcgcggtcgtccaaattatccccctgaaccacaaaaccggatattcttcacccccaactatgcaaaccggacgaattacccccctcgaaccaattcagagtagttttgtccaacgtggcgcacatgtggcaatccagtcagcatttttgtaataaaaaattgtgggacccgcctgccatactcttcttcctctctctctattctctctctcgctcttttctctcgcggctcgcgcagcgcgcacgacgaggacggcgcggggacgggcggtcagtgtgggcggtcggcgacggcggaggcagcgagcgcggcggaggaggcagcgagcacggggaagcgaggcggcggggcagggtagcggtggcggaggaggcgagcggcggcggggtgcggcgaaggaggcagcggcagcggcgaggcgagcacggcggcggaggcggcgaggcgagcgcggcggcggagccagcgagcgcggggaggcgagcgacggggcagggcggcgaggcagggcattggagaaggcgagcggcagcgggagctcgcattgctggaggcgagtcgacggcggtggggtgcggcgaaggaggcgagcgcggcagcagaggaggcgatcgtggcagcggagaaggctaggcggcgcgcggacggggctcgaggcgacggcggcgacgggtgacgcacgacagcgcatggcgcgggcggggctccaggggagatggcgacggcacgcggcgcgagcgacgacgacaggcgacacgattggt

SEQ ID NO: 30101 - DNA, 2666 bp, Oryza sativa
agaaaagagcgagcgagagagagaatagagagagagagaaagaagagtatggcaggcgggtcccataatttttttattaccaaaacgttgactggattgctacgtgtgcgtcacgttggacaaaaccactctgaattggttcgaggggggtaattcgtccggtttgtatagttaggggtgaagaatgtccggttttgtggttcggggggtaattcggacgaccgttattgttcagtggtgtaattcatagtttttccattttaaaattctaatgccacgcggaacaaagaccatgtcaaaaccgccacgtagacgccacgtcatcgaaaccgccctttaaaaccgtaaagagagtcaaattgtaccggttttaatagttggtggtcgagatatccggtattgtggtttaggatacgaatcagaaataatccgtccgcatccgcactggcttcgaatccacttagaaaatatagtatagaatatcgtatgacaactatccatccgaatctgatctgttttcatccctctagacttctatcttgtttttatttccacgtccgccactgattgactataaagcgaaccaacctgatttgtgcccagtgaccatatgctgatgcaggctataaactttctgcggttcattcacggaatttccaaaccttcctgatgaagcatctcttggtgggggagcacgaatcgcaaagcactacttcctccgtcccataaaaaactaatctagtatcagatatgacacatcctagtattacgaatctaaatatacatatgttcagatttattatattagaatatgtcacattcggtgataggttcgttttttaaaggacggagggagtagaggagtaaccgcgcaagtttcctgggcttggtgggccggtcgccaacagtttgtttgaacccagtatcctttccgtggcaaccaagttcccgtgagcccatcctcagccacccgattcccccatacaactcaaatcaacggcccaaaaacaacggaaccacccctcccggaaccttccagaacaccctatagcctcttgaaccttcccgaatcccacctttctataaatccctccaccttctccgacctcctcatcgtcaaaatcacatacacaagaagagcgtggaagagagggaggagaggggagagagcaatgccgacggggaggttgagcggcaacatcacgcaggactgggagccggtggtgctgcggcggacgaagccgaaggcggcggaccttaagtcgacgagggcggtgaaccaggcgatgcggacgggggcgccggtggagacggtgcggaaggcggcagcgggcacgaacaaggcggcggcgggggcggcggcgcccgcgcggaagctggacgagtcgacggagccggcggggctggggcgcgtgggcgcggaggtgcgcggcgcgatccagaaggcccgggtggcgaaggggtggagccaggcggagctcgccaagcgcatcaacgagcgggcgcaggtggtgcaggagtacgagagcggcaaggccgtccccgtccaggccgtgctcgccaagatggagcgcgcgctcgaggtcaagctccgcggcaaggcggtcggcgcgccggccgcgcccgccggcgccaagtgaatccttcgtggccggaatcgcacctccgatccctcctagttaggcgttgatccgtttgtgaatgtgcagtttgtttgtgttcttggcttaattttggggggaaactatgatatgctaactggctcagacgcatgtgaagtgatgatggctagaaattgaatttccgttggatttgtgaacacatagtttagttgaagcgcttttcgatccggttgtgttcaatcgtcgttgtgctctgcttctagttgtgactagctttgttctctgctcatatttcattgattgatccaagtgattcttcctgggaatcgcaagttcgcaactccgggcctccctaagttcctagttataggcgttgatccgcgttgtgaatgtacagttcgtttgtgttcttggcttggtttggggaaaccatgaatccatgatgctaactaggcgtatgtgaagtaatttctaatagaaattaaatttaccggccgaatcgttgtgctctgcttcttgtgtgttgtgcggtgcctagcttgttccctgttcatgtctcatcgacagctcaggttgctgctacctgtccggagctttggcggtccgtaaaattgatcgagtcactaactcggtgggttcaattaaccaatgtttattcgttcatttttctcggcttgaaacggatgaactccagaagagcatttttcggcttacatatttgtaacaggcttcacggctgagtttttatcttcacttttccaaccaacatctctcgtttttaaactgctaaacgatataatttttttaaaaaaattctatataaaaattattttaaaaatcatattaatcaatcgattttttaaatttattttaaaatatttaattaataatacctaaatgttgttttgttttgcatgctaggaagtgaggttttcatccctcactttcgaacagagccttaaagtatgttgattacagccactggtggatcgctgctctcgcaataggccttgtcacttaattctgccaaattatggactagtt

SEQ ID NO: 30102 - DNA, 1881 bp, Oryza sativa
tcaaaaaaggaggagaacaccaactggcatatacaaggaaaataatggataatgcaacttattgactctctgtaataatcttccaccgttacaaatactccaccacccagcaaatccaacaacaccaacatgtgtacatacgcatggccgactcgatcggcgacgagatccagaaagaactcagaaccagggggagccatggacgggggtgacgacggacttgacggcgaggaacttgtcgagcgcgtgcatgctgtcgtccttgccgaacccgctcatcttgcggccaccgaacgggcagctcctgtccatggcgaagtagcagttcacccacaccacccctgcccggatcgacctcgccatccggttcgccacgtcgatgtccctcgtcaccagccccgccgccagcccgtacctcgtcccgttcgccctctcgatcgcctcctccaccgtcctgcacccaaaattaatctctcttaccactatagtagtttcttagataataaacattttgaattgatatgacatatcatggtcagatcctctgcgatcgaaatcacgtaactttgtcacttacatgtggatccgatgatccctggatccacaagttagtgataaaggtaccgtgtatttgactagagaggatggcgatccatatatatagctgggtttacttgaacttcatcaggcacatgacggggccgaagatctcctccctcgcgatgaccatgtcgtcctgtcgttcagaatcgcaagcgaatcatcagagataagactgtgaagacacatggtgtgttcgtggtaaattctaaaggttaatttattttttatctttaccttcacattggtgaaaatggtgggctcgatgtagtaccctttcttaccgcagggcttccctcccgtgagaacagttgccccttctgccttgccttgctcgatgtacccgagcaccctctcatactgagccttgtccacctgtatgaacatagtagcagggcaacacagtacggtgatcagtctctggttcagatagttaatcaggcctgaatcatcactgaattattggaactcacaagaaaaaaaatgctcgttggatggatgatgattcagatttttcggaatttaatttcagactcactcacctgtggtccttgattgacgcgaggatcgaaggggtcgccgacgacccagctcttcatggtgtccgctagcttctgctcgaaccggtcgtagatgccctcctgcacgaacacgcggctcccggcgacgcaggcttctccctgcagattgatcagatcacggctatggctctcatcagtcaattcaatcaagatcacggcaatgcatggcgctctgccaattcggatgctcaccttgttgaagaagttcccgccgatggcgagctcgacggccttgtccaggtcggcgtcgtcgaagacgatgaacggcgacttgccgccgagctcgagtgccaccggcttcaggttgctcttcgcggaggcctccattataagccgtccaacctcagtagatcccgtgaaagccacctgcaaaaaaaaaaaaagttgtaagaaaccgatcaatgttcatgtgctaattgacagctgaatgtatgatatcttaccacgtcaacatccatgtgagatgaaattgcagctcccgctgttgggccgaatcctgtcaccacgttgatcaccccatccggtactcctgcctgaatatcacattccgaaaaggtcagagatattcagagttttagactaccagcaatcacacagcacaaaatgcctgatgcaagaacagagctactactatatcgtttttcttttttcaattttgcgtcctgttctaaattgaagattggattagctactttcttga

SEQ ID NO: 30103 - DNA, 2279 bp, Oryza sativa
ctactttcttgattttcattagcacgttttccaaactatcaaatgttatgttttgtatgaaaattttctatataaaaggtactttaaaaaaataaataaatttatttgtcaattttctataattaataattagttaatgttaatcacatttctcgtttgtgtgactaatcttacttgcttattttttttttaaaaaaaattcttacttgctttgataggtgggcgaagaacagggcgctgaggggcgtctgctcggcgggcttgacgacgacggtgcagccggcgccgagcgccggtgagactttggagaagaacatgatggccgggaagttccaggggacgatgaggccggcgacgccgaggggctcgcggagggtgtaaccctggagctgcctcgacatcttgagcgtctcgccgtggatcttgtcggcggcgccggcgaagtagcgcaggatgccgacgcactcgccgacgtccaccgccctggcggcggcgagcggcttgccggcgtcaaggctctccagtgccgccagctcatccgcgtgccgctccaccacctccgcgtacttcgccatgaccctccctctctcctgcatttgacaaatgcgccattgatcggtcactttccagccattttttgcacgattgagaggaagaagaagatgaccgtactgatcccgacatgcgaggccattcgccgtggtcgaatgcttccctcgccgccttcaccgccaggtcgacgtcctccttgtcgccttcggcgacgcgggcgatcacgtcgccggtgcgggggtccctggtctcgaacgtcttacctggagaagaagcacggagcacggcgaccttccatgatcaggatgagattatgtaaagataaaattaagtgaaaatttcagtaaacctcacatttcatggttaaagttatataaaatcctaggtatcataaccttgatgaagagagttagttttagtttatgactctcatcaagagcaagaagtctttaattttagattggactgctatagaatttgacccatcgtacaaaaagtttctgatgataagaatcatactttcatggaactccataggggcatagggctataggcttcaacacggtagatgttttgttctgaattattctgagcaaacttacgacccaacgatacaatggttttttttctattcacaaagaaaataatttggaaatcgcaatgcttctatacgcttccagaggtgacacataaccgaactactattgttttaaagtttttcaaaacaccacctctatatatatttagtaaatatttacttaaaattgtaaaatgtagaatatatgtggaatttttagttgttgatttttttattaaggttttcggtttaactcttcgctactttgtaaaatattatcttagatatgttaaagtcaattgaaatattgtcttggattttgttagcatgcttttacatttcattaaaaaactttctatataaaatttactctacaaatatcaaataaatatattttttaaatttataataactaaatttaattaattatattctaatgacttcttgattttctgtgcactaacttcaccttaatgaggcaaaccccgaatttgatttttcttcagagcacgaaacgtgtataaaagtacacaagaaaataggatctctagtacggaagcatttatcttcttctgaaaattcagaaatgttccaaatctgaaacgtgctactgctagagccacatatgggcagtcccaatccataacactagacatggtttccataaactccacatcatcaagaaactagtgctagacactactcttccaatgcaaacaccactattccatactttaatttaatgctatttatctcacatgatgtcttagatgttgtgtagaaactatgtctcatacaagacatggttttcttctctttcctcatttattcacttgccacatcattttttgtcctaggtgacaacttatttaatgctatgaacactatcctagtcattgggttgggaatgccctaatgatttgatttgaatagttctttactacttagtactattagtacggagtactagctaatcattgagcaaaaaaaagatgtgagatgaaaacagcaactagccggggacgcgaagcacatggtataacacgggacgatgggaaaaatagatgccagagcttggtagagactgaaactgcaggcccgatcatgcttctttgtcgtgttactccttggcgaactgcccatgatctca

SEQ ID NO: 30104 - DNA, 3862 bp, Oryza sativa
catatccaatagttttcagaatgagggagtatggcttatgaaatatagcaatatagtgaattgtttttttcataggcaacacatacagagaccaatcatattgagaacagtgtatgtatatggtttcatatagataaaacccatttcatctttttcatattatttttttcatatttaatgagaatggattttttagtgggagtggcctaagaattaatctaaactggctggtactaattaattatggagagaatcattaagagcaagtttaatagtacagcccactgctagctccaattcatctatatatagtcaatctaacagtcaattcatacaatagttgcttacgatactataaatatttggtcccacatgtcatacacatactgtgtcttggagtccgtgctgcagctggctacagatctgtagtccgctgctcttctctgttatcttttatctcattaaaatatatttatagctcactaatagtttgctattgtacttgctctaagaaacagcactgattgcgataaggaattgaatccctactagtatttggaagaaaggaaataaatcgaagagagcaataggacaaccacggcgattatgaattggatcccattactaggttttggtagagtacaattaagtcctccagtaattaacgcaggtgggctggacgtagctagataaccacagcccacggctagctagcgcgcggctaacacacacgtacgtacgtaccggaggccgcgtcgacgaagcgcccgttgatgaacagcttggtgtacctgatctccggcgtcgtcctgggcgtccccccgccgtcgtcgccgccgtggaggcaccccgcgccgctgttctccgcgcgcgcctcgtcgccggcgtggtggtggccgttgctctcgctctcgctcgccatggcgcgcggcggtgtggctcgatcggtctctctctccgcgcgctgctttgctgttgcgtcgctaagcgagaagcgtagtcctactgtggggggggggggggggggggtgatttgggcgaggcgatacgccgatttaaagagaagcgtgcgccctgccctggccaggtgctagttgggctagccgtccttcaaatttgacagttttttttcccattcacagatttgactggtctagctgactagctagtcctttaaatttatcttaaattatagatgattttataatctgaagatgatcatttattgcccatgtacccacccctccctcccatttcaagcgcaaacatgagttgtcaaattttaattgtacgtcttattttattttttttgaaaaatagtacttttaatgttttatcatctgataataataaaaatactaatcataaaattttttaaataagacagatgattaaagttagacaaggaaactcataactacgtttaatatgggacggagggagtatactttatgagtctattaggttgatgttattttaaatctttttggtaaaattgagaaatacgtggatacatttaatttattcccaaacattggtaatgcctagataattttggtaacaatacatctatcctatcctattaaaatttgataatattaccaactcaccaaaactttggcattaccaaaattctagaaatgtttattttggtaataatttgagccagccttatatctcgcttatccactcttttatagtttattcctccacctacctatttttactttacttaatcctcacctatcatctattattcccattcgttctaaaataaacaaacatatcacacccctgtattaggtttgtttattcggatgaaaggagtaatacattattttatctcctatcatcatttttcatcacttgtacttttgctatctccttaataatcattaaaaaagggaaattattctatttgagacgagggagtatttccatcaccttactttactccaagacggcaaggcctgacaggcacccgcacatgggaaacaaacggacgagtcaaggagtgtactcatgtagtgtggtcgcgcactcacgtgattacctgaagaacttgcaaggattgggatctggtctctttttcaattcatcatcgatatgtatatatagagaagggttaattggatccatgccacgcgaattgtggcaaatcaaaaaaaaaaatgctacacctattccggaatccgggtgcaggccacaactgtttcgtcaaattggaaccatgccataatgtacgccctgcgcgcgctttgccaccgttttagggtaccgtattttcgtatggacgtttctgccctcgtgttcacgtgtgcttagaccagctccggtccggctcgaacaacccggtcgccattcgttccccacaccgaaaccctagcttcttggaggcggcgcaggcgacggcgccggcgcaatcgacggcggcggagcaggcttcggtgccggagcagggcggtggcgcaagcgaaggcggcggcggagcagggcggcagcggagcagggcggcggcggaggctacgacggccgaaggggaggacctccaccgatgggaggatgagtgcgcaggggcctacgcctgcatcccccaccgcgttggcaatgtatttgggcgaatcccttgtacgggttgcttccaaaccgtgagtaccttcccccatgaactctttatgcagataaaattacgatttgagtttcgatttgaactttgtatgtgcgatttgagttattgttttgtcattcgttggtaggcattggttttcagtcgatgttagggtgcaaccctatgcgacagtagatgctgatggtaggaaaatcatcagtaaaggaggcactgggcattgggtaatcgattcagagagtttttcgtttgatttcctaatggaaagtttgagggttgagtttaagtggggctcgaaccagtctccctcagtgtggtattttaacaaaaatttgggtgaggatgttaggctcataggggacactgatttgccagatattttcgagatgtatgcaaccgaggccagtttccacttacttgtagcagttcttgaggaaagcatggatgttgcttctgtgtgttgtgtgcatgagcccattgctatcatcccacctgagaacccttcccacaatgatggttctagacaagctgctactaatgatggttctgcacagcctacaacagtggaagcagatgttagagagcctgacatgtttgataattaggaagaatatgttggtgttaatgatgagcagttgtatctgcctccaaaacctactcagccacctgacacctctagccaatcctctcagcctgctgccacagggtttgtgtcacgaccggaattaacccaacgggcgttccttacgtgcatgtattattccttgtcccaggaggcaaggtacaccaaaagttgatacatttcagagtttatcaagcggagcgtaaatagttaatttattacatgggcggcgaaggcccagcacacacaaagacaaacgggaaagaggggaagactagggcgacgaccacaggcgcttgacggcaggcacgagctagacaccaaagccttcatcttctaggaactccacttctgggtttgggaaaaattgagcaagactgagtacaaccaccgtactcaacaagacacacccacaagtgcagaataaatgcaagggagtacaagggggtttgcagtaaacagcattaaaagacacttagttgctcaaagctattttgtaaacacgattctagagctatgcaatattattaatcaaggccgtgaacccacacgaacctgccttaacccaaggcctacgatgattcagaccgaactggcaacccgaccctgggtcc

SEQ ID NO: 30105 - DNA, 6941 bp, Oryza sativa
  unsure (1)..(6941): unsure at all n locations
tcagaagtgtacatctttacccacaagacacatcttcctcacgtgtaaccatgtgccacataccaccacggtgtacggacagaagacgtgacatagtttccacccatcctagccatagacaagagtaccgacccaaccccacctacggtcggaacccccgggacaggtaggcaggactgagcctctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtagaagtacggtagtgctttgcaacagaggcccgaagaccggtccttatatggccgaggtgctactatcaaaaccatgcacccgagcctagcctaaaaccattttgagggttttgaatagagggggaggtgcaaatccaattccacaataatccaaccattccatagtgtccaggtgatgagaatattcccaaagtctagagttataaaaccacctaatgttgcctaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtttacacgaccaacggaaaagaaaaggattttactctaataaactccatataacaagcaggaacaaagcacaaaaatgggttcttgacttcttcaggaaaaattagagacttgaatggtccaattccgagttcaaatggccaagttatggccatttgaagtttatatgctctttaaatgaatatttgcgaatttcttcatttaaattttaattttaaaagggtttattgcgtcagccgaggggaggggactcgcggaccgggtccacgggagtggggcccacgcggtagcctcacggtccacggtggaccgggtgcacccgggctcacaccggacggtgccgtgggccccacgcgttagccgcaaccgagggcgcgggcggctgacggtcgggccccacgcggcagccactcggcgcgcccgagggcggccaagccggcgcagcaggcgggaggcggcgcccgcgcccctatggtcgccggcggcggccataggcacggcggagcggcgcccgagagaggggaagggaagggggaaaagaggcggcggtccacggctcaccctaggtcgacggcgacgacgaaaaaggcggcgggagcggaggaaggcggcggcgcggctcgggtcgacggggtcgacggcgttccggcggtcggtgagcgaaacgaaggggtggacgaggtcggcgaggatgcggcgaagccgaaggaggcggcgctgaggtgggaggtggtccggggcgacgacggcggcggaccggagctcgtcggcgacggcggagagagagagcgacggcgggagctcgattccggcgaggaggaagggcggcgagaggcggaaacggacggaggaggtacggggagggtttaaatagagccggggcgagagagggcggccggggaaggaaggaaaccggcgcgggaggtcggccgccatcaatggcgccggcgagatttgcgggggcaagtccgcccgtttgaactcgatagagagagagggaaaaatggggggaaagggagagggaatcacggggaataaatccccctattgattgcacgcggggacgacgggatgcggcggattcggcggcgccggtggcgctagggcgcgggcgagcggcatgagcggcgggaggaaggggatgacgggtgggccccacccgtcagcgagggtggcgggcgggcctgcccgtcagcggcgcgcgcggggagagaccgagtgggccgcggggagaggagagagagggggagggagatgggccgagccggcccaagagggggagggagggaaagggaccctttagggtttttctttttataaacccattttaactttgtttatttcttaataattattatttgtgctctgaaaattccactaaaatttatttacgcattttaggcttttaggaaatatacaaaaatcctccaagccttatttgacttttaactttgcacattttaatttttggaggctttcacacggattttaattattctaggcataatttagaggatgtattttagagtcgttttgggacgtgacagtttggtggccaatcctctcagcctgctgccataggggttagtggtcaatcctctcagactgctgccacaggggttgaagctcctgaggtagaagtcactgatgaagctcaggttgttagagtgttgcatgatccagagaatccaaatatagtgaagaatgctctattccctgacatgatatcttttagaaaagcagttaggcattatgcaattaagaaaggttttgagtttgctgatttgaagacagataaaacaagattcattgcaacctgtcgcgctgaaggctgtccatggagaatacgtgcttccctaatccatgataagaaaacaattaaggtataaatgtattattttagttaatttattttttcatctcctgaaagtagtgttagttttagtaactttttatcaccatgtcatgtcatgcagattacagttcttccctttgaacacaaatatgcatctaccaaactaagagagggcaagatggctacacagggctgggttgctgataggcttggtgattggttgaagaacaatccaaagaagggtgctaaggatgcaagagggaagctgcaagaacagtatgagatcaagttgaagtattcaaaggcatggtcaggtatgaagttagcactagaacaggtacatggtaaatatgaggaaagttttcagttgcttttcaactggaaggctgaaattgagaggaagtgtccaggtagtatagttgaaattgaattggagaagttaggaaataaaatgtgcttcaagcgtttgtttgtagctctaaaaccatgtatagatggctttttgcaagggtgtaggccatatgtgggtgtagactcaactaagttgactagaaaatacactggacagttagcttcagccacctctgtagatggtcacaactggcttttttatgtatcatatgcaatttttgatttggaaactaataacaactggttgtggtttatgaaacaattgaatagagctattggttgtcctgaagggttagttatctcaaccgatgcatgcaaggggttagaaaaggctgttagtgctgcatttagtgatcatgttgagcatagagaatgcattaggcacctctatgctaacttcctaaagaagtaccatggttctgttatcactgagcatttgtatccagctgctaggagctacactgaggagggtttcaagtaccatatgcagcaaatatatgcagtgaaaccagatgcaatagagtttcttgagcaacatcattcaagaatttggtacagatgtggctttggagaaagcagcaaatgtgactatctgacaaacaatgtttctgagtgctttaatgctcagatcagaaatctgaaaggactgcttcctcatgaacttgttgacagcatacgagagttaataatggagaagatggccactagaagagatgttggcaagaaaatggatgatggaatcattccaggtgttatgaagcagcttaatgatgccacatctcttcttaaagtggtgaagattaccagaagtgatgatgggtttgcagaggtcacacttgtggatactgacaacaagactagaaggcatattgttgacctagacaaccaaaaatgctcctgtagggcttggcaaataacagggaagccatgcaggcatgcattggcctggatatgcagcagtggaggaaggatacaagattttgtgagcccatattatagtgtgcaaatgttcaggacagcttatgcaggcagagtaccacctatgactgataggacacagtggccagtagttgatttgggcttcaaggtgcatgtccctaagcagaagagaggtgctgggaggcctagagtacagagaataaggggatttcttgagcctggaagaaagagagtgaaatgcaagagatgtaaaagatttggacattttgagaaaacatgcaagctagctgaacctgtagatgcagatgatatgagcagccactgcaccccccaaaaacggtatattgctgtcattgtgcttccattcttaattagtctttgtgcaagcgggttgtgttctttaactccaacttgataaaaaaaacccaacttgataattattgttagttacactcctgatatattgtgctatgttgtagtcactaagattcaggcttgtatgcttgccatatggtctaaaaattctcacttttttgtaggaagagacaagtgtgcaggcaaggaaatgatccaggagtgtcaacaagtgaagcaagctgctcttgcaccaaagaagaaaaaaacacctaggaaaaaaaagacaccaaaaaagaagaagactccccagaagaggaaagacctagcatcctcaagtgcaccaccaactagagtagttaggagcctatctacctatcttctactgtaatgccagctgcctcctctctaagtattttgctaattgccaatggctgtgatgaacttgtaatgcacgtgtgcctgtgaacttgtagtaacctatttgcagtgacaatgtagcctgccccatctcttaagtattttgctagtaaggctgctatgaaccagtaatgttgctcatgtatgtctatactgttgtatgcatatgttgagcctgaaaactgaaattatggaatgcatcaatgatctcttttgctgaaaatttactgtactcatgtgctctctccttttgtaaagatttctgtgctgtaaactgaaattatggaatgcaccaatgatctctttgctgaaaatttgtgatggacaattgtctgcatggcactgattctatacaggaatctgacaatttttcccagcaatctgcaaattttatggttctattattgtaacaattcactactttcttctcaaacatacactttcattcatattgttcagcactgcacatacacatactttcttctgaaacatactctttcattcatataggtcaccacagtacatacacatgacaatacatccatatttccaatccaaaatacacttgttgacaatacatccatttttttcccatctaatttctacctaccattaagcaagcaaataagacagtgatcactaaggtaaggtatagaagtctagcacggctaaatttaacttcttccaactgcttcttcatcgctaaacactccagcctacactggttgagtgtctcaattgttgacttcaactcattttcctttgcatcaaggacctcacaaatcttcgctttttcattcttctcatcatctaaatattggcgaagaatgtcgattgtttcttgcatatgatcgtactcgccggcgtgacagtacgcaaccatctcctcagcatactcattcagcaggtcttcccatatccataagaagcaacagccctaagcaaacacctaagaattaagacaccgaaatgaaaccaacgaaactaagcaagttcttaccgaattgccgcattgtagccaccagcgtcgaggattccttggtgtgttcgaaatctgcacagtggcggaggcaccgcaagcacacttcagcgtggggatggaagaaggtgattccatcatcgccttgccgtcgcgccaggaaggaggtgattccatcgtcgccttgccgtcgcgccaggtcgtactcgccgccggtcgcctgcgccgtcgctaggagctccggcgccaccgccttcggccggcgtagcctccgccgcncgcctgctccgccgtcgccttcacctgcgccgccgccctgctccgccgccgaagcctgcgccgccgtctgcgacgccgccctccgtcgccgtagcctgcgccgccgccctgctccgccgccttccgccgccatcgattgcgccggcgccatcgcctgcgccgcctccaagaagctagggtttcggtgtggggaacgaatggcgaccgggctgttcgagccggaccggagctggtctaagcacacgtgaacacgagggcataaacgtccatacgaaaatacggtaccctaaaacggtggcaaagcacgcgcagggcgtacattgtggcatggttccaatttgacgaaatagtagtggcatgcacccggattccggaataggtgtgtcatttttttatttgccacaattcgcgtggcatagatccaattaaccctatagagaaagatcctccaatccgtttaattttataacctgctttgtttatacgtgatttggtttgacattcatcgatctttgccaataaacccgtatcatatttgatcacagaaaaaaaaaacttgtcgcgtttggcgattttgacgagctttggtataattttaacatcgtcaccgttgcctgccctccaacctttgcagccacctgacagctcagtatagctttgcatatgaccccacttagctctatgcatgccccatacatggcttggcacatccgtgttattgttgtctcatcttctttttctatatatccagcctagcttgacaagtttttgccttgttctgtcctcgtactctggtt

SEQ ID NO: 30106 - DNA, 1167 bp, Oryza sativa
tttttggcaatagcgcgatgatcccaaagtttaggttataaagggataatgtccctttatgaaattctctaaatagagccatgagatcattcttaacaatctcccaaaagacctgataaaactctgcaggaaagccatctggacctatggaggagttatgatccatttgaaaaattgcctctttgacttccttttctgaaaattcagcagtaaggatgtcattttccaagtcggacacttgaggaatatcatcagtccatccctctatcatggatacatgattatgatctggaggaccaaataatcctttataataataggtgatgtattctttgagattcccctcacccgttattatagcgaactcttgctccaactggaaaatcatctgcttacgacgatgaccattgtctatcaagtgataatatttactattactatccccttggagaaaatgatttgtcttagatcgctggtaccaatacaactcttcgtcccttaacagttttgccaaatcatttttgacctgcttcaacgaagagttatgtgtttggcttttttgtctagtgtgttaattaaaactaaaagctttattttttgttttttatatgtgccacttaaacttcgcgcccaccctcttaaatgttgcctaaggtggacaatcttgtgtttccaacgttccataggattccttcccttgtttatgctttgccactctttggctaccatctcaaagaatccatcccgctctagccagcctaattcaaaacgaaatggcggctgattgccaaaatgtgcatgcgatccggatctcagtataattggagagtggtctgaaatggctcgaggtaaggcttgacacgtaactaaaggatatttttgctcccagtcagtgttcattaacactctatccaacttctcataagttgtattttcgaggttcttggcccaggtgaattgtctccccgaaagataatctctctcaaattgagactattgatgaccgcattaaaaagaaaaggccaacgagggtcaaaagaattattattcttttcttcggtgatctaatgatattaaagtccccccctaccaatagagggtatgactccttaccacaagtctgagctagttccgtcaaaaattattcttttaactcgggttgagcag

SEQ ID NO: 30107 - DNA, 506 bp, Oryza sativa
acaattcatcattgcttttatctacattactagtagacgctacagcactactataaagagtagcaaatctatccacttctgaaattttaatctggttaatggactcctttatttctaaatcattctttcctagagaaacccctaatttagaaaaatttgcagcaagagtcttatctggaattgaagcaacagaatttgtggtattaaacttgttacctgttagcgtctcgaggttatgaacctttttaagcagctctgcccggtttgccaccggcgcatctgcatttgccatcgccttctgtctttcactttgcctagttggaatagggtccactgggcgacgaggtcgccttcttgtcggggatcgagctccaactgcctgtgctgcatcggtgggctttagatgtggcagcactggaggcactaaggtggtcttcattggttgctagtgctgccgtcaaattgttagtcgatgttactcttccatcgcctgcaagctggctatt

SEQ ID NO: 30108 - DNA, 6494 bp, Oryza sativa
ttctttctccgtcctggtcaatatcatcaatcttcttctttcctttcccatccacctcaggcaattccggttcaaagaagatttcatagccatggtttcggacaacaacgtaaacactaggtggtaaatctgctaactcatcaactgccacctgcatcctaaccacaccatttttcctgagataaatcatgtccacagttgttgtttgaccaatgacagaaccaacagcatgtagactgagaaagtctctaatctcatatgacactccataaactttaaaccaagttttctttagaacaaacttcgcttcaatctcttgctcccacttgtcaatgactaggttcacattaaagtcaaaactaggaacactgccaaccctacgcaacctgtctaattcgatcacagagggaaattgaaccatataagtgtctggagcagtctccttaacatcccattggaacctaaccggcaccaaccttcgcaattcaatgatcaagttgtccacagaaatgtggccattctccacccggataattgctgttttgttgtgttccctgggtttcactgcccctgttgttggcgtggggatcatgaaaaagcctccaccatcaactccccatccacacatgcttgctgtgggtttgggagcgagtaaaagcgggcatgaaagtgcagtatgttcaggtgcttcacaaatatcacacaaaatctttgtgcactctgaaacagcatggctcttctccttgcatctgaaacaacgcccttttgacgcctttgaagaagtgccagcctctgcagtcactatgtcaaccctagactctcctcttggaacatcagtacctgatgctggtgctgcattcagattcacagcgaactgaccatccggacctctgttactgtctccgccacggccttgatgaccacggccggaagcaccaccactgccattcccggtagccgctccagacaaagccgtgttcccgggatgtcaacctctgccgcgaggccgccacggtcctctcccccgcggccgcccagcgccaccttctcccctgcctggattgaacacgccgccacggccgtcaccatcctggccatcgccgccgctgccggtaccacggccgccgccatatcgtcctccaccaccagccatctcacccgctcgcaccacttccgcaaaagatcgcttggggttgattggtcgacgctgtttacgagctagggcaagcagcgcctttggttgtcgcttgtagaggccatcgccagggcccttagactggagcccattaggcggctgggcccgcatgtttggtgtgatgcatggcccattcttttgctaatgttgtgccggtcttggagacttcgtttgacccctcgtttgaagaggaagcgctgatctcggctgctctgatccgctcggccgccgcggccggcgcaaaggacggtgcgacgccttggaaatcaggtcgccgattgtcaccggcggcgaacgtcgacgcggaggaagggcacccgtccacggagtctttccattttccgtcttacttgggctagttgatgcatgatggtgaacgccggacgacaacgcatccaaatgttgctgccgcccttgtcttgaacgtctggtcaccgtcgtccacccttcttcaagacctgcacccataggaaaactcatcttgtggttagggacggatggttgtaaatgaagcatctcatcctcagactcatcgtcgtcgatggaggcaacgtcagagatagcccagaatcggccgcaaacgccgccgcctcgcgctttgccagtaggtgtgccggttacagcttgcgtcgagccgacgatcgggcttgcacccgttgtcagcgtcacggagggatccaccgcgatcgcctcacaaacgcctaaccgctaaacccggaacaccctcacaacaaccctttgcagactgcttaggcaaataattttaatttagaatttagtagttgtgaaattttgaaattaccaactacatgctcggtatatagactcttgagaggctgcattcgtttgcacctgattaggaaaagaaatatctcgttctccacgtgtacactttcataactgctaagtgttgtgttatttacaaaaaatatctataggaaagttatttagatttaaataaggaaaaagtatgaattaccccccctaactatcacggtcgtccgaattacccccctaaccacaaaaccggactttcttcacccccaactatgcaaaccggacgaattacccccctcgacctaatccgcggtggttttggtttacgtggcagtagagtcagcaatttatttattaaaaaaataggtgggccccacctgtcagtttctatctctctctcctatctcatctctcactgtctcactctctctccctcttctccttcggacggcgacggccgaggcagcaagcgcggtggagtcagcagcggcgaggcgaggcaagccggcggcggcggtggagagcagcgggggcagaggagaggcgagcgcgacggggacggcggagaggcgagcgcggcgggggcgaaggaggcgaggcggcggagaggcgagcgtggctggggcggagaaggcgaggcagggcgggcgtggtgggggtggcggaggaggcgaggcagcagagtggcgagcgtggtggcgaggcgagaggcaggggcgaaggacgctaggcggcggcggtgaggcaggggccgcggaggaggcgagcggcggcggcctgcggcgaaggaggcgagcgcgtcctcccattcgcggacgcgggtcaacgggccggtcgtcggcggtggcagcagcgggaggaggtaggcgttcacggcgaatccccgcgacgttgtccccccgccaaccgactcgctgccgcgctttgctgccctccgcagtgacaggggggcacgggcgccgtcatgcccgccggccaccggtctgcttttcaccacgcccgtcacgcccgccgtctgttccgggcccaccaattcccgtcgtgccacccggcgtgcccgtctgctgtcccaagttcaccactccctgccgccgtgctcaccgcccgtccacgcgccgctgccgccgcccactggccttcgacacgtgcctgagagagagaaggggggagggggaagactgaagagaggtaatgacaggtgggccctatattttcttttgtttgttttgttgattggatttccatgtcgacgccacgtgtataccacgtaggagcaaaaccgcttagtattgagtgtgtgtgtgtggggggggggtaattcatccggtatcaatagtttgaggtgtaatatatccggttctgtggttcgaggggtaatttgtactgtcgcaatagttgggggagtaaaacataccttttcctttaaataattaacattcaattagtcatacaagcacgtatatataaaagacgtgttatacacgcactgaacactggcgatacacgcgaggcgatcgaccagccaaagtatacacaggcatggaaacgtgcgggccgtacgatcacccagctggtacttgaaagattgtacgtgtgcatgggcatatgcatatacgctggtggtcgatctaccgatgcacacgtgaacgtgcatggccatgctgctctgaccagcacggattggcatggattcatagaggaacaggtgtcaggctggttcgctggtgcatacgcttgtgtgaggcgatatgcatatatgccctttatgccaaaatataaaaaatattaggtgaatgtaacaaaactataaatttagacagactttcatataaattcgtatacgtagtattatgatgtgtcacatacacttaaaatcttttatattttagtacggagcgagtaatatacatgcatgcatggaacggttgcatgcacatgagagctagaaaattgctggatggatcacacactaccacagaacacgtgaaaagtggcggttgggaaaccccataggtgttggtttttccaaccggcaccatgaagatagcactgatgagtgctccggcactaatcccgttttaagaaccggcacctttgagattactcgcgagccaaaaaaagactcgagtatcgagctcattcatcccacatcacagaactcccaaatcaatcacaacccccaatccccaatcaaacaacatcacagaacaagaaacattgaagaacatcacagaaatctttcactaacattgaagaacatcaaaaaatcattcactaacattcacagaaatcattcactaacaggaagtgcgccgccactgccactcgttccgctgccaggccgccaccacctcccctcccgccgcttgccctccatccaaatccgacggagggagggcgccaccgtcggacagccactgcctttcatcccgccgccgggccaccactgcctctcgccagcaggtctccactgcctcccctcccgccgcctgccctccctctagatctaacagagggaaggcgccgttgctgggccgccaccacctcccgccgcatccccctcccttccaccgccgcatgccacctcccgccgttgccgccgctaggccgcccctccccggatctggcggaggggaggacgcgccgccgctgccgccttcgccggccatgggcagcgagagagagaggacaacgagagagaagggaggcagagagttgagagatgagggagagagagatgcaagatggctctggaagtctgtggatggattgaaccttatctcctcgtgatgccttatttcgtcattcgtggtggggcccactggctcggcttaagtcagaagtgtatttttttttaaaaaaaacacctataatatgttataggtgtcggtttttaacattaaaggttatgtttttttttttaaaaaatggcacctataaaataggtatcggttattatttagaactagcacctataattgcttaaaggggccaattttttaggatttcaacatgcgaaagtggaaaaaagcctacaggtgtctttttagcacttacagcgcatatagtgctgacacctatttgatattttgtagtattgacagtggccttcctacatttaatttcttggggtgaacgcgaaaattaaacccatataggctattcaattattaactatattaattaatatattaaataataagtatgtattatatcctcgataattttttttatgtgtgttcgccgccgcgtttcggagctggattatgagtgaggaatctctcaggtaaactcacaaatttgcataattaagtatccaactacaagacctttctcacgggcatcagcttctatctcatccggcctccataataaaattatgagtgaggaatctctcaggtaaactcacaaatttgcataattaagtacgttcccctgacattaggattatatatatacatcgtatactacttgtgagaataattagcatgccatattgctagctactacgcgtacgcgtatacaaagacgtacaggattcacatttctgacattctgaacgtgatacaccatgcaaatatagatgaatcctacctaacatacttggatagccatcaccaaccgtacgtgtgctgccgaacccacccaaattaaccaatttggacgagtatagtgtccagtggtaggtgacgtcctgacgggatggatcaaccacacgtacgtaaattacctcgaacgtggccggacatttacaaggcttagtaggtatatatatacttaaaagctcgaaaacgatcgagtttgggaaaggccacagatcaaggacagtatatatatatgaaccaagatatcatcaaacagtttaatagaaggctcgttcgtttgtgtttttgagaaaattctttaattacttgctcctgagtttttcttcatccttatgtaccgctaaattttgtctcaattctctacatgttttttaagtttttgttctatgtccattccgttacggttttgctagctagctgtcgacagttttggagccagaaacattcgattttatggccgttcgatctggcgccatgattcgtgtgagatttttttctattggatccaaacctgatgaccaatagatgtgctacccgttggcgtgtatagctgcatgttgcctttttccagaaatttcttggaggcgaggtggcctaggcggaggcggagaccccgccagatgcagctctcggcgattttttttgctgccggccggtgggtttctcgctgcccacttcctcgccgatttttccccttcagctgctcgtgttcctcgctgtcgcagcgatcttctctgcctcacgctctctactcaaaatttcatgtgattttttcactttttggtgcgttcatgtgatattttgtgttcagatcctgcatcatgtttgccctataaatcctttgtatgtttggttggtgttcttctcctagatttctaggggaaacgattcgttgattttcgcacgcatgtattgtt

SEQ ID NO: 30109 - DNA, 805 bp, Oryza sativa
tagttcatcatcatcatgttacgatggaccgaaatccaagcccatttatgtgttaacaaggcccaactatgctaaagttgtttcatatctggcccatcaacacgttgcagttatgggtcgtcattccacagtgggcttgtcacaacaaaactcgtaggaaaaagtccaatttgactcccttaaatataggcaaaatctaattcgtacccctcaactggaaaaccgggtaggacgactcccctaactattgtaaccggtgcaattggactccctcggcggtttcggagggcggttttgctgacgtggcaatgttgacccggttttcgtcccacgtggcgcttacatggcattagaattaaaaaaatatctgtgggtcccatctgtcattaaaaaaattatattgtgggacccactgacatgtggggcccacatgtcatcctctcttctctacctttttcatcctccccctctctttctcttcacgagagtgggacgagggccagcggcagcagcggtgaaggacgggcgggcgagggccggagcaggggccaaatcgtcggcggcggtggggacgggggccggagcggccgtggccggcgcacccacggcgctctggagcgcgtaccgaagcgacgccttcacgacatcatcttccttcccgtcaatctggaccacgccaagccaagccactgcgtcgtcgactttgcatcgtcctcctctccgtttccccacaaaaattccggagaatggcgcaccgaggagggagatcgacttcttcttctccaacttcggccgctggcgtaaa

SEQ ID NO: 30110 - DNA, 2408 bp, Oryza sativa
cggaaagtctgatccacagtcagactatccgaaaatatcagatagtctgatgttggatcagactgtctgatccactaaaggaacactacaagtagatctagtgcacaaacaagagtatggcacaaacagcgactagatctaaagcggcacaaaagcaaagctaaataataggagaagagatatcaccaacaatgaagttcaccgagttgttcccggagttcaaatccttgaggggattctactctacgttgaggagctcactaagagccgggtctttgctaaccctttcctcaagaggttgcactaagcactcctctttccactaaggggtatctctttccttgtggaggcgagatccggccttcacaaacttctcccggccaaccacacgtagatcggtggctcgggagtgacacctagccgtttaggagtcctcaacctccaagagtaacaaacaccacacaactcttggtcaaaccctagtgctcaagatcgagtgaaacacacactaggccctcaaacaccaaatccacaaccaccaagatctactacacaaagaacaaagagggatttgagagagggagagagagctcaaagatccaaaacactttagcaccaagctcaacccaaagtgaatgtgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgacccccaagcaggccagagacagagaacaaaattctagaggatttcggacaatccgatcgatcggaaagtccgatgtcatattggatattccattatttttgaaccaagaatttcatcctctcacagagactcaagttccattgaatttcggagtctctggatcatcggatactccgatcacatcggatagtctgatttaaaactcactcaaaaggaataaaaagcaattcaaaatagagagtgaagttctgagaaatttcagatagtccgacgtatcggatagtccgaccttatatcggatagtccgatattttttagccaacactcagaccgaagacagtgagcaaagttctgtgaaatttcggatagtctgagcatcggatagtctgatcaacatcggacagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcattctccccctttttggtgattaatgacaacacacttagaagtaataaaagattaggattttggtggagctccccctaaatatatgctagaaatgaaataggagagctccccctcaatctatgcactagattagaaatgacaatataacctcatgcatatgccaatgacaagatatttcacacatttgagcatggataatagataattgcacataacaagacacaaaaacccaagggtcgactagccatcacgaaaggagatagattagagatttttgatgataggtggttctccccctttggcaacaaggcaccaaaagggaaaaaatagaggatcactcatccttatcagaatcctcgccctcctcacttgactcctcagcatagtcaccttcctcctcctcttcttcttcctccataggagccttgccatgatccgcacgagaggagcttgcctcagctgcaaaagggtcctcaatcacatcctccccactgtcctcaacctcagaaccatcgggagaacacggcaaatgggtgttgcgaaggagggtcttgatccgtcgagtgtccttcttccttgctctgcgttccttggcttgccgaactgagatggtcttgcataagttgaagatggacttgaagaacctcaaggacgagttggagtccggcttggtgacggtagcggagggaccggcacgagaagaagcacgagtggttcgtccagccggcacagcagcaaccttgatgggacgcccttggtaatcggtatgtgccacctccttgtgaaacttcttcttggacacaatctcaatcatcttcataatgtaagacccatagccaagtcctcgcttaggcatcatggagataagccggatttcttcagagatgatagtcaaggcgtcaaagagctgtgggtgagccttcatcttgtaaagca

SEQ ID NO: 30111 - DNA, 647 bp, Oryza sativa
gaaaaaacggagaccgagaaattcggtcagtacttcggtcttatgtgctagatgaccgaattttattcggttaattcggtcatcaccctcgattaaccgaattgaccgaatttcacagaaagcccaatatcagcccaagaaagcaagtccaacattaataaaaccctagctccctttctgtttccttctcctcatccacccagccgccacacccgagcgctcctctcttttttaacgctctccccacctgagcgctcctcgttttctctcgcacatcggcgtcctgttccgtcgccggtgcctctgcacgactgcagcgtcccagcatctcgttctcctcctcctcctcctcacaagtgacaccacgacgacctcctcttcttgcgtggcttcagtggacacccaggccccaacagccaagcccgagccgcgtggaggctccaccccgggggcacatccgatggtgcctcttccactccgacggcgacgagcggtccaaagccgatctagatgagtatatgatagtgaagaaagctgatctaggatttttatgaattttcttgatgtgtatgattttttggatctgaaatttattgaggatttgtgcgattcttctgaatatttctaaaaattcggtctacccgaga

SEQ ID NO: 30112 - DNA, 11413 bp, Oryza sativa
aaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaccgtcctcctcctcccgtcaacggcaccgcgctcctttccctagtcggcgccctcacctggtcggcggcgcgtcctcccctcgtcggcactgtccaccccccttaagaggcgccgtcctccaccccttctcgccgcccacctccgcgcgctcgttgcccgccggccacgagcacggcccccatctggctcagccatccccggcgctcctctctcccttcctctctctccacgattgcgggtattttggtcttaaaactcctcaaagtggcaaagtatactgatgataatctatttagtggcattttatcctttgtattctaatggatggcatttttgcactcttgtggagtggcatattgtccgttttctccaatttgcccctgttctgttagatcggtttgacggtgttaattctgggataaaaagacatatataccctttgcatattgttgcagtttgtctgtacttctgtaaaaaaaaaagtcgtgcttttgcgatgtgtactcctactgtcctacatgcggcgatggatagaaacgtatcgagcatgtttgatgctccgttggtgttggtgccctgacacaagcgatcctacaaacagatcaatttaactgccggcttttatgaacaaaaacgttgcatacatcaggaagggaaaaggaaccgggaacacaagcaaaaattatttcccaaatccatgaatctatcacaacctaaaaatgaattttcccagctgcttgcaaattgattcgatcaatagaacgaactgtgaaaacctactgctttgcacgatgtcaggatgtggcgtggctgcatcgccagctttatgcggatggtggatacagcgaagtgaagcaacagataaaggccgggaatcggaggggagcttcccggcgccgacgttggtggacgacgcggactgcatcgtgtcgaggccactgggagtcagcgccgtcgccgtgctacacctccccctgctacacgtttgccgtgcccgcgtcccgtacggccgtacctcacctcttccagctgaaactcaaccctgccgcccctccacatgcgcgcctagccgtggagctacgtcgactcacccctcccatggcttaccgtgtcgcctccctgatcgcgcaccgcttgcctgagcagcagtgctgcctccgccgtctgctcctccctagccagggcgttgggtttaaggggataagggatttttggtcgggagtagaacgattattttgcattttgtaaatcatttttcttttctttctacttttaattgattgaatcggagcacacctaacagccattcaaaataggggcaaaatgcaggttcagtctaaaaaagtaagggcacaaaccctaaaaataagaggtaaaattataattgcatagctaacagagaaaatgtgaaaatcgaaccaattgcattttaggatcgaataccatcctcaatctaatggcaaaaccaagaaggttaacctatgcttggagctctatttgcgttgctttgttcatgctatgccaactaagtggaattcatggttgtagcataattctgattcaatatctcatatcactcagttttgcttaagtctcctttcgaagatctttatgggtatccatctagtcagggtgtgtttaatttcacgccaaaattgaaagtttgactaaaattgaaagtttgaagaaaaaagttgaaagtttacgtgtgtagaaaagttttgatgtgatggaaaagttagaagtttgaagaaaaagttggaaactaaaccatgcctcagtttggaattggagatgatgcctgcagtgttccaaatttggataactggctaaaggaaaggaaactgctgactcaattgctcaaacaacacctcaatcgagcaaaacagtagatgaaaacttatgccggtaagaaaagaagttcaagagaatttgttgttggggaccttagtcttttgttgctaagagggcaaatcacaagctatcatttcgttattttggtcctttccgggtgattgccaagatgggtaaggtagcttatcgcttacatattcctgaggacagcaccatccatccggttttccatgtatcccaactcaagtcaactaccgtttgctggtgctgaatttcgttgttactactgcttagcatcacgcgtggggagacgtgggtagatggagatcggcgtcaggaaggggagcgtgcaatcgcgatcaccttgggaggacttgaaagaccgatttctgttgttagttttacaaagaacccatttttttaattttaggaagtctattttagacgttctcttggagagatacatctcaaattctgtttagaaaaccaaaaaaatatttttacatctcaaattctatgtagaaaaccaaaaacaaaattttggaaattgatttttgggtatcacttggtgatgctctaagagagtcatcgtgtccaattttacagttaaggattacgaataagatctaatatatatttaagagtcaaattggaccttttcctttgaagaaccgtactactgcagaccatagttcgtttattcaggtactacatttcggaactagtataaataaaacctggcctactgctgattactgattttttatagtatatgttcaaaacagaaattgttatagttacttcttttcttttttaaaaaaaaagctgtgattcatacatgttcttcaatacatatgtgggtaaggatggtttgtctagattaatagtaaaaaagaaaaggctgtcacattagttgtaatggaatgcactcaaatccaatccagtgagttgctgatatgcctcagaatagcaaggctcatcattggtttgataacatttgcatagtcacacaagctgtactacgagaatatagtcgtgtgtatgccaacctgcgacattatagaaaaagcctgtcaacctgtttagtcagtatcagaagaaaaattaaccctacggaataaaatctttaagcatcctctctgctcaacattgagcctgatatctgaacatatgacatctgagtgtagccattgaaaactgaggcatccaatctcgctagaccaattcgttgaaacatgccaaaacgaccatcttcgatgataggatcagatgcacgggctgggtcatatcttgtttggtgggttaaggatggaccagcaactggaggtagctcccaatacaaatccaacacggattcaacaagtctgctgttctggaaatgctctttgtatgagatggctttgttgctatggttgaaattgtcacgcatataacctctaactccccaccatgcatcatcctttccacaaagctcatctgtttccacagctttctcccaaaaactctttcgtctcgaccttaatcttgcttcgtcactatcccaaaagcagctatgtccaccacctgggtagaaaaaatacatgaaaattagtttttcagtgtggagggctgcctttttcagttttattgaggaatttcaaaaaggaagattataatccagctgaagaatatggtgttgcaatgtagtgttaatagaggaaaatggaacaagatagcattataggaaaaatgaaggagacccactgattagcatatctttaaaaaaaaactgcaatctggaatatcaccgactaaacttctggtatacattgatattaaatgggttcagaaaatgaaacatgatgcctgatgaacaaattaatgaagttgtggtaatcggtatcattaccaagacatcacaagttaagagcttcaagttcctcatatcagtttattgaattgtagtcataaatgtttctttcctaaaacccaacataagtaaacaaatatatgtcaagctgccagcagattatagttgcatacaaacaattataggatatataacatatcatttctagttggtctagtatgctccatcggagtaaaatattaagctgagaaaaaacataaatttcgacaataattgtatttggaagaaaatctgcacatgtttggacatgtcgagttaaaaaagaacagaaaagttcttagtaacatattggaaaccttggtagacatagtgtttagatcatgataataacaaaaaatgtaaggttatcttatatcttagaaatacaacaaaaaaaagcacaaacaaaaacatgataataacacccagaattcataatcgcatgattagaaagaaataaaataatctcaatatgcccaaaatttactttttaaggaagtcagtacaagagattgcagaagaaatataaagaaaataaggagaacattgaaaaaggaaaactgtgtcacattaagaacgttaaccattcaagaatgtcttatggtaacagaagacatcacctcatattataatgccttctacttcagaagataaacaaacctaactgcacttatactaggaagacaagctaatggaactactccaaagtaatgtgacacagctggctcaacatctatatgcaacatctgatgtatcttgattattgaaaacttagaatccaaggacaaggtgacacacctctgatgtgttcctgatcgcagatctgtcttaaggagtaatgatcgcctgtaccagtgtcataattgtcctcaaatatgatatgtcggaatccaactattgaagcctgttttaacctacataaaacaagacacatcaaaataaatttaagtttcgaaaacttagagataagagtgcactatttattagagtgaatgcttagcatgtgtcatgctgacagttaagaatttgatcataagaacagttcaatacaaaaacactacaaatatggcaatacccaacagaaaatagtttgtccacagttcaagagaaaggttgaacaatgatgatctacagaaagactttacctcttcaactcactttggtgatcatcaaagaaaacaagcactctgctgagatcagaaatgccatgattcctcaatagcttcccccaatcaacacttccgaagtcaataaaatccttcccagcaagataagtgcagttcccatcaacatatgcaggccccttcttcagatatttctcagggtgtctgggtgagagtgatataatcttagtatttggcatggcctgacgcaaaacccatgtagagtgccccttgaatgcaccactctcaatcatcagatctggcttaagccagcgagccacaaaccaaaggccaaaactgtggtcaaagcccattccatacatgttgttcttgataggtcgtgtttcatatattggtacaaattcttccagtccacgaagtagatcctttgaagtccactccactatctttccagtttttgatctgcctttagtgaagaaaaaggacaatgatattccatacagtcaaaagtgatatttcaaacaaattaccccagtatagaggttcttgtgaaataataacaaaatataccccaagaaaaactcagcactacgtagagaaacataatcatgtctaccaacagctacaaacataaatataagtacactggtggcaactaagatggtcaattgttacaggacttcaagaaacagaataatagattgccaccgcaatgttcgcactcctatctagcagcagtcattgttcaagaaacagaataatagattgccatggccatgttctcattcgtatctagcagcagtggaacaatgaccgaggaacaaatctgaacaagtataaaccaacagagatcagttaggagcaaataactataataaatttgcacatataatgtggtcatcactcatcgaacaagctatcaagctattctgtcaaatacaattcaagatttcaggtgaatatgcattgcgctcacataaagctagcctacaacctatggtgttaggtgtctaagacactaacgatgaggaatatctgcatgagcagaatcattttcaaacagggaggagattagttgcgaaagggtgattacttcgcagaaaagaaccggatgtccggatctatctcacaagaatcaacagcggcgtgagggcttacaccagggtaccccgagggcgccgaagtcggaggccgcggccgcgtccgggagagcgagaaagcgcgcgtcgagccgcggcggcgggcagtcggcgcgggggcgggcgcggccgatgaggaaggcggtggcggcgacggcgaggaggaggaggaaggaggcagcggctcggtgggaagagtggaggcgggcgtaggcggcggccacgaacgcggggttcgcctttcggatcttggactcgtcgtcgtcgtccccgacggaggtggcggaggatgcgccagcgtagggagagtaggagaagaaggcgccggcggcgcgggctgagagaccggtgtcgtgcatgcaggcgggacgggagcagagagagatcggagtagtagaaagtggcggcggtggtagaccggtggtatttggagagagatcgagggaccgaccgttccacacgaagggagggggtggggggcgtgttagggaagatgtcaacatggggaggatcttgcttgcacgggccacgcaaatgttccagtagcttttttaacgcgtgaatgataaacatgatctctactattatagtattataaaaattgaagatgtttttgccgatagttttgatacgtcatccgtgtttgaatcgttttttaagttcattcgtttttgaaagtacagatccgtttttgagtcggtttttaatttggttcgttttcagaaatacagaatgagtcgtataaaaagaattttatcttagctaacttgcatgctaacttgagatgatcggaaccctaattacagctcatgattttataaaaggaatattcaagcgaattcctacagtaaatttcaccttagttaacccgcacaacaataatcttcacccgttgcaacgcaagggcatttttctagtaataagaaaaggagaaaatccaaaaagaaaaaaacaatggacaagcatcccaatgttaaaaaaaccattgatgaacccaacttcctataaatgctactatataatcatcttatttccaaaattttatcgttgttatgtttccattaattagtagccctccattaagtactatcaaaagaccattttaccctacgaattgttaaaagctcattaaattttttcttttttagtcaacttataaataataatttagtataaagaacaacctacaaattagtgtaagcttatggaaagagcaaaaattttaattgccttttagcaattcctatgggtaaaataattttttatagcacttaacggagggctgctaacgaaaatctaaatgaaatggtgcgtttgtatgatgacatttcttggattcgtatgtttatcgatggtgtttcatggatttctctaagaaaaaacatagagtagggatatgataagaataaacatgtaaaacattaggaagcctataaaggttcgcacgctggggcgtgccacgttggattttacttttgcagaaaagcccttcggtttgtgtgtaattcaatcgagtacccagtgaaaagttcctctgaggtgtcaattcacgaataggcccttacataagttagatattgcatgcgaaggagagaaaattcacgaattaggaccgcgctctaaaacgtggaagccgagggggtttctagcaaacgacgccctaacccacccaccataatcctagccgccgccgccgctcacactctctcctccctctggtcttctcctctccctctccagctcccgccgccgccgcctcatgccgcctccgcctccccctccccctcgtgctagagggatgaagaacgtgttttattatcaattctgacgagttaaagtaattatttccatgcttttaacatatcaatgctcgtacttagtgtgatgtgtggtgcactaaggatgtcaataatctaagttggaaatttcaaaccagttgttttatttaccaataggccacactttacacactacttgctcattgagcagtagcttatatgttggtatgttagctgaggatctcatcgttaggctggtaaatatattctctagatttgcgtcgcttgaaatgtttttgtggacaaatgctggtatttttcttctgtgcaaaccttggggccaaaacgtatactccctggttctcattatatttattgatccctttccttgcatgtttgcaaaattagcggtctattaccttccgtgctgctgaaataatgttctcatggtttgttaaaaatggtgatagtgatagggaccatgatcgtgacagggagcaccgtgatagaagcaaaagaagataacaccgtgattatgaatattctcttgatcatgatctccccttggaccaagattctgaaaggtattgcttctaaatttctaacctaagcaattacttgcaactgcacaaaatatgggtgtttttttcctttattaaatctacttatttgattgactaatgttttcctgatgcatttatttatttttatcaattagtgaattttcccctatgcgtgggaattcatggtgatgcctaataattatgaaaattaggttgtatcctttctgataataagatttaaagttaatgatatgttcgatctatctgctgcatactacactctgttgtgttcctctcttatatcgagcatcttattattagttttagaacatcttaatataactgacaattaattgctatagcaatcatgctgacaaaatcaggttagtccataattatctctgagaatctgattaaagctgccagatgtttagcatatgaagaaattcaaattctaatgtccctggcattcattctcttttgatctttatattgttcatttttttaccttctgttttacaactggatagtgcagtgggtactatattggcattgctctcggtgtactggagcattgcaactagctgctaattatctgattgactcattaatgtgtgctcaatttttcagccactgtttcttagtagaagaattggaatgtatatgtttctgaaatgaactctcccaattaacaaatttagaggtgcatccccttttaagttggttcttttgtttccctatctattaggagggggagaaacctgaattaagagatgttagcgtgtaatttccccctgaaacgtatgttaatctaatttttgtctaaatttactaaatgaattaaacgcctggcctccattacctatcacttatttggaaaattctgcagtaccctagagtgaaatgcaagcattgtgttcatatggggtttgttggcatatttcaactaaatccaatttttaaatgctacagtgctacaagaggctagaaaacaacagttgcgctattgttggtgactgacatgaatccatcgccgctcaattttaacaaagttgcaaagaagtttctaagacaataggggcttttttttggcgctgcaggctcttgcatcacccattcatctgtcattacggtttttgatgcacactgcctaattagttgtttttattatacttggattatttttctgacagaacaaatcacttcagttcccctcctgccaatgaggagtgtatgcttatacagtgaaagtattataggtttcatcaaggtattgtaatttgtaaaaccaatacaaatgctatgctcaataattgttttgaaattgcaatttttgatgaatcttatgctcaaaagatgattaaaattatctccataatgctcaagagaatacagatggttgtttttgtacagaacttagattttattataagctgttgtctatcgacaatatccatcattttatcagtctatcgacaatagtaggacgagctcttcagtctaaataacagttatatgtttgctgatgcgcctcttataacttttgctgccatgacactagccccatgtctcttgctcttgatcttcctttatgagtcactccatctaatttgtgtttgcttcctgatatttttgtagatgcaacaacatgaagattgaaaaggctgctgcctgcaaggtgtttgaaatcactgcctctggaatttaaatgtgtgaaagtgattgaatagttctgaaaatttatccttgctttgctagaagattgaatgggcggctattggaggaagaagaagcatgctacaggggtaatgacaaaggtagcagggtccctcttttgtgctcatggcatgtcaatttatcctttctgttgatttcgtgtctagaccagaaattttttaattcctacttgaaatcatgctaaaatggtttggtatcatatccaagaccaagcttaaatcatcttgtatatggtttcatcctacatttgttgctatgaagagtcaacacaaatgttgatattttccaaaaatcaactgaagcgtcgactctaaaatcaagttctagaaaagagtaagaaggatgtgctccgtcaaataatagaactgtaaactatagaaactagaagtcttaaggacactacactaaccctaaagtcactcgtcatcataagcaaagtgcaaatattgtctgtctggagtctggactcatcatttaggtgctctttggcagggcagcagctgtatgtttcagcttttgagttgtccttagaatccatctcattgagtaagcgcacttcaattgaaatctataactttctcgcattctgggaagttcattttcttattgcctgcaatttttgtagcaactacagatacaaccattgctcacatcatgaaagaacaagatgatatcaagatcaaatcctccaagtgctggaatcagattcggccacctgctacactgctgacttcaaacggccgccgaatctgcatacgacctccgttttcggcccatgagtacttgatggaaagccctcggagtcctctttccaacggatccagcctcatcgccaaacttcgtctgggaccccggcccaagtggggcccatgtggggtgcgccccaaccaggtggatcatgaccctagggtccctttggtcatcctcccacctccttaaatagctagctaccccttcagggtttctcgggttttgttagattaaagtttagccattactacttgcttgcagcacgcgtgtcggctagaccgtccgtctgcttgttcttcggaaccccaacttatcatttgtattaaattcctatttgcaatatcagattgtttttatcttggtcttgcttggttcttcgatttgcttgcaggaatagtgttg

SEQ ID NO: 30113 - DNA, 21899 bp, Oryza sativa
agtaaatttaatagtgtgcaataataatgtgtagttcaagggtgctactcccgtcccatgccaatcaatatcattaggtacctaaaaaccaaattaaatacaagagtgagtaaaaatactcagcaagtacaatattgaactagtaaaacatacacaggtttaatgcaataagaaaaccaatatgaaatatttgtcttcctttaatttaaaaggaaggaggcaaaaagtagtagttccctcccgggcaggtgtgaatatcctcttagcattaccggtaagccgagcaagcgtgatcagcgcttctcaaggatcatgaatgaagatccaaattgcactcccatgactacgcatggtacttgaataatgtaaacaaaaacttccagaataatgaaacatgaataacgtcgtgaatttgaacatgaagtgaaatatgaatacgtaacataatactaaaatcacacaattgattataggaaggttcgaataataattggataaatgaaaccaaataaagtaacacagtttatctatcacacaagtccatcttgtacttgccttaactccttcaataatccgactcaactcctccaacattggaaccctccacacctgtggagcaaaactacgcataaaccactatatctaactaataatagttacaaggatatttactaaaatcgaaacccagttcatataaattattaccgatttgtattaaatagcctatagctgttccattactgttttatacgtaacgtacaaaccgtctaatggaacctagcaaataatataacttcggacatctagacaaaattgtctaccactttcatgttgagtcctgatttccagacccggtcagcagtactgtttttgttgtttctcccaaaccgtttatcggaattgagtgaaaccagcggcgttagaaagatatcgacgatgactacaaactttatttatgacaactaacctgaatcacgatggtttaataccagatttgaaaatactattgttagcccataatcaacaactaagaaaacactgaaccggcaatttaatcgattcccacgtgaaaattgtatttctatggactaagaggagttacacttgctgaggagaaatcgaatttgagatcaatttgtgaatacccagaaaatccccaacttttgcctctctttcctttttccttcttttctcctgctttccctgcttcttgaaactcctgctctctgttcgttccagaagcacagcaacagaccagcatcagcagcagcagcgaggaacgttaacagaaacagccgtaacatggatacatatcagatcgatggcagcagcagcagcaaggattggcggcaacactcaccaaggagtcgagcaggagtggcgctggacggcgatggctgaacctgcggcgacggcgcagcagccattggggtgatggcgactagggtttgtagcggctgcagggttatcgatctcttccccttttctctttttttctttttttttcagttggttaaatagatatcctgatgaagatcgaacggcccaaattaatttaatcaccagtacttcattcggactccgattattataaactcatagtctattttgcactactcggcgagctctacgcatccatggttcctgatcgcctattcgaacaatggtttaaaaattgaacggcgtttgtgctaatattccccgaaatatactattttgaaactcggggcattacattcttccccccttcaatcgaattcgccctcgaattcgcccaaccaaactctagaacacggggtattacattcctccctccttcaatcgaattcgccctcgaattcgtccagttattcctcgaacaagtatggaaaggaactcataggtaggacttatataactcaccaggcgtgaataactctggctacttctcccgcatctatgtctcaagttcccatgtggcttctcgttcggtcttgtgcgtccaaagaaccttgacatatttgatagttctgtgcctcagcaccctctcagattcctccaatattcttagtgaacgggactcaaatgtcaaatcttggtcaatggtcaccggctctacggtaatatgatgttcagggtctctcaaatattttgtcaacatggaaatatggaacacatcatgtacacctttcatggactctggtaactcgaggcgatacgctaggattccagctatttccactatcgagaatggaccaatatacctacggctgagtttgcctttcgttccaaatctcacaacacctttggtaggagatacctttagaagtacttggtcacccacttcaaactctaattcccgtcttctgacatcagcgtagctcttctgcctactttgagctacgagcatgtgttttcgtatttctgctatccgttctgtggtttgttgaacccaatcgggttctaaaacagctctctcccctatggaatcccaacacaatggggatcgacactttcttccataaagtgtctcatagagtgccattcgaatgctagcatggtaaatgttgttgtaagcaaattctacaagcggcaaatgatcctcccaacatatcctctagagtttgaatagtccactcagattgaccatcagtataagggtgaaaaaccgtactgaatttcaattatcaaatgcctcttgcacagattcccagacttaaaaagaaaatttacattccctatcagaaacaatcgagcgaggcacaccatgtaacctcactacctcgcgtgtatagatcggtgccaagtcactcgcagaataagtggtgcggataggaatgaaatgtgccaccttactcagacgatctataaccaaaaaaatggcgtcctttccttatgaagttcgaggtagcccaaccacgaaatccatagcaatatcatcccaaggccatacaggaacttccaatgattgtaactttccaccaggactcttatgttcagcctttactcgctgacataccccacatgatggcacgtactttgccacatccactttcatcctcttccaccaatagatcttcttcagatcatgatacatcttggtctcgccaggacgcacaacatatggtgttcggtgtgcttattgcaaaatctcttccttgactttagcttactgtgggacacataaatgcccatggaatcgctcaactctcgaggactccaaagtgaaatctctagtttttccttcctttacacgtttcttaacttgttgtagcaaccgatcgtgttgttgggcatctagcactcgttgtggtatgacagactcaagaatgactcgtgactcggtactcgccactccggcgtagcaataggagatacccatccgttcaaaatcaattatcaaacaattcacagttggaggaacgaccttacggcttagagcatctgcaaccacattcgccttacccgatgtatacggaatgttgagatcataatcttttattaactccagctacctcctctgctttaagtcgaaatccttctgagtgaaaatgttttgaaactattatgatcaacaaaactatcacaagactctccgtataggtagtgcctccaaatcttaagagcagagaccactgctgcaagctcaagatcatgagtggggtaattctgctcatgcttctgtaactgcctagacgcataagatataacattgccctcttgcataagaacacaaccaaggcctactcgtgaagcatcggaatagacagtgaaacgcttaccaaggttggggcaaagtaagcaccggagcagttaccagcctctacttcaattgctggaaactatgctcacattggtccgtccattgaaacttcacacatccttatgtgcgagcatcgtcattggtttagcgataattgagaaatccttcacgaagcgtcgttagtaccctgccatacccaaaaagctcctcacatccttaacattagtcggcctttcctacccgacaacacttgaaactttgctagtatcaactgagataccctgctgatcgattacatgccctaggaaagtcacttcaggaagtcaaaattcacacttctttaatttagcatagaacttgttttcctgtaaactccctagcaccatcctcaaatgacactcatgctcctctacatctttcgagtaaatcagaatatcatcaataaacaccaccacaaacttatctagaaagctatgcaacatgctattcatcgcctccataaaataggccagagcattggtcaccccaaaagacataactctacactcataatgcccatacctcgtggaaaatgcggtcttctcaatatcctcttctcgcactcgaatttggttataaccagattgcaagtcaattttagaaaacaccttttactccctttaacttatcaaacaaatcttcaatatgaggcaatgggtacttgttcttgattgtcgcagcatttaaggcccgattgtccacacacatacgacaactcccatccttcttctcagtaaaaataacaggtgcaccccatggcgacacactccgtcggattaacttcttggataatagatcatctaactgttttttttcaactcttcttggaaaggacgagctaaccggtacggggctctagagatcggtcgtgtaccaggaacaagatcaatacagaactctacatcacgctcaggtggcatccctggaaattctacgggaaaaatattgggataaacttcgttcggactccgattattataaactcatagtctatttttcactactcagcgagttctacgcatccacggttcctgatcgcctattcgaacaatggtttaaaaattaaacttttgcacgtttgtgctaatattccccgaaatatactattttgaaactcggggcattacagatacacctctcagagggttgttgatcttgccggtgcagatcaaccctattcctacaagcaaatcgaagaaacaagtaagaacaagataaaagcaatatgatattgcaaataggaatgaatacacacgataagttggggttttgaatacaagcagacggacggtctagctgacacgcacgctgtaaggaagtagcaatggctaaactttcatctaaacaaaacccaagaaaccctgaagggtacctagctatttataggtgtgggaagatgaccaacggtgccgtagggtcgttctccaccaggttggggtgcactccacatgggccccacttgggccggggtcccagacgaagttacaagcccataggcctattacaagtgatgcaacaccttgtttcttcaattgcggctcactaagatggaatttcgcaatgaggttggatccgttttaaagacaactccgagagctttttattaagtactcgtggacccaaaacggagctcgtatgcatatttggcggccatttgaagtcagcaatgtagcaggtggccgaatcgaattccagcttttagagaacttgatcttgatgtcttcttgtagatccatgatgtgagcaatggttgtatccatagtagccatggtcacattatcctccccttcttcatggaaaaacgtcctcggtttttccatgtggtgctcttcacgtagtccatttaaaacaacctgtttcttccaatcaaaacaaggcaaactcgagataatttggttagcattaacattcctctctagcttgtatgttttatccacatgtacaagaggtttctaaatccgaacatatgtaaactctatgcaccaaatatattccaacatcattatattcaccaaagatatgaaaaatagcattagttggacatggcaaattagatttagcaaataatttctccttcaaattttcaagctcacaaaaatcatcaaaccgaacatacccaaagtatttaaagaagatagcaattcacattcctctatttcattagcaatgtgaacaacatgcttaaaatcaacacacaaagaaacaatagaaatagcatcttctttcaccagttgtggcatggatataagtgaagcattatcacacaactcttctttatcacaaggaacagcaagtaaatcaacttgtgataaaggcatctcagcaattggttccactaatggttgctcttctctagtatgaaaagtggacatgttcaattaattaacggcacagtcaccttgattaattgcagcaccattaagtttaccttttatgccacttcagataatgtaggtgcatcagtcttctcttctgtcttcgtgagcgatggagatggcatctcgatcatattgctcttctcctcatggtgaatgttctgagctccctgcaaaatgtcagtaataggaggcacaagcatagcttgtttctcccttgggttctttaaaatattgctctcaacactgcaagcaagcatgaacaagtggcctatatgattatatgtcacattaataagcctagcttgaatatcggaattaagccctctaaaaaatctagtcattgtgttctcattgctttcttttaaaccactaaaagtgatacaaattttaaagttatgaaagtactcctgcacggttttgtcaccttgttttagatgtgaccatggcaactacagataaaaccattgctcacatcatggaagaacaagatgatatcaagatcaagtcctccaagtgctggaatcagattcggccaactgctacgctgctgacttcaaacagccgccgaatcttcatacgacctccgttttcagcccatgagtacttaatggaaagcactcggagtcctctttccattggattcggcctcatcaccaaattccatccaagtcatccacaaatgaagaaacaaggtgctgcgtcacctgtcatgggcctatgggcttgtaactttgtttgggaccccggcccaagtggggcccatgtggggtgcgccccaaccaggtggaggacgacctagggtcctcccacctccttaaatagttaggtaccccttcagggtttctcgggttttgttagattaaagtttagccattgctacttgcttgcagcgcgtgtatcggctagactgtccgtctgcttgttcttcggaaccccaacttatcttgtgtattcattcttatttgcaatatcagattgcttttatcttgttcttgcatgttcttcgatttgcttgcaggaatatggttgatttgcaccggcaagattaacaacccacagagaggtgtatcgatcgctagggcgcaacacaataacgtcatgtacggttgtagtcgggtcgtcaatgtttctcccaaatcgtagttgtctcaactcactgaaagatcgggccaaacaacaaccttgagtgtcgagtggaactcagggttcatcaggtggtatcagagctttcgttgctcggtgagtttttatctagctataacctgaaaattttcctacaaaaaaaattgcatcctgtacctagccatctttgtgccattgtattgttcttttcagtttttgcgttgttgaattttgtgttgcatcgtcacgtcgtgttgctggtcttagcgtctagttcgtttagagtttcgaattctagtcacgttttgtaccactgtcgtcgcagccgctgtgtcttggttgtcatcgggacctacgaaattggaatcgtctttccgccagagttccatatttgtagttttcagaagtttctgtcggttagttttgaagttgcgtctagggtatgctgtttagacgggcttgtgtttgtgccgtggttatgttttgccgtgaggaagaaaaaatgggaaaggaatatagcatatctgtttggattcggttcggtggaaggaaaggaaaataataatacattggatcggcaaatcagtttctgatttatctcattcatttaatctggccggccgatccatccacccactgtacccgcacctccccaccatctacagttgtttcccccaataccgtgagtagctcaacaccatggtgaaaatttttcaagtgtcggattggaaatccgtttgaaacaacggaacctatgagggacgagagcattccatttttgtatagttctaattttgggattgaacttttacacttgagtccctgtaatttttagattcgcatttgagtccctgtaatcttgcattgaggtccttgagtttgtttttttaaaaaaaataaaaaaaaggcagaaaggtgcataaaaaaagcaaagaaaagcagcaccaaaaaagaaaagaaaagaaaaagaaaagaaagaaaaaaaagaaagaagaaagaaagaaaagagaaaatattgttatctttgagctgaacttcatatatcagagtgtgcttgagttgtttctagtgctatcctgtggtatcgtttgtgtttaggctcgcgtctctagtacgttctagcctaggaccagcacggtacttgactttgaacgattattcaactttgcattctctgatttgagcatttgctattcctttgctacatatttaagcctacccagagctccacagatttgattacagccgtacaacaagtgtttgccaaggcattcatacatccaaacttcgttgtggtgcttggttgagtcggtgtacatcaccattccgcttgctttggtaagaacttgtaagagcttggttaaaagcttgagtgtgtgtgatatttgagctaccactacctagtagttgataggaacgtgcatattcttgtgtgtgtttcttgtttgctactaaccatggcaggattgcgcaagggaatacgagaacatcaacttctacaccttcgatgagatatgacgacttctccacgtgatgcatatgaggtacatgactataattttgcacaagttgcatcaaagttaccattctatgatgggaagtatgattttgttgcatatattgattaggagctagcagtagacaatgaatttgatatatatgatttttctgatgctcaaatgattaaggctgctagtaataagtttacctcttctgcattattttggtggagttatgtttgtaacaaacctgaaactttggatgaattcaaaaccataatgagaaaatgctttgtgagttcttattacaaatgtactcttcgggagaaattagaacatctgaaataaggcgatagaactgttaaggactacattcatgaatttaaggtctgtatcatctacagtgatctcaaagagtgcaatgaaaatacaatgcgtagatttttcaatgggcttaattctaaaattcaggttttgtttgataatgtgacatataatcatattgggcacctattcatgcttgctcgtagcattgagagttagatcatatcaaatgcgaggaagcatgaacaatgtgatttatctcccatttctgaatctcctatatccttatgcaatgatgatgtgcaaacattggaggagcaatcttttgtctctcctgttactaacgttttgcagggagttcagaacattcaacaaaaggaggagaatggtgtacttgataagaaagaggatgaagcacctgcggtttcggaagaaagtttgcaaggtaaattaaattgtgctgagataaatgaatgtgagtattctcaagctgagctacacgtgtccacttttcatgctatagtagagcaaccattggtggaaccaattgttgagatgcctttgtcacaagttgatttacttgttgttccttgtgataaagaagagttgtgtgataatgcttcacttatatccatgccacaactagtgaatgaacatgctatttctagtgtttctttgtgtgctgattttaagcatgttgttcacattgcaaatgaagtagaggaacatgaatttctatcttatttaaatactttgggctatgtttggtttgatgatttttgtgagctcgaaaatttgaaggagaaattatttgctaaatttgatttgccatgtccaactaatgctatttctcatatctttggcgaatataatgatagaggaatatatttggtgcatagagtttacatatgttcggatttagaaccttctgtacatgtggataaaacatgcaagctagagagaaatgttattgctaacaaaattatctcgagtttgtcttgttttgattggaagaaacaggttgttttaaatagactacgcgaggagcaccatatggaaaaaccgatgacgattttccatgaagaaggggaggatgatgtgaccatggctactacagatacaaccattgctcacatcatgaaagaacaagatgatatcaaagatcaagtcctccaagtgctggaatcagattcggcttacatgtgtgtgaaccctcgtccaggaatcagccgaggcacacaataaaaaattgataatagagtacaattattactctaattaataagcgaataaaatgtcattacagaggtagatagttactctcaatcaataaagatataagcagcggaaaaaaaataagataaacggcgcagacgactccactccacaggcagcttgaccagggctacacctaatcctccacaccatcagcatcactgtagaactcctcctctgatgaatgattgcaaggtgagtatatgacatactcaggaagccacgcagcaaatatgcaagtgcacaggataacaaaggatggcatagtagggtttcatttgaataaacaacatttaatgaacatttcagaatttaataaaacagttaagtaataattaaacaatattaatccaacgctatacaacataccctgttgcataggcccaaccattctgaacaaccatcccggctgcacagttctatctccaaaccaggaatatgccattccaaaccagggttgtttgggatctatgtgacttgccttgctggccttggaactcttcaaattcttctcctgcgaaaacggactctccggaaacgtcggaatctaaacagaaaggagcaaaacaccaaaaaagcacataaacaagcatgaacagtacatgtggatatttttaacatgtagatctcaattttagaaaaatttagaaacttgaaccaactaaatccgagctaagatgaattagttatgaatttttaaagattaaatcggattaaaacacttatatgagtattaattgaattatgatgcaataatgaattatttttgaaaaggaaaagggaattattgcgtcagcggctagggttcacggtgaaccgggtgcacggcggcggctcacgaaaacgaacggccgagatctttccatccaaaacgaacggccgagatcgaccggtccacagccggaccacggaagacgacgacgatgacgtcagcggtgacgtcaccaccggcggcggctcgggcgcgcgtcacaccctaaaaatcctaaatatataaattgttgtttaattggaattattagaatttattttaaaagcctagaagagaagatctaatttgtaattaataaatcccaatataaaatggggccagataaaatttcattaaatactttgcttaactctataattcttagatttttctgggatttatttgaggtaaggaagtatttttaataaatggaattgcatttaatgaataatttaaattggaaaaggttttaaaagttctcttttggctttgggccgaaagtcggcccaaaaccctctctctctcctcctcggcccagtccgcccgcagccggccgcgcgcgcgttcgcccgctgacaggtggggcccacctgtcagtcttcgtcttcctcgcgccgctgccgccgcccgagccctagcgccgcgccgccgtcgtctccttccaaatctagccgccccttttcgtttccggtgaaattaatagaggggaaatgatccccgggatcacctctatcttttctcttatggaatcgtcaactaatttcgtttggaaatccgtggattcaagttcgattcggatcgatctctctcctccgaaccctagactttccttcgccgtcgccggtcgccgtgggccttcgccgccgccttccaacccctatataaggacccccaagcccgctgctacccgtcgccacccttgccttcgtctctcgtcgtccgtagcgccctagccccgtgagacctcgcgccgccgtcgtcgccgccgctccagccgtgcgccgctgtcgctcggggaggtcgccatcatggtcgccgtcgcgtcgccgtcctcgtccgccactccgccgtcgctgtcgaccgccggaacaccgccgtcgtcgtcaagccgaaggtcgccgccgcttcttcctcgacgccgtcgccgtccgttgatcttccgccgttgttttggtcaccggtgagttcgccgcgtcgccctctacgtgttcgttccctccgttcgcgctgtcgtgccgtcgttcaccggcgggcatgcgcgcccgagccgccgccgatagtgacgtcgtcgctgacgtcatcgtcgtcgtccatcagtgagccgcggtggatccgatcgatcttggccgtccgttttggataggatcgatctcggccgttcgtttccgtgagctgtcgccgtgcacccggtccaccgcgaactctagccgctgatggaataattcccttttccttttcaaaaataattcattattgcgtcataattcaattaaaacccatataaatgatttaatctgatttaatctttgaaaattcataagtaattcatcttagctcggatttagttggttcaagtctctaaatttttctaaaattgagatctacatgttaaaaatatccacatgtattgttcatgcttgtttgtgtgctgttttggtgattttgctcatttctatttagattccgacgtttccggagagtccgtttttgcaggagaagaatttgaagagttccaaggccagcaaggcaagtcacatagatcccaaacaaccctttgagcatgttgatcccgtttaaagctcttgtttctattcaactattgcatttattttcgaatgtcattgggtggaattaacctattgtttgttatagcccttttgttcttgattactttattccttgataccttgggttattataacttgactagttgggctatatatattggttcagctaaatattagatatgattgcttagccatgcttagaaacattagcacactattgggataacttatgactcactattatttaattatggcttaatgatagttcacgatggtcaatcgtgattggttaattaattacttgccaactaaaacttgataatggtgggttgtgagcacatggttctgatggtcgtgctcatgacaattaaggaccggttcacgagtttcggttgtgaaacattaaccgtgccaaccacaagccagcgtgggcaacggctttaccttttgtatagcatggttcattgcggagcaccagactaagaagtggcggagataagcccacgagggtcgctggggagtccatgccttgtttataagggggtgattatgatccaggaacggtgcgcggtggtggattgtgttgtgcgaggggtactgtcacagctcctttccgaagtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcatcataataaaagatgctataactggtaataatttgattagctcctggtttggaatggcatattcctggtttggagatagaactatgcagccgggatggttgttcagaatggttgggcctatgcaacagggtatgttatatagcgttggattaatattgtttaattattacttaactgttttattaattctgaaatgttcattaaatgctgtttatgcaaatgaaaccctactatgccatcctttgttatcctgtgcacttgcatatttgctgcgtggcttcctgagtatgtcatatactcaccttgcaatcattcatcagaggaggagttctacagtgatgctgatggtgtggaggattaggtgtagccctggtcaagctgcctgtggagtggagtcgtctgcgccgtttatcttattttttttccgctgcttagatctttattgattgagaggaactatttacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagcgcgcaaactcgctggcgaacgacggcgcgacgacgcgaacggaggacaccaacacgtagagggcgacgcggcgaactcaccggtgaccaaaacaacggcggaagatcaacgaacggcgatggcgtcgaggaagaaacggcggcaaccttcggcttgacgacgacggcggtgctctggcgatctacggcgacggcggaggggtggacgagatcggcgacggcttggtgaccacgacggcgacctccccgagcagcgacgacgactggaccgacggcggcgcacggctggaggtgcggcggcgacggcggcgctaggctacacgatgctagggctctaccggcgacaagaggcgaaggcgagggtggcggtgggtaacggccggcttgggggtccttttataggagcaaggaggcggcggcgaaggcccacggcgaccggcgacacgaaggaaagtctagggttcggaggagagagatcgatccgactcgaactcgaatccacggatttccaaacgattttagccgacgattccaaaagagaaaaggtagaggagatcccgaagatcatttcccctctattgatttcaccggagaaggaaaggcgcgagcgaatttggaaggagacggtggcgcggctcggctagggttcgggcggcggcagcggcgcgaggaagacgaagactgacaggtgggccccacctgtcagcgggcggacgcgcgcgcgggcggctgctgccggactgggccgactgggccgagagagagagagagagggttttgggccaactttcggcccaaagccaaaagaagacttttaaaaacctttttcaatttaaattattcatgaaatacaatcccatttattaaaaatacttccttagctcaaataaatcccagaaaaatctaggaattatagaattaagcaaagtatttaatgaaattttatctggccccattttatattggaatttattaattaaaattagatcttctcttctaggctttttaaaataaattctaataattccaattaaacaacaatttatatatttaggatttttagggtgtgacaaacctaccccccttaaacagaatctcgtcctcgagattcggaagaactggtgaatagatgcggatgagctgactttaattcatcttctcgttcccaagttgattcttcttccgagtgattactccactgaactttacaaaaacggataactcgattcctggttcttctctcatcggtttccaagatacggattggtttctcaacatatgtcagatcctcttggatttctatctgttcaagactagcttcctcagtgggtacccttaaacacattttcaactgtgacacatggaacacatcatggactcctgccaaagattgaggtaactccaactgataagcgacctctcctcttctactgacaatcttgtaaggtcccacaaaacgcggtcccaattttcctttagtgtggaagcgatgaactcctcgaagaggcgtgacacgaaggtacacataatctccttcttcaaaactcaaatctctacgacgattgtcggcataactcttatgacgagactgggccacacgcaatctttcttgaatgattttcaccttttcttctgcttccctcaggatatccgtcccaaaaacctgacgttcccccatttgatcccacaaaagcggagtgcggcacttccgaccatacagtgcttcgtaaggagccatatgaagactagcttgataactgttgttgtatgagaattccgcataaggtagattcttatcccaacttccaccaaagtctaaagcacaagctctcaacatgtcttccaaaatctgatttaccctttcggtttgtccatctgtctgcggatgataagcagtactaaagttcagcttagaacccatctcttcctgaagcttcttccaaaactttgaagtaaactgactacctcgatcagacactattttcttagggacgccatgcaaacacacaatcattgccatatacaattccgccaaccgacttccagaatatgttgtctttactgggatgaaatgagccactttggtaagtctgtcgactatcacccaaatagagtcatggcctgataacgttctgggtaggccagtgatgaaatccatgtcgatctcctcccacttccattcaggaatcttcaaaggctgcagcaaacctgcgggtttctgatgttctgccttgactcgctgacaaacatcacatactgctacgtattctgcgatttcacgcttcatacttgcccaccaaaatttttccttgagatcctggtacatcttggtactaccagggtgaatggagtataaagtatcatgagcttctttcagaattgtattttttaaatctttgttgtctgggacgcagattctctcacccaaccatacagttccttgctcatcttccaagaaaccgatagcttttcctcttctcatattcttcttgatttcttaaatatcaggatcattaatttgggcatctctaacttgatcaattagagtgggctttgcttctaaggctgcaacgaaacctctactgacaattcccaaatttaatctttcaaattccttacataactccaatggcaactgtcgtccttccgtagcattgcaatagcctttcctgctaagagcatctgctacaacattagcctttcccgggtgataatgaattcccatgtcataatccttaattaattccaaccatctccgttgtctcatgtttagatctggctgagtaaagatgtactttaaactcttgtgatcggtgtacacctctgtacgagtaccgaaaagataatgacgccaaatcttcaacgcatgaaccactgcagctaactcaagatcatgagtagggtagttcttctcatgcgggcgtaactgacgagatgcataggcaaccaccttcccatcttgcatcagaacacagcctaacccaagcttggatgcatcacaatacacttgaaaacccttctttgggtcaggcaaaattaaaataggagctgatattaagcgattcttcaactcttgaaaactctgctcacattcttctgaccacttgtactttacatccttttaacgtaatcgtgtcatgggcttagcaatcttggaaaaattctctataaacctccgataatatcctgcgaggcctaggaaactacaaatctctgaaactgtctttggttgtttccagttggttacggattccacattactaggatcaacggcaactcctccagctgagatgacgtgaccaaggaacttcacttcagacatccaaaattcacacttgctaaacttggcatacaattgatgctctcgtagcttctccaatgcaaggcgaaggtgttcttcatgctcttctttggttcgggagtagataagaatgtcatcaataaagactaccacgaacttgtctaggtattccataaacaccttattcatcaagttcatgaagaaagcggggcattggtaagtccgaaaagacataacagtacattcaaacaacccatacctagtggtgaaagccgtcttaggtatgtcttcctctttaatcctcaactggtgataccctgattgaagatcgatcttggagaaaacagtggcacctttaagctgatcaaacaaatcatcaattctgggtagcgggtacttattcttgatagtcacatcatttagtgcacgatagtccacacacatcctctgggtatgatctttcttttccacaaaaataactggagctctccatggagatgaactcggtctgatgtatcctttctgaagcaaatcatctacttgcctcttgacttctgctaattcattggctgccattctataaggtctcttatggatcggagttgttcctggtaccaaatctattctgaactctatgtcccttttaggcggcataccaggtaaatcatccgggaacacattgggatactcccggactataggaatctcttccaaagtcatttggttcagacttgaccttaaagactcagaagacaatgcatgaacagttacaactcgaccatcattgctggtgagagttacttttctgttggcacagtctatctttatacctggctaaccagtccatccctaggatgacatcaaggtctttggattctaacaggataagattggctagaaatggtacttcttgaatttctattctgacagaggggctacgttgcaaagagagtgcttgattacttggggtactaaccatcaaaggacgtctaagatcttctacttccatcccatgatttcccgcaaaactcatagataaaaatgaatgtgtagcaccagaatcgaaaagcactgttgcaggaactgagttaacaaggaacgtacccaaaatcacatctggagcaccttgagcttctgcagcagtaacatgattgacacgagcctttgatgctgatgcggtagagttgctctgggcagggacaaccttcacgcgtcggggcttcggacacttgtcagcgtaatatcctgggtctccacagttgaagcacgccctgggcttgctgccttgctccctcttggcaggctgttgctgtgttggagctgcaacagggcgtggagcttgattgcggatgttgttgccagcattgttgttgaagaactgacgctgcggacgaacaacagacgaagaacctccctgtggcatggactggggtcctaaagtaagacgcggcctttgactattcccctgttgtgccttgaagtgagcaatccggcgtttcttctgctccatgcggttgtacttgtcctcctggcgaatagccttatccactaacttctggaaatcatgataatccccagtcatgagtgggtaagaaagctcatcattaagtccttccaagaacctctcctggcgctcttcatcagtgcgcacatcttctggagcataacgagccagacggttgaactcgtgcagatactcggtgaccgtgcgagatccttgggtgagcgacctgaattccttcttcttgagagacaccactcccgatggtatatgcgtcttccggaaagcagcggtgaattcaagccaagtgataggttcagcagtagtcctgttaaggcggaagtgatcccaccactcagaggcagggccatgcagctggtgtgatgcaaatgagaccttctcctgatcagtgcactgaagcaaatccaacttcttctctatggcatgcagccaatcgccagcttcaacaggattagtggtgctagagaaagtgggcggcctcacacgaagaaattctgctaacttgttctggggaggtgcatggttatttccctggttctgctggttctggagttgctgcatcatcatgttcataagctgtgcctgttgagccaggacttgggcaagtgtgggattctctccattgttgttgttgttattgttgatgttggggccattcccgttgctgcgagtgagcaccatctggcatgggcaggatcacaagaagagaaaccgtggaaaactacttaggacagagaattacttttctactaacttaacttttattgatcttaactgagtttcattattacagaactgaagactctcacaccactaaactcaccaactacctaacactcgaaagcaaacaaacgcatgcacttacatcccaccactgatgtaaaccacatgcaggacccacacacacaaccaaacttaaaacaagcaaacgaacacaacgatctaggacaacggcttgacaaggcactctaggtcttccgggcatcggagttgattgaaggctcgttcggctcgtctcaatcatcttgagtagctccccactcgacctttgaatgggtgcgcttcgattcttctccttcatcatcacttacattgacgaccggaggatccgctagggctggggtaacttctttctccaccacacggacctttggtgccaattggtagcgagggacgaatagagctctcttcgttgcggtaagacgaatcctggccttctgcggtggtgcttctcccatcaacgcggctagttccttctccaaacgatccaccttgtcctctaacctgcaaatcttaccacgattccgatcgtcacgatcttgagctgctagcacaacctccgcgcgggtttcatccatagcccacagcatctcaaccaaatgccttatggtagcatcattctcaatcccctcagtctcaagatagctgccacggtcacttccctggggttggcgaggatggtagcgatactcagtgtcggccaactaatcactgtagcgatcgcggagctctcctatggcgatccttgccacctcctgacatgcatggatgtagtttcctcctccagcttcgaacatcactgatgggatatcttctctattactgttcaaggtgactttgactcggcacttctcttcttgacgatcatgaggaatctgggcatacaaaggggcagtcccaaatcctatggcaaaggacatcgtgcgcaactcctagacaaatccctcaacaccatacaagtactcaggcttgtagcgcggcatctaaagacaagtgaaaggaggaagttaagacatttatccaattaatagcacaagtttttggattaatttgaataaagttagaaaatcaaagtaaaaggtaagtaaataaagtaaaccaagcttgcaagatacgttgaaacagttggaaacaagatcacaaattttgcacttttgaacaacaggttccaaaagaaataaaagaaagttataaaatcaacatgcgaaatttattttattgcagcaaaataaaacaatgttataaacatttgctagtaaatgagccattagtacagtaatagatgtatagtactaacaacactggaataaattttgaatgagaaccactaaaagagattatgaagtgcatgtgccattagtttggtttaattaaaagagaaagggaggagaacagttctactttttcaatatttttagagggcttctatgggtgaccatttggcataacctagggtcaaggaggctctgataccaacttgtcacgcccggaatttctatccaaaattacaaacgcttacatgtgtgtgaaccctcgtccagaaatcaaccgaggcacacaataaaaaattgataatagagtacaattattactctaattaataagcgaataaaatgtcattacagaggtagatagttcctctcaatcaataaagatataagcagcggaaaaaaaataagataaacggcgcagacgactccactccacaggcagcttgaccagggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgaataaacaacatttaatgaacatttcagaatttaataaaacagttaagtaataattaaacaatattaatccaacgctatacaacataccctgttgcataggcccaaccattct

SEQ ID NO: 30114 - DNA, 1594 bp, Oryza sativa
tagacccgcccataaccgcgggcacggctattcgaatagttttactctggccagaggtgtaccactgtacccacaagacacagccccacaacatgtgaccatgtgccttcataccaccacggtacctcggaaaggagctgtgacagtaccccttgcacaacacaatccaccacagcgcacctttcctggatcataatcacccccttataaacaaggcatggactccccagcgacccccgtgggcttatcttcgccacttctcagtctggtgctccgcaatgaaccatgctatacaaaaggtaaagccgttgcccacgctggcttgtggttggcacggttaatgtttcacaaccgaaactcgtgaaccggtccttaattgttatgagcacgactcccaaaaccatgtgctcacaacccaccattatcaagttttagttggcaagtaattaattcaccaatcacgattgaccatcgtgagctatcattaagccatcattaagtaatagtgaatcataagtaatcccaatagtgtgctaatgtttctaagcatggctaagcaatcatatctaatatcttgctgaaccaatatataaagcccaactagccaagttataataacccaaggtatctgtgtgacttgccttgctagccttggaactcttcaaattcttctcctgcgaaaacggactctccggaaacgtcggaatctaaacagaaaggagcaaaacaccaaaacagcacataaacaagcatgaacagtacatgtggatatttttaacatgtagatctcaattttagaaatatttagagacttgaaccaactaaatccaagctaagatgaattagttatgaatttttaaagattaaatcggattaaaacacttatatgggtattaattgaattatgacgcaataatgaattatttttgaaaaggaaaagggaattattgcatcagcggctagggttcgcggtgaaccgggtgcacggcggcggctgacgaaaacgaacagccgagatctttccatccaaaacgaacggccgagatcgaccgatccacagccggaccacggaagacgacgacgatgacgtcaccaccggcggtggctcgggcgcgcaaactcgccagcgaacgacggcgcgacgacgcgaacggaggacaccaacacgtagagggcgatgcggcgaactcaccggtgaccaaaacaacggcggaagatcaacggacggcgacggcgtcgaggaagaaacggcggcaaccttcggcttgacgacgacggcggtgctccggcgacctacggcgatggcggaggggtggacgagatcggcgacggcttggtgaccacgacggcgacctccccgagcaacgacgacgaccggaccgacggcggcgcacggctgaagctgcggcggcgacggcggcgctaggctacactatgctagggctctaccggcgaccagaggcgaaggcgagggtggcggcgggtagcggcaggcttgggggtccttttataggagcaaggaggcggcggcgaaggcccacggcgaccggcgacacaaagcaaagtctagggttcgtagaagagagatcgatct

SEQ ID NO: 30115 - DNA, 2956 bp, Oryza sativa
gggccaactttcggcccaaagccacaagaaaccttttaaaatcctttttcaatttaaattattcatgaaatgcaatcccatttattaaaaatacttccttagctcgaataaatcccaaaaaaatctaggaattatagaattaagcaaagtatttaatgaaattttatctggccccattttatattggaatttattaattaaaattagatcttctcttctaggctttttaaaataaattctaataattccaattaaacaacaatttatatatttaggatttttagggtgtgacagccacctgctacattgctgacttcaaacggccgccaaatctgcatacgacctccgtttttggcccatgagtatttgatggaaacctctcggagtcctctttccatcggatttggcctcaccaccaaattccatccaagtcatccgcagatgaaaaaacaaggtactacgtcacctgtcatgggcctatgggcttgtaactttgtttggaaccccggcccaagtggggcccatgtggggtgcgccccaaccaggtggaggacgacctagggtcctcccacctccttaaatagttaggtaccccttgagggtttctcgggttttgttagattaaagtttagcctttgttacttgcttgcagcgcgcgtgtcggctagaccatccgtctgcttgttcttcggaaccccaacttatcttgtgtattcattcctatttgcaatatcagattgcttttatcttgttcttgcttgtttctttgatttgcttgcaggaatagggttgatttgcaccggcgagatcaacaacccatggagaggtgtatcgatcgctaaggcgcaacacaacaacgtcttgtacggttgtagtcgggtcgtcaacgtttctcccaaatcatagttatctcaactcaccgaaagatcgggccaaacaacagtcttgagtgtcgagtggaactcagggttcatcagatgacctgatatgctatttggtgccttttaagaacaagtgcagcttcttctctaggaagaagaatgatgagtatgtgccacagtgccagttaatttacttccaatcatccttttttttaaaaaaaaaataaacgtggcataatcattagtgctaaggcacgctttatgttggctgacaagcttacaactatatgatatctatgtgcaaatgtgtgatatgtaaatcgacttataaaagccgacagaaattgataagattgccctgcagccactgttaccatgcggattgcataactcgctggcttaagatcaacaaggtaaattatacttctttatatttgatgttgtacctccaaaatgcaaaagaagtttctgtattctgtgtatagatactaaatgcatatatgcgaacaagagtacctgtaacgtctgaatattactcaagaaattcgatacatagaatgtgatacattgtctgaactttgtctgacgggctgaatgttgattgctttgtatacaaacttgtcttgtctggtataggaagattatccttctggatctgattttatgtttcttttctttcaggcatgcccagtctgcaatgaggaggtatttgggtgaatcacaaatccaaaaattctaaataggcctaacatgtccatcgaatggaatatcggagtatttttctcatgaatttcataaggtatgttgtatccctctttggttcaaattcattcaatattatatttcagtgagtagtgacgaagtaacaatgaaacaaagttctaagaacttaggaatctgtttgtgccaagaaaactttttagccttgtagccaaattattttgtgatgcacacataattgcctacattttctcttaaatgccacttttcatgaataaggacatgattttaaaggtagattactctgttggttgtacaatttattctattaattgctaaaagaaaaaaaagactatgctgctatatttcccttgaaaatattgttgtagtgggattctcctacacttctaagcatacatcatgaaaagagagatagtgccaagtgagcaatgagttctttttaggagaaattagcaagttaatctgttctctaactttacaatgcaataatgcagatggcagatgttgaactctttatgttatatttcaggtagagaagaaaaatgttgtcctgaaattagaaagcgatagattgattatgtttgaccattctactcatttagccaagcttctattaccttttgttacagctgtcgaaaggggcttgcttaagaagcaatattaaccatgatggcatttgcaatagagagaaatttggaattcacactttcagagcaaaaattattctcctgtgacctctcacctatcacaagaaccccaaccactggatgaagcgggcatagtacatgtatatgcaatagtagcacccattaagaataggtatgttccagtgtctctcgtgttgctttattgtgtcgttaactccatcttggtaaatgataatctctgctactgttgatgttttgcactaaaattttctctttcatgtcaatttccattacagtaatactcattgtcatctagacacaccaattgatagatatctaggatggggattaaataggcctaacaaaaaaatacagcttgacatttaccactcaaaatttactccaaaccaaataatatagaacaacagtgtgcatgaagtactacattgcatcatgtaaatgacaaaccagcaaatgaaatgtttatcataatgttggtgagtagaaatgtgtcatggtacttgcattgttgaccaaaatgtgtagttgatatgtgcctgcatcatacagataataatatgacctctgaaacagaaggatagaaccctcttgcacataggaattgttatatcaagatggacccttttttggcggggaaagatggaccttattaactgatatgagtaa

SEQ ID NO: 30116 - DNA, 30886 bp, Oryza sativa
  unsure (1)..(30886): unsure at all n locations
gcttgcatgcatcaactttccaaatgaatatttgtcacgtcccgataaatttatcccgaaataaaattcattctctaaaacgaaaaatagaattaattaaaattcgaatgtggcccggagaatttttgttaaattctccttggtctaaaatgagcccttaaattttacttgaattttcagagcaccagaaataattattaagcaacaaaaacaattatcagagtttattaaaaagaaaaactaaaaataaaccctctcctccctttgggccaagcgtccctctctctccctcggcccgcggccgaagtccttctcaactccctctattttttcttctctctctctctcttgggccgccctccttccccttggcccagctcccttcccctccccctccctcccggaccactccctcctcctccctctctcccccgggctgcctctccctcctctcctcctgggccagccgcccggcccaatccgcgccccccctgctcgagccgcgcccctcacgcgcgttgcacgcgagctgacgtcgcgcccgcgtggggcccacgcggcggtcgtcgtcttcttcctccagccgcccggcctttcctttttttcccgaaaacttagctcctttcctcccttaaatccctgcgattaaatcatgggatcccaaaattgattatagccgaataatcccctttccctcctctgttttcccccacaattcccccttgattcatgcttttaatcacccggaacgcccgcgccaatcccggccgctttccatggccaccggccgacttttctgccgccgttctcacctctcccgtgcccggctccctccctcggcgtcgcagcagccgcccctaccgcctcgcccgcgcgccggtcggccgcgccgtctcctccctcggcgtcgcagcagcctcccctccaccggcgtcgccttcgtttcgcgcggaaacccccggaggtgcgtccctgccggcaacagtggtgttgccgccactgctccgcctccagccgcctttgccgcctcgcctttgcaccggccgacgtcgccaccacctccctcggctccgcttcgccgtcctcatctccggcatcacctcctcctcgcctgaagctcgccggagtggcctcctcgtcggtgtccagtacctccccgtctccggccggctcctgttcgtcgccagtacgccgatcgacgtcgctgtctcctctatcgacgtcgcaacgtcgtcctctcctccggctgctcctctgtttcgccggaacgccgtcgcccgtgccggcctctccatcctcctcgtcgccgacgtcccttcggtcgggcgctcctcctcgccggctcatcaccccgctgcaccaccatcgtcggcatcgcagcggcgtgttccacgccgtcctcgtctccgtgcagctactgtcggctgccctcgtcgcctcatcgccggtcccggtcgtcgtcctcatcgtcgtggcattcgtccctccgtcaagccgatcgcgttcgtcgcccgcgtttcgtctagtgtgctgctgcagccccgtcatcgtcttcgtccttggctccgcgtcgtcaagccttgtgtcggccgtgtctcgccttcgtccaaggatcgccgccgaagtcgttccctcgccgttcgcctccgtcgtccctgagtcgtctccgtcgcgcccgttcttcgtcgtcgtacccacgcctcgtcgtgtggtggtaaggatctctccttcactgcttccgtcctcgtcctttcggtgtcgccccgtgcccgttgtgcggctgtctaccccggtacccgtgcaccggtgacggtagtcgttcgtgtgtgcgtgtggtgaccgtgtttgtgtgcccgctcggtagccgcgtggtttccacgtgtgcagcccgcatggtgtctagtggagtccgtttgtcggacacccgtctcggttgacacacggggtccgcttcagacgacccgtggaccgtctctgtgtacccggtctgccgtggtcccttacgacgacaagtgcagaacgcatgttaacaagccaaacttactggctgttacacgctagcgcttacacatgttttatagttgcaaagcctaattacaataatccgtaaatctccatataacaacattaaacttcggatgaccatgtcttggtcatacgagctccgaatcgacctgttcaagtctcctaatgtttgttataacctaaagaaccctatgctttctttttatgtattgttattgtttctttataggcttgtagctttgcttgtgtgcttcgcatagcttctgtcgttccggaggttcccgaagcgtggttcgtggtcgtcgccaaaggttcggaaggctgttctctctgagcaaggcaagtcacatcatccttgagcatattgaatcccagtttataaaattattttgttttaaattaatgcattaccgttttatttaaattcccgcgttatcactgttttatttagccatgcctatttaccttggttatgattttattattattgctattgttattattaccttgttcaccctaggataaacaaaaccccaactagtgtgtactctattcatggttccactagtatgaatttaggtagatgcttcgctgattaattaggcaacattaggtggttttataactttagactttgggaattctcatatcatttggacagtatggaatggttggcttatgttggaattggacacacctccccctcttttcaaaacccccaaaacggttttaggctgggctcgaggtgcgtggttgggttttgttagtcgtacctcgggtactataaggattaagctcaggcctctgttgcaaagcactaccgtacttccacatgtctagttggtaaggcatagtttgtggctcagtctggtcataaacaaaagtacacggatggagatggacgaagtcggggctcgatggacatctctaggacaaatgaaggctacacgagctgcggctcggtagtcgagacgtcatggcacagggccggtgttctgctgctaggggctcaatcctgcctacctgtctcgggggttccggccgtaggcggggttgggtcggtactcttgtttatggctaggatgggttgggaactatgtcacgtctttcgtccgtatgccgtggtggtatgtggcacgtggttacgcgtgaggaagatgtgtcttgtgggtaaagatgtacacctataatcagagtataatctattcgaatagccacgccctcggttatgggcaagcctagcaatgtacccaagttagtgttttaattcttaaaacctgcttaacaactaaaatatggaatggttggcctgggttggcttgggatgagctgggacctgggtctggttgccagttcggtctgaatcatcgtaggccttgggttaaggcaggttcgtatgggttcacggccttgaataataacattgtgtagctctagaatcgtatttataaaatagctttgggcaactaagtgacttttaaatgctgtttactgtaaaacttaacccctattattatccccttgtacccccttgcattaatcatgcatctgccggtgtggcttgctgagtactgtggttgtactcattcttgctctatcttccccccctttagtaagagaagctttggagaagaagtcttaggtgaagtcctggcttataccccagttgagcacctgtgaagatggagacgtaggcccgctagtccgctgctgtttatttttgtttgtcaggcctgaagtgcctttttaataatgtaaatattatcgatataataaagatgtgtcttttatatcatgtttgtgtggtgtaccccggcttttcctgggacggggattaatacactagcgttctggaaaaggtatttttccgggcgcgacaatatgattgtgattgcatgaatgtaatttatttccaaattatatgtacataatcaaacccactaatttcgatgtaattgctttatttccgtccatactaattaatactttctatgtcttgtgtgtatatatatacgtgcagcgatggcattctattttttacacactccagtttcatatctctatgccgttacaccgctggacgtcgaccgtatactcgagtcgctaccggcctatcgtataccgagccgttaccgcaaactgagttaagtctactggtcgtgccacagctgtacactagccataaatcgttcgttcgcacgaagtatagtccaaagcctagttcgttcggtcgtcccgagttgctcattattaatagagtcattttaagccaccgattttgttcgccggttcggttgaccgtttgagtggtctcgtatcacggtgggttgactcgttgagttgatatcccgcgaggcttgcttaccaaagttatatttccattgatctattttgtttaatatgtaataattgactatggttttccggttaatagtaattacacatctcatattctaaaatctatatccaaacaatctgagctccgttttaacccattcaagtttgtagtgaatttgttgaaatgtctagaatccattaaaattggtttcttttgctgtttcaatagccttattgcttgtatttcttgtgtgctttgtttgtcgtttagattccggcagttccgacgctccagtttattttgaagtggttgtcgaggttccgtcagctcaagagcaaggcaagtcatacatacagcactgatcatgttgaacctattttataaaatcccctgctttctattaaatagcagtatttttgaacgtcatgtgggatggatgtctatcgtactcagcctgttgatatctcatgccattgataacttgggatataattgattagatgattggtttaggaatgcttaaccatgcttagatcaattagttcacaatgggattcataataatttagtccttaattatatgatgatgtaccaccatggttattgtttaattaaactaaatatgcttagaaggtgggttgtgggtgcatggttttgctagtcttgcccatgacaattaaggaccggttctcgagaatccctgaaagatataatcatacttaccacaggctagcatgggctccaggctaaatctagagtataacttaacttagctaacatactacggcagtgatagatgcgatggtgccgttcggacctggctttggtctctgttgtttccggatttacctaggcacgagaggggactgcccgacttggctaaaaaggagtagggctggacgaaaagctcgtggctcttgtctggcttggctcggctcggctcgtttgaatttgctaccgagccaacctaaggttttagctcgttagctataatgagccagctcgagctagctcgcgagctgctcacaagctaaacaagtctagcccaagtagccatctatgactcatttagtgaaggagcctgttgacggccgttatcgaccagtttcgaccatcaatattacccaatgtgtgaagactagctattcttgcaatgcataaattccaaataaaatatctacttccactatatactatgctactaacatgtatgcaggagaagcacatataaatggaggagaatcgacagaaaatagaagaatgatcaatcagacgctgtcgagaagtagccttgtggatagatgggctgataatacagaattaacatgagtaaacaagcccataattcacatcactaggctgaggaataaacgaggagtacacttgccaagttctgggccagatggaccagactagggttcggccgaacccctaggttctgccgaaccatggcccagaaattccacaggccgatagttatcgacatccaatggcggttatgaccgtttctacctgaagcaaccgccgtggacacttttcacaaggagggagaaagatgctctttggatgcttcaccatgccacatgtcaagaggagagcaaaaatgctcctaggatgcttggagcatctccacactcccaaggcacctctccacctataaatacccctcctctcattcattccctcacacacctcaagaagaagatcaagagctctctcaagtattgtttagtagttctacagatagtggagtaggaaatagaattgtcttcatagtcctcgagttttcaggagatttcgggtatggctttaatagctttcctctcttcttttgtgagacttattaaattaatagaatattcttctttatacaagttcggtattttattccattcatattacttgagtgctgactttactttatactcgtgtaacaagctttccagataggtgtattgatgtgggtttagtgtccgattattcggttgctctatgtcggttgcaaggatgtagagtagtattttactaatgtaagcgcggtgcttagattattaggtaccactaattggggttatatactgcggatgagaggtgggccgctgatggttacagctaagtacgggtattcctccgcgccagtatataatcctaagttaattacttggggagggtactcctccgtatttagccctggttgtatggtcatgacgggctagggtggcttctcgaaacaccaagaggacactgggtacggggtattggttgcatgactgtataatagcaagtatagactaaagatgtatgtatactagaagtacaggaatgatacttttcttattctttcaccacttagcttagactatattttagagtgagtatttcttagttctttcttctgtgtgtcaccctaccctttgaactgagttaacccctgcatagactttgatgtatataagtaacatataaactattaccatagtactctcttatcatatcttcccttgggataaaataaatacgataccttggaatactcccgggtgaaatgctacaatggtatatccgtgcgcttgcggatcacatctgtaaccataatataccatgagtatttctagtgctattgctggaaattatatttccagtagtgccactaagaaataccaaacaagcatttctggcgccgttgccggggaagataaatgattaagagttcactacttgctaataattttatatttacctctatataagtcactgtcctttgtaggcaaaccttgtttgttttctcttttatgtgaaaacagggtagtacaggactggttatgatctgccaaccaaattcatatctagagtcactggtgaagtgaagccgacctcgtgtcgttcatcctcaaggttactctatcggcaaccagaccagtcaatttcgcgccacaagaattgcatgatacggctgagaagaccctttgcaagtttgctgctccctctgttgggtaacatgctagatggaacccacgtcagtatgggagatggtgctttgatctgaaaatctgcttagtcaagatggcgcaggcttgcacattctgtggcaagcctaaggaggatgcaagtgcttatttacagcaattcctggaaagctgtagcacgtataccgtcaaaggaatcagactccaactgttgccgctctccctcctcgagagagcagaacagtggttctacatcaaccgtgtaacagtgaatacccggaataagcgctcaacggcattcctctcaaaaattttcccgatgggcaagaccaacactcctcgtggaagaatatctagctttcagcagatgagggatgaaaccattcttgaagctggggaaatgctgcaggagtacgtcaccacccgtcctcatcatgggcgtccatcctgnnnnnnnnnnnnnnnnnnnnnnnnctctcgtcctgggatcacctggacgctgctgctgaaggagcacccttctcaaagacggtcagtgatgccaaccaacctgattgagaagatggtctcaaatattggttggagcaaggaacgactccaaacccgtcaacgcggcatgtacaccgtcgaagggatggaaatgctcgccgcccagttggatctccttatgaagagactggacaacaatgagaaggacgccaagcagagtgccgttaaggctttgggctctcacataacatgtgaggtctatggcaaaaccggtcactctgggacggatcgtccggaaacccgtaagaacgtcatgctcatgaacaacaacaatgggtatcgtccacaaggagaccaaggatggagcattgctccatagggtagatcaagaacggaccgaacccacaaggaggtcaaagtaaaaccccgaaggacgaaaagcctcaacactttcatgatgaacttcctggagcgggaagaaacgaggaaccatcagtaccttaagctggcttccaagaagccgggaatacaggtcaggtcaacctgcgctcccagtttcaaagatgccgctgcctgcacctaagaccaagaaggtatggcggattaaggagaagacacccgttcctataccttctgaactaggtgcctcatcgagcaaaatgcgttggaggtacggtcgtgctcgtcggacctgaaacgacgtcgctcttgccaacagataaattggtagttatctcatatttattttccattgcatcaaagcatgtttgaattttcaaacgcacattgagatttgaatttgaggcgatttcttcaaatgaatttttgtgagaaaaataaaatgcaatttttggcaaaatttagcacagccaccttcacactagtcgttggaccccaatggctgctgatttttgcagggtagcggctagcggggcccacatgccattactagccgttatccatgcactatatatgcagctcggctgggagagggaagtcacaccactttaactcattttcactccctctcaaaaccttgcaagcttgcctcaaattcacacaatttgctgtacttagtttaaacactttgcatatacaagtttgctttagttcgatgcaaggttaatcggcgggtatttgcctaacccccgtccgagtagtcttgtattcttgctctttgttgtagctatgaagaaacgacttttgggcatattcaagagacaatcaagctcacggacaagaagacatgataagccgagtacaccttcttccgcggatgcatccatcgaggaggcgtacgttccaccaaggctgtacgacaactccgatctcgacctcgtgggcgaccgggaaatgcaagcctatcatatgctgaaagaccgaacgtgtgctcagacctgagcatacgactcgaccttctgaaaaggataggtgtggatgctgagtttcatattgttcagcgtgctataggttgggataaatttgcatgtgtagatgtgccgggttcccgtttgcttaacatgcagtttttatgtaccttgctagaggtaggtgatgggttaccttccggctattctgcaaggaatatcaactttcttggaagaccttagcttgcatctaggctttgacaaaacatgcaaggttaatttcaggaacacatttcctgattttaacaagcgtatgttttagcaaagtatttcgggtctcatcctgtaaaaagcctagaactagtgacatccataatcctaccctggggctattgcataggttgcttggttttgtgttgtttcctagagctgatatccggataggacgaacttatcctcttgtatgccatggttagaaaaaaaatcagagtttcacctgttcaacccatgatcaagcaatggttagaaaatgtgaagttgtctagtcctgttgagtgtatttatttggtgactcatttagcatgaggagttgggactatgctttatatgcaagtatcttgtatccctgctacccgctcttatgttggtgaggcctacttggttcaatgccacatactcaaacatggtccaaatgattctcttatatttttgtttcctggctatacaaatgagattccgtaacctatacgggagtttcatttgtataactaccaagaactaaccatttctctccaagcggagttgccttgtgatgtcctatgcaggtaacatgacggatggcgagagaagcacctcaggaggcgtcttcctcttcaccaccagagcagatgtatttagacagttgggacccgaccgtgcatgcccttgattggacccaattcatgcaacatgacaccggaggttcgtcctggcagagtgccagcgacagccggtggcatgagccataggagttgcactggggatactcacgctccttcagtccaagtggtcaacttccatcttcttggatgcattgctcagtctcctctcgaggggggtctaggagaactcatccgggggacggatacacttgaactgcaggcagtgaacgagcaacacaccttggaggatcatgtggtacagtcacgtgaatggtagcactctgttggtgcacagctcgcaaacttcaacactatgatgcaacaacaacaagttggcaaaattttgcacggccaccaccacactagtcgttggaacccaatggctaaatgtggggccggttgggtccaccaggggttcggccgaacccctgcatggcactggctagctgcaaatatctgtagggtagcggctagtggggcccatatgccattactagccgttatccatgcactatatatgaagctcggatgggagagggaagtcacaccactcattctcactccctctcaaaaccttcctctcaaaattcattcaaagttttgcaagcttgcctcaaattcacacaatttgctgcatttagtttagacactttgcatatacaagtttgctttagttcagtgcaaggttaatcggcgggtatttgcttaacccctgtccgagcagtcttgtattcttgctctttgctgtagctatgaagaaagacttccgggcatattcaagagacaatcaagctcacggacaagccaacacgataagccgagtacaccttcttcagcggatgcatccatggaggaggcgtacgttccaccgaggctgtacaacaactccgatctcgacctcgtgggtgaccgggaaatgcaagcctatcatatgctgaaagaccgaacgtgtgctcagacctaagcatacaactcgaccttctgaaaaggataggtatggatgctgagtttcatactgtttggcgtgctgtaggatgggataaatttgcatggtagatgagctgggttcctgtttgcttaccatgcagtttttatgtaccttgctagaggtaggcgatggtgtacttcccggttattccgcaaggaatatcacctttctcgaaaagaccttagcttgcatctaggctttgacaaaacatgcaaagttaattccgcaggccggtagttatcgacatccaatggaggttatgaccgtttctacctgaagcaaccaccgtggacacttgtcacaaggagggagaaagatgctctttggatgcttcatcatgccacatgtcaagaggagagcaaatatgctccttggatgcttggagcatctccacactcccaaggcacctctccacctataaatacccctcctctcattcattccctcacacacctcaagaagaagatcaagagctctctcaagtattgtttagtagttctagtgctagtggagtaggaaatagaataatcttcatagtcctcgagtctttaggagatttcgggtatggctttaatagctttcctctcttcttttgtaagacttattgaattaatagcatattcttctttatacaagttcagtattttattccattcatattacttgagtgccgactttactttatacttgaatcaatatagtcgtgtaactagctttccaaataggtgtattggtgtgggtttagtgtccgattattcggttgctctgtgtcggttgcaaggatgtagagtagtatttagtaatgtaagcgcagtgcttagattattagataccattaattggggttatatactgcggatgagaggtgggccgctgatggtgacagctcagtacgggtattcctccgcgccggtatataatcctaagttaattccctagggagggtactcctccgtatttagccccagttgtatggtcatgacggctgtcgtaatgaactcggcagtaaggggtggcttctcgaaacaccaagagaacactgggtacggggtattggttgcatgactgtataatagcaagtatagactaaaaatgtatgtatactagaagtacatgaatgatacttttcttattctttcaccacttagcttagactatattttagagagagtagttgttagttctttcttctgtgtgtcaccctaccctttgaactgactttgatgtatataagtaacgtataaactattagcatagtactctcttatcatatcttcccttgggataaaataaatacgataccttggaatactctcaggtgaaatgctacaatggtatatccgtgcgcttgcggatcacatctgtaaccataatataccatgagtatttctagtgctattgctgggaattatatttccagtagtgtcgctaagaaataccaacagagcccacgtatgtagccaacgagcccaagtgaagtggctaagcccatgaaggaaaaatgcaaatagccctgtagcatctagtcctttactcatttacttgtctgatgtctccaactctggatcgaatcaattgattccttctcttctcgttcacctagtgacgctgcttccttgttctcgttcccctcttgccgattctctcatctcgcgttgccattgattatcatatcttctcgtagtgccgttctaggcccccaaccatcgacgcctaccctattcagattctcctcgccgtctccttcaccggctttgcctcgcggcactcgacctctgccactcaacctctgcttcgccggttgaagcactgccacaccacgccatcatatcccctctgtcggatattcctcgtgtgctttttcctcgttgacctagctagcctgttgccagtagccttcactgggcaacaaagtcgtggaggtcgcggtaccccacctcgtcgccccacgcagcagtcatggctccacctcgtcacctcactagcttggctcacgagccaaacgtgctagctcgagcttgcaggcaagccgagccgagatggggttctagctcgttaggataacgagccaagctagctcgttatagctcgttatcctaacgagctagactgagccgagctgagccgagccagctcgatgtccatccctaaaaaggagggggtgaaacctgaggtgggtatgtttggttagggagggttatataaagggttttttcatgatttccccctttgcagtatcgcggtggtactttggggcatggtaacatatgtagaatcgtgtcttgtgagtaaagttgtactcctctgatcagagttaaaactattcgaatagccgagcctgcggttattgggcggtcaaccagctcaccgtgattagtctcattctagttaatatgacataattaactggtgtagttaaggtggtttggttgggactattgcaacgtggtttagcgttgagcagtgatttttaatattgcttaattataattattgttttattgtattcactttatgatttataaatgctgcttttgttgcaaatatcctatagcctatcctttgtgaatatcttgcatcataccttgttccggacattgaggatccctgtgggttatgaaggaagcaacgtgttttggtcgtgaagattaagtttagattatttgtttatttctatagcatttgtaaaaattatttattatttttgtaagacgtggatttgtttatcaaattatcgtttgtgtactctagctggtcctggacagagattttattacacattctacttggagttcaggtagggaatttctgggcatgacattagctgagaaggaattactggcggctagcttgccatcggctgtgtggccgatggctgtgaacttttggaaattttcattgtcttgaacaattgagccagccgtggcgactgttatccctaattttgcggacttgctctgattttgggaaatggaaagaggagatcaagtggataaataactctcaaccaattttaggagataaaaaaaggctcaactggattttgatataagggcacacaagaattgtcatacaaggattgtctttcaaaggttctagacgctgagtgaggcagccggccgtgctagcttggtctacgactctatttgtggacgggatagaagagcggcaggccgagcgaaaaaaggtaggaatagactgtgctaggactgaaaaggaaaaacttaatgggcttttggctcaaaaccaagaaaaaattttgattaactttttcattatagtgtatagcaatcataatatttcaagttattgctcagtttataataggtgttgtttcactatgaaaaatacatttacccgttgcaatttttttcagagcgtgtacattcccgtgtttgtctgctccggctccacccgaactccggcgcccaatccgccggcctcgacgccggttcgatacccccgatgttatcctgtgggcggaggacctaatcctatctatcctgttccccaacacccatggcaactagccacctcacctctcgctccctcctcgtccaagcccagtaccccatctcacggttcccatccaacctccgcctctccctctcccaccacaagcaaccagccgccgtcgccaagcgccgccgagcccccgccccctcccacccggacttctcttcggtcatccgcggccgtcccaagaaagtccccatcccggaaaacggcgagccagccgccggtgtccgcgtcactgaacgtggcctggcctatcatcttgacggcgcgcccttcgagttccagtacagttacacagagacgccgcgcgcgcgccccgtcgcgctccgcgaggccccgttcctgccgttcgggcctgaggtaacgccgcgcccatggaccgggaggaagccgctccccaagagccgcaaggaactgcctgagttcgactccttcatgctcccgccgccgggcaagaagggggtgaagcccgtgcagtcgccggggccattccttgccggcacggagccgaggtaccaagcggcgtccagggaggaggtcctcggggagcctctcacaaaggaggaggtcgacgagctcgtcaaggcgaccctcaagaccaagcggcagcttaatatcggtgagttgcatctgatgcagcatcactcaattgtacacatggaacatcaactaattcgacagataaatgtctgcaagatttgtttcccccttgggctctggtaccctgttatgtctgtctgtgttcttttgttttctttcctataaaagactcgtgctctatgtgttttggctttctttacaaagccagatcaataataaatattgagtaaatttcacaaaactacaggtatttttgcacaatttatcagaaaactacagatttaagagctttcgcaaaactacagatttagtatgtccgtttattgtacaatctatcacaaaactacagatttaagaacttgtttcacaaaactatagatttagtgtattcgtttatcacaaaactacatatttagtgtcttcatttatcacaaaacgataaatctagtgtctccattatcacaaaactacaggttttaacaaggaaggggatggagaaagaaaaataagtatattttgttattatactcaccgatcaccgtgacatttatctcttgagtttagttcttatcatgtagccgctttgtcagccctttcttgtattcctagtcagtctctcattgccaacttttgcaggtagagatggtctaacacacaatatgttggagaacattcattcgcattggaagaggaagagagtgtgcaagataaaatgcaaaggtgtatgcacggttgatatggataatgtctgccagcagctagaggtcaaattttgctacttacctcagaattcttaaaatgcatacggtgtactactcagttaaattggtgactgttttattttttttttctttatggaccaatgttctagtaactcatctgaaactaatagaatttagaagttgtcttagctctggttattcattagtgaactcctttctgcttgaacttctgttttccatttccatatctgggagcaccttatctgtgactcttccctgattacttcatatcatacatgagcaggagaaagttggaggaaaagtaattcatcatcagggtggtgtgatatttctctttcgtggtagaaactacaattacagaactcgcccaatctatccacttatgctttggaaacctgctgcaccagtgtacccccgcttggttaaaaagatcccagacggcttaactccagatgaggcagaagatatgcgcaagagaggacgtcagttaccaccaatttgcaaactcggtaagtctctttgtttccatgtagttgactcctttaactgcctttcaaattgtggaatctgcaaatttcatagttaaaagaatgaaaaatatatgcgctagttgccaaagtttatttttgaaaatattagtgcctttgcagccaagagtaatgtccaaaataggaagtacctgagggaggttgatgtcgaacatgaaactactacttttatttgtcagaaacacttgaaatgtggaattacagttgaaccaatgctgcttcttttgctgagtgtggtacatattgtctatccacattagcccatcttcttgcatagcactgttccatgtttgtgcagtttgttgtcattgtttacattccattttttttaaaaatttttaaaggaaaaaatggtgtttatcttaacctcgtgaagcaagttcgagaagcatttgaagcatgtgatcttgtccgggttgattgctcaggtcttaataaaagtgattgcagaaagataggagctaaacttaaggtttggtaaatgctcagaatattatatcgttatgttattttgttcaaaacatgattaattctacctttgcaggatctagttccctgtaccttactgtcttttgagtttgaacatatactgatgtggagaggaaatgattggaaatcatcccttcctccattagaagaaaatgattttaaagtggcgagcgaccaaattttgaatagcaaagaagcaggttctggaagtgctctgaccccaattgagctggtcaacaatgccacgtctctcaagaaatgcaacttgattgaaggtgcagaaaaattggaagattccatgaagtctagttttgaaaatggtatgattttgggttctgcatgtggaaaccctggagtatgcaactctgaaggtatagatggaactgagtcctcagctgatgctccaattgaattttctccttcaaattcagcaagggatttagatccatctcaaacatcaacattgtattgccaaagctccctattggacaagagtgaaaatggagagctcattgagatgtaccctgacagatgtggaaactcggaacaatctccagatgtaccagaagctttaacttgtctaatgggcagcagtgatgagattcatgaattggaaactatgaggagaaactgcaaacatttaaacggcagcgatggtgttaacagtgattccatagtcccttcctacatggaaggaattttactccttttcaaacaagccattgacagtggcatggcactcgtgctgaatgaaaatgagtttgctgatgccaattatgtgtatcaaaagtctgttgcttttacaaagacggctccacgatacctggtactccggcatacaccaaggaagtcccatggtacccagaagactgagccagccaagaatgtaaggataaataagcatcttgaagaacataaagtatctgatcatgtcaaaaagaaagaaattgtcatgggaggatcaagaatgcagagaaatgatcacgcacgagaatttctatcagatgttgttccacagggtaccttaagagtagatgaacttgctaaattactggcttaaaggtgatcggtcctttattaaccgaaggtgtgttgcgttatcaaccttgaattaacgtgcaaagtatatacatgtacattgatatgggacgtataaaacttttcgtcaatttggtcatgctgtgtaactgatcacgctttctgcattgaaatgttggaatgtaataatatggaacggcgaagcattttcagacaatgagctctacctatagtgtgatcatctaggttgtgtccgttagctatggttgggaaccttcccacctagcacgcaaaacggatcaattcattagtgcatgattaatcaagtattttaaaatatttaaaaaatggattaatgtaaatttttaaccaacttttttatagaaactttttctaaaaaacacaccatttaacagtttagatgtgcatgtgaggaaaatgaggacttgaagttggtaaagtgttcgaaataacccttttcaaaccattgatcctaagcatatgcctggaagttgaagtaagattttatagatgtagcttactgtaaaatcaagaagttgatttagattttgtgatgaaaatattggttgtttgctgatgaaattttggagatttatagacgattgattttgtgaagtgagagtgttcggttgaccctggcgatcagaccagccaaaccaatggtctgaccggtgggatcttgaccgttgtcggtttcaggttgtcttattggatatggatgtttcctttagggatttgactttaagatgatttctatgcatatggatattgttgttatactaatatgagtcaagttgggacgaacttgtgctcggaatatggtttcttggttgttttacatgtgcaggtgttgcttgaggcctcgggagagtattgctggtgatagattggagttaacttgggagaagttgatgtctaggtatcaacagattataggatcaagatgtcgattagagggggggtggtgaatagacgatttaaaaatgaatggcacctaatcaaaactaacctaagttgctaggcttagtgagggttaagtctaattaagcaactaagttatattttacaaacctagggtgatagtggcttaagtatatctctaagaaagtaaatcacactcctaagttaagtttagcaatcctagagtgatatgatctcaagtatgtctctaggaatgtaaattgcacaactgtaaatgcgacaaataaatgagacaaggagacaaaagattttttaccgaggttcggaaattcgccgatttcctactccctgttgaggcgagcccaactccaccgctcaactagtattaggtttactaactttttgcagagaatgattatgaagtagaggagaatcgacatcaactcggacgataaatcaatcggacgatgtcgagaaccagacttgtgtgtgaataggccaagaactcagaattgacacgatgaattaggccaaaattcacaagtctgcggagtggagcaatagaggaggccaccagccgaaactgggctggattggctagccccaggttcggccgaaccaatcctggcaccgttggatccaggttttggcatggacgtccaggattgcatcccaatgacggttggagggcacttcggacaattccccttccacaaccgtcataaccacctctgtataaggagctcactctcttcacttcaacacacacctcaagcaatagctctctcattcctcccaagtttagtttagtagtatctagctggtgtaatagaaatagaatatgagtcaggagtccggaagccttcagaagagttcgggtatggctctagcagctttcctttcctcttttgtaagatttgtacttttattagaatactcttctatatatatttatggtattgaaatactttccgagtatatgagtaactattatacattatgttcttgttatactgaatataaggctaacttatctgggagatgctttggtgcgggtatagtgtttgcttatgcaattactctatgtcatgatgatgatattatagtagtatctagtagtttagacgtggtgtctagattacgagatatcattatttggggttatatattgcggatgagaggtgggccactgatggtgacagctcagtacgggtattcctctgcgcctatatataatcctaagttaatttcctggggagggtattcctccgtatttaaccctggttggatggtcatgacaggctgccgtaaggaactcggcagtcaagcgtggcttctcgaagtaccaggagggtatcggatagagggtattagctagtatatcagttaactagaatgtatgtatactatgtatattagaagtataggaatagatttcttttctctttttttttccacctagcttagataaattattaccgaggatgagtagaaatgcttgtgtgtcactctacccttggattatcttaacccctgcttagaatatgattatcacaagtaatatataaattattagttgagttctctctacatgatcttccacgggataaaataaatacgatacccttgaaatactctcgggtaaaatgctacaatggtatatccgtgcgcttgcggatgaactctgtaaccataatataccaggagtgtttcggcgccattgctgggaattatatttctagtaatgtcgttaagaaataccaacaccggcccacggagaggattacccaagcctcgatcactaggggtagttcttccttcactccgaaggtggtgaactccaaaccactcacaaccagcgtcggccttcctccgcaatcttctcggagaggtcaccgggcaactactccacaagccgtctaagaggcggcaacctccatgagtaacaagcaatgacgcggctcggagatagctctacaatggaagcaatgcacttgactcttggctagaacaaccttcaaccactacaacggatgaacacaagctcaaatgagtgtgggagaggtgcaaggggtgtatacaattgaagtggatgccaagagagtctccttgctgctggtgggggagtatttatactcccacccaccaaaactagccgttggggggtgaaatcccccaactctgtgtactgccagtctgaccggagttgtgtggccggtcagaccgtgctactctgcaacggctagttttctagttgttgtagggctgtcattgggccccatcggcctggccggtcagaccgcagttgggtggtagaccggcctcggctcggtcagaccgcccctagctcggtctgaccgaatgcggctctggcggctctggatcgccaccccgagagccacagggagaggttccctaggccggtcagaccggggttcacccgccggtcagaccggctgacctacgccggtcagaccgccactaggtggtcggtctgaccggccctggtcacacagcaggcacaacaggataatgagagcaagccaaatctaaatgcataatgacctaatgtggaaatttaaatcatctctttgctaggtcattacccctcttaatagtacggcaaagctataaataaactagcacagtttgattgcccaatacctcgatcaatttagaattcaactactagtttaccgtcatctatactttgctttgcgccatcaatttttagtccatcgataatcaaccatgcgcacacatgatgtgtacctaactcaaaacacataactcgatagaacggttagtccacaattagcgcttgtcattaattaccaaaactaacaacgggggcctagatgcttcaatctccccttatttggtaattgatgacaaacacttcaaacatatataatcaaatataaagcacatggatatatttttcaatgtatagaaaatactccccctaaacatgtgcatatcaatctcaaagaacaaatttggaacaaatgcacatttcaacatagttcaacacaaatacaacatatgatgtgaacttcacatatagatcaatcaattgcataggatggtcacaaatatatcaaaatcacatccaccatccatcattgcacaagttcacatcaataaaccatccaaatcataaaagttcatccatagatcatccaagtcacaaattatccaaagagggctcacaaataataacctaggctattacatgaccacggagggcccaaatctcacaagagagttcaacaaacgataaaaacacacaagatagataatatagcccattacatatagatatagccctcccaacttagcctaatagatatgaggactaacctcactacttctagtcccaacccacctaagatagatgaatttcttctccccctttggcatcaaggaccaaaaagcttcattcttgaggaatagagggaggatggggtataggatagtgagacgaagaggaagaagggtcacggcaacgagaatacacataggcatgtgtgttttccatggtagtcatacgccggtccaaagaagtgacttgagaggatatcctggcaacctcagaacgaatgcccctcgcatcctcatgcattgcctcagccctcatgctcggtagttagcctttgaatgctttcacttaagctatttatagccccaagcaccgagttgaaatagtcctgaggaggcatgccaaagtatgcataaggaggagtgaagtactcattgataccttgaggaggaggaggtgctgagcttgagattgccccagggtggaaagaaggttgcctcatcctaggagtatggggagtgccaagctgaagacgaggcttatattgcttatgcttctttagattgtttccaacactcccaagctgagcttgaatctacctcataatgtagggcgcatggtaaattcattgactaaacgtgcccttggatattgcaatctcttgcattatgaggttcaccacatcaaactgacgaccctgcatgatggcatctatcacatgccaagccacccccttaatatcatcattattcccacatcgagggagaatggtggctctcacaatcctgttcaccacactacgaatagtcatcaaccctgcaactttcccatgggtgtgtcgccttccatcttcatagaactgtgaaagataatcaatggagagcgggttgtgagtatgctcctcatgcagatcatcaccaaagtcaaagcggatgttgagtaacctccggaactgcctcctagagatagagtactggagggtgtgtgacatccacttcatctcactacaatcaccggcaacccacgttgtggcataaaattggcggatgagctcctcatcatagtcttgtgccataatgactatgcaatctatccccacagccctgaaaagggcttgcaagcttgtaaactctagagtctcatttatgttccgccatgaaatccacttgtgctttgcaaaagccctgctcctgtagagctgctcataaatagtcttctggaaggccgtgtgaaaacggggatcagtggtgtctctaggcctcttgaactgatcatgatgccttaggatggtgtactgagcggagttcctgatgttaaccacaaactgaacagaaggatcaatttccatctcatttccttcttcctcatcctccccactgccactgtcatcaccatcttcactttcctcttcaccctcttcccgtccctcattcacatcttgctcttcttcctcacttgctcatattcctctccgctcgactcctcatgctcgcactcgggctcttgcacggccgcttgatgaccatggcgagtgcggggaggcattgctgaatccaaagagcaataaaggaatatgagcaacaaatttagaaaacactcggttaggcggaaagaaattttgcactgccggtcaggggcggtcagaccggtggccaatggccggtcagaccgcccgtagggctgaccagaccgccactaacaagtccagcaaaaactctttcaccacaacacaaatgattctaaataggctaggataattttgcacagggtaagatcgtgaatcaacaaggatacggtctatttcatcaagattggaacaatgagggaaactacccttaaccctatttgagagtaagcacaaaagggagagtgatttaccggttgaaaggagatggtttgcacgaagaacaacccactaatttgtgcaaatccataagcacttcttccttcacctagagttccaatccatggatcaaaaactcaataaaaaaacaaaagaatccatggaatagagagcggaagagcaggagattcacttacggtgtaaccggagtgaaatccacggtcaaaccgaggggatttggtggaggagagtggctagggtttgagagaggagagagagatgagtttttcgagttggggatgagtggggaagagaagagaaggggtaggtgcaggatggagaagaagaagaagggcaaaactacctgggcccacctcagccggtcagaccggccctatgtggtcggtcagaccgcctcacctggtgtcacgtctagaaatttagcccatatttccagactattttgtgtattaaatccctgtccaggaccaggaccagctagggtacacaaaacaataaattaatatacagacccaaatgtaaataaagcgtaaaatacttacagaagaggcacttagtcctcacaccgaaagagaacgacagcagcagaaaaggcgatcctagcggggcttcagctccactccacaggcaaaactgaactagggtttgagccttggtcctctaacttcatcttcaactcagaagcactacacttctgaaaagggggaacaacagcaagactgagtacaaccaccgtactcagcaagccacaccattgatgcagacgtgcaaggggattcaaaaatggcttgtggctatttgcataaaggcagttgtaaaacattttgttgagcaaaacagtaaaactgctgattaattaaggtaacattaaatctctattgatcaacactacaccacgttgaacaggcccaaccaacccatctgaactacagtgcattgggtcgatttattaagtgtgagactaatcacggtgaatctggtcgaccgcccataaccgtgggcacagctattcaaatagttttactctgatcagaggtgtacaactttacccacaagacacagccccacaacacgttcccgtgcgccgacatgccaccatgacatactggaaagaggccgtgataggacccttcgcataaccccctctaaccaatcgcaccacacctcaggtttcacctccactcctcgcaaggcatcgggcagtcccctctcgtgcctaggtgaatccggaagcgacaaaggccgttgcagggcccatcccgctccatcatgcccacccttgcctggatacgtcggctagaggaaagctacactacaaacccagccgttgcccacgctggcttgtggtaagtacgataagttcttccagggcatcccgcgaaccagtccttaattgccatgggtgtgactagcaaaaccatgcacccacagcccaccattcagtcgcattttagttggataattacgaccaatgaaacatggccaggtgtctcgagcacgcagctcgttctgatgctaaaaaggtctaatacttcaattatcccatcaactgagctagtggtaattaagcatggctaagcatatagttctagctgggtcacataagtaacaagagctagtcgatttatcacccaaggttgacaaaggacaaatatcaagtaaacatggcacaagtgagcagataggtaaacccgattcccatgtaattggcaaaacatgcatatttatttgcaaacagtaaaacatttgtaaagtaggctcaacatgctcaaggggaatgtgtgacttgttttgcttcttcacttggatcttccgaactcttatccttgcgatcgcgatcttccgaaacggcataatctacgtgctggcatgcaaaatgaggaaaaactctaataaaaaccaaggaaacggtacataaagagtaaacaaacatgtggatctcagttttagatgaattttgcaagttgaatggcccaatttggagttcgaatgaattatatatgaattttagaagttttgagccatttaaatggatttctataattattattgatttattacgcaattaatgattatttttcacaaggaaaagggggttgctgacgtcagcaaggggtgaggcgtggaccgcgtccacaaaggggtggacccacacgtcagcggcacaagggcgccggtccaccgtggaccgggaccaccgaggcggtccaccaccggtccacgggaatcgacggcccggatcggcccaagccgatcgggcggccacgggcggcgcaacaaggacacaggcacggcatgaagctggcccgggcgagccatggcacggcagcggcacggccaccggcggcaacagccgacgacgccgaacagtggcgagcggccggaagacggcggcgttcacgggcagcggcaatgcaaacggaagggaaggggagcgggaggaggggctcaccgagcgtgtgggccgacgaggcggagccggaggtggccagcgatgggaagaggcgacggtgctcctcaaggaggcgaagcggacggtgctccggcggccttccgcgagcgggaactggcggacagtggccggaagaacctggagaagaagacaggggatttagggagcgaggaggaggcacgacgccgagggaaatggcggccgaaagcggcaaggatcagcgaagctcaccttggacggaggaaagcggtctcccgtgatgattcgtgaggagggaggggtggacgggcagtgcatggtgactgcggtgccggggaaggcaacgacgcagcgcgaggtggtcgggaacggcgtcgagaggcggccggaggcggctgctatggtggcggtttgggtggtgtggtagagtgacggttctagcggcggaatggaggagcggaggggatgccggggtacgagacgacgcagtgaagccgtcggtggcggttgcacggagcggtgtcggcctgctggagggcgtcgacgggcggcggagctcgggcccgcgctgcggcggtgtttcggaggcggagagggtaaaaggagtaggggccggggtgcggcacggcacggcgatgccaatggtggtggcggcacagcgtggcggcgtgcggctagaagcatggcggcgagcggcggagctcgggctcgcgtgggaagtgcgggagaaggcacgacgggctcgggaaagttggggaaatgagcgaggggagtgcgggaaggagttttatgggtgcgggacaacgggagggggccggggcgatgcggattcggggcagcaaccaccggcggcgtggggtggtgacgtgggcacgtggcggggcaaaccagcgcagttttcttgggggaaaattggggaaatggtggaggaggtgggggggtgcagttccaccacttgggcttgagcaggaagggctgggtggtgcggattttgcgacggagtaggcagcaatggcggccacgggcggttactggcgaggtggctggaggaacggggaggagctgacaggtggggcctcgggtccacctgtcggcgagggaaggagagaggaggccggggggcttatgtggacttagggagagatggggagcaagcgggccgagcggcccaaagaggagaggggagggaggctgccgggctggagggcaaagaaggagggagagggattgggccgagggcggcccaaaaggaaggagagggaattttcttttttttctttttatttaattgtttaaatgaactttgtgactttaaaattatttcttgagctccgaaaattcgtggaaaaatccggagagtactttagggcacagagaatattgcaaaatatttctggccaatgatttttatgggaaaattttaagtctaccattatttcacttgattaaattgctttaacttttatttaatttatagaaaatgatttattaattgatttttaatcccgaacgaaatcgaggtgttacaaatctaccccccttacaggaatcaagtcctaagattcgggtatggttagaaagaaagctgggtgtaggcggtctgatcgatctggccgatctgcacactgcattgatcccttttgttttaaactgactgatggactgaccaaccagcataacttaactgaactgactggcatcgaccattctattcttttgctcaaaacaaccgaactgactgggattcgaccctggagttctattgcttcgcaaaacttaattgattagctctactcgatctgaccctgacctgaatcacgagggctcatggaacttcctgtccctgtactgaactgctagcattatcaccttttggtaacctgagagctcaccaagcagactagaaattggcagatctttcatgaaatcttgtatgtgagcctgcatgaatgacagattctaactttactttgacctgctcctgactaccagaactattctaagaggctgcttgaccggtctttcgtctgaactgcaactgtacctgatgttacttctctgatgtgaattgttgtcctggcctcacgggtgtatcttagaattcaatcggatgacttgagatcggcatgactctattgacaccttgtagctggcttcttcgagtactacctaaattgttgtactgggttgaatctttaagggaaatggcgacgaggtgaaccaaaattcatctctgcgacctaccccccttacagagagtagtcatactttcgggtgaccgggaataattgaactattgtccttcaagaacaatcgacacttctcggatttacgaatggccctgacattgaaaacagaaaacttcatcgatcaatcaaaataaagcaatgacgatgcactttcatccaggtcaaggcttggaacttaaccctcagttgctgataggaaattccacataaagaaattctcatttagctcttgatcttactaactcttgactacttcccaatcagttctactgctggcatatttagcatgcttctggcctgacttcggtgtcatatgcttgaacagattgcatagtcgacattctttgaaacacatactgaccacttaacagatcaaactcaagagtccttctcatgacataacatcacacgtcgattattcttttgctgactcttcctgtattgatgaactgtaaaccctgcaactgctttcccaaaaatattgtaatctgcacggctgccagaaactgactttgatgctgtcgagagtttctgttctttgatcataacaacttcgctttcatatcttcggtaaagctgatctgtcgaaaagaggttctctgccacacaccctgctgactacacatttctgaacctgattcttggatatttcttgcccatgtatggaacaatttctgccaacttccgagaaacatcatgaggatttctagaattcgtagtggttccttcgaacatatggagaaccatccatgattcataatcgtaccactagggtgtaattgttgcttaccattctctaacagtttccaagggtagagagttcccaagattccttgtatgatgttacttctgaatttttttttcattactccctacacttgaatacccttgatactacctttagagagatttcatagtgtcgagcgctatggatccaaccattgtcacttccttggttaatcctttctttactcgctcgcaaacaggttttggagcacaacaaaagtgcgatgagttagaagggaaactcttggtttcttgtaacttgcagatacacatgttaacttgcttttgcatactcaaaggtgaaaagaagagaaacgcttgactcctactctattcaatattcccttttcaactatatcactggattggaacttctatgcacaaggaaggtatttgaacaccaaaggcctgtgcacaattgttgactcttgctgacagaactgctgatcagtagcacatttacccattgtgattctgacatggttgacttgtccttttgttggttactagctgaagctcccacaagaacaaaactttgactgatgacgttcctaagacaaacatcaatcctcttggtagctaaaaggaacgagaccttctcactatcggtgcaactcttctgttaatttcttgcgagacctctgaattggagcagtatgagatgcatggctgatgttgacaaccacattgaagtctgatgcttgagacattgattgcagtcgctgctgaagaattgagccgtctctccgtagctaaagtagatcactgatttcctggcttcgtctgctctgctggtgctgattctgtaatcttgaagtgattgctagagaaacaatagagaccttgtcagtgcacttaatgacaattcatcatgatggaaactttacacccaagtgacggttggtagtacttctctttctagggtctttggactggatctgaccacttcatacaggaactgatgtaacttgaggagacaaaggagttttaaccatgttgctgacttgatgagactgacgctttggcgctgaacaaccttttgagagatgataggtcttccaacaattggaaacaatggtggactatctttcttggtctcgagagtagaccattactgaggtggtgtcccggctcaaaacgattgagacacttctcacttgatggatctttgatgtgcactctttccgctgtgcatgctcccaactgaaaccagagtagagaactcataaccttggtgacaatgttattactatcactgtggg

SEQ ID NO: 30117 - DNA, 19297 bp, Oryza sativa
agtgccctattgtcggtcgttttgacaaataagtccaatgggtgattgaacactttgtaagaaactgcccttgtacaccataaccaccgtgggtagcacttgctgcttcagggatcgatggtggcttagctgtgctggtttcctcaggacacgactgtacaccggcaggggttgtaggtgcttccattggacaacaatggcgttgactctgactccgactccgggcttgcacctgagcttgtatctattgttggggacactgtcgttgcatctactgcattggactctgcggtggctgcatcaatctatgacacattgttggtaattcttacggtcacagataaaatccgcaagcgcacggatataccgatgtagcacttcgcctacggagtattccaatggtatcgaatccaaggaaacgtgtgtgatcagatcttcctccggttaatccaaggacaccaagcaaatgataggccaggatatacaggattttctagtgagaaacagtgtctagggaaagcttaactttaatcctaatgcaatacttcaggcactggcaatccgctgttcccagatgtcgctctactatgcacccggacaggaaggacttaagtgatcttgagggttgtcaccacctctacacctacctcaaacagagtgtgggatacgcagccattactatattgaatattatattgaattcagagtaataaacagaggagaagattaccgacaactccggaattcttccgacttcttctactctactctcttcctattctagtatacaatatagtacaatagagcctcttataattcagctcaagcttggaagtgtgtgtgtgtgaagtgagggagtgatgtccttttatagggcagttatgacggttgtgagaaggggaaatgtccgaattgtcccgcaaccattattgggagagcatctggagcgtccacgccaaaccctaggatcaacggtgatcggggcggtttggccgaacctgggctgggccctcctagcctagccttcggtcggtggactccctagactctcctctgtctatttctcggagttttgggttgatttactgatgttttgatgaagttcacaacccttccttgtatggatacataattctcactttagtctagatttcctcccaacatcagggtttatcatctgcatacaaatatacaccaacacttgtggaatatgtgagattaagcacctatcactatgttggatgttttattatctaaactttatgcagatgggatttttataaattttcgcaaacaagctcttttcctcatgttgacttcctctcttgtctctcaaggatgtatattttctttttggatcctcaatcaaggcaaagtgtgccaaaatctaccctattctaaggctgatatgtggagcttggtagggataaattgtgacatacttgcatcatatatatattgtaaagctaaaaatacggactcaagaagatcatcaatcatacttctagatcaagagtctttatttgtggtgaaaaaaaaatggaaaagtaaaatcttttgtggaataatggaaatgattctcccctttttcctatacttcctcctcccttttgttttcttggcatgaatatggaaggggcatggctatattttctttccaactttgctcaatgatttgggagcaagcatttattttcttcttcttttttttatttttttttcatagtcatgcctttcctccccttttttttcatttttctttttgccgagaacttttttaggagaagaaagcatagtctaatgtagaagtttattcgaatggaatttttgtggaaaaccaacttccagtttagaagcttagcttaattatatatgtggagaaatggaaatggaaatgaccccttgatcatgggagtacgaaagatatctcacacgagtcacctaaatttaacaaagctcaatataatgtcaagcagtcatatgcatgataaggttcatcaaagatatacttgcatatggccttggtaggtataaaatgaagtcaattaggaggattgtgctttttaaaatgattttattttgtgaaaaataatttcccaagagtcataacaagagttacaagagttcccttcatcttgaatcatctcgcataaagcaattacttagatgcataaggttccctaaacatggatggttgttcataagcacaagttcggctgagaataatgaatatacaagatcaatcacatgaagaatttcattagttggaaattttatctttcgcttatgcttgaaccaattgttttctgaattttcagctcaaatactataccatggtggagatatacagataaaagacgtgctctcctgcttacctgtgaaaactgggaggtattggggccaacactggttcggccgaactactctggtgcccaatacctctgcaattttttgcagagttcagtgccttccaggtgtttagacattcagtaattttcagattatgtgcacgtcagaagctgtgatatctcccccatacttattaaacatgaaacaaaacaaattttgacaaacattggggttaacaccaatgagctacattattcatagcaagtgcttatatgattggaaaaacaaaaaccaagcacctactactattttactcatgggaaaggaagcatctagttagcataatacttattttcctttcccatttctacgattgcgcgcttgattttagcgcacaaaccgtgactaagggtgtcgaaattatttctaatttcagcaagctttatccctagctccgcgttgcgatccctaatctctatgttctctttgtggattttcttcacttgtgcgcgagcatatggatcgagggctccggcgacttcacctcatcttcttgatattggccgggagccctcacaattggagggggcgtcaagtgatgcttaaccttcataggtggaggtctacgggattctgctgccccctccttctcctatgtcgttaaaggccggagtaaacccttgccatacccaccgccgggagttcgcactccctgaatgcagaatcgctcctccttcggagtggatggagtagcggtgggtgtgacatacttatggaacacctcattccctgccttggtgaacagggtgcccacatagcgctcggcgggaggcggcgcggccttcccgtcatcttgaaaaaggcaacgtgcctttaaaagaccgagctctcccgttgtcggccgacgcgcaggcgaatccccccgaaattttgtctttgtgacatggcgaggggagagggatcttgctactgaacggggagccgaacggggctgagaagggttcggccgaaccagggagctcgccgacgggctccagaatcgcaggggagcccgacactgttgcgaggggctgcgcccacagtgcattcaccccttccatggtgtattgctctacagggatcaattgattcgccggtgtcggctctccgtcaaggttgtgtgtggagttggaggaagagccaatgaatgggatcaaagatttgccagccattggtgaattagaggtgatggagaacggaattgagatgagaagaagaggaggtttgcaaaagtgggagagaggaagaagaacagggttctgggtctgatacgactgatctacctccgaatgcgcatcacaacatactatagacaagcgggggagactgaggttcaaaattggggctgatcgggcgcctgtcacaccctgaaaatcgctaagttataaatcgttgtgaaaaaaggaatttttagaaattatttaataattaaagtaattgtgtgaataaaatctatgaaatttttgaaagttaaattgatatagataaaattttattaaatactttgtgtgcccaagtattttcaggatttttcttggatttatttgagcattggaagtatttttaataaatgaaagatcatttcagtaattatttaaattaaaaagttgattaaaatttctcttctgtccactcctctcctgtctctcttccttagcccgcagcagcccactcttcctttttgtcttacttagataaagtccattttgggtccctcttgcaatcaggcctagtaaagaaaaggaagcccgaaaagaagtctatttgacagagccagttcatcccgataccgcgccaatctccaccgaatccgtcgcatcccgtgctctgtttccaaaattggttgcaaaaacggattcccctcgatctcctctaccttgtccctaagaaacccctttgaataccgttgtatatcgcgtgaattcgatgcggttttgagctccgtttttccggcgaaccctaactaatccgtcgccgattcttcccgtaaccgagccgatctctccctcttccggctataaatagcagtcccaagacctcctcttccgtttgctcctttttcccgaatttttccctaaccctagagccgccgccacgctcggctttgctctcttatgctggccgccgctccagccacgtcgcgccgcctcctcggtcgaccccgacttgcgccgtcgcctcccttggcttcgcaagggtgagagctacctcggccactggttgttttgcgccaaatcccaccagaaggttgccgtcgccgtgaaccagtgggttattgccgtggtttggtctccagccgtgtcgttcgtcgtcgtccatcgtcgctttcggacgccgttgcttccactggattcgcagctgtgaggagaagcccgtccacccctccgttgccgccgcttgtcgccggaaagccgtcgccatcgtcaaccaaggtcgccgccctttggagctcatcgccggccatctccctcgccgtctgtcgtcgcgtaagtggtggtaagggccgtgcttagaaatattagctcattaatgggataaattatgcttcactattacttatggttctattaaatggtagctcacgatgggcaatcgtgttatgataattaattgataattaaaatatgattaatggtgggttgtgagcacatggttttgaaggttgtgctcataacaattaaggaccggttcgcgagctactgttgtgaaacattaaccgtgccaaccacaagccagcgtgggcaacggctttaccttttgtatagtatggttcattacggggtgccagactgagaagtggtggagataagcccacgggggtcgctggggagtccatgcctctggtttttgagggggtgactacgatccaggaaagatgcactgctttgagttgagctatgcgagaggtcttgtcacaactacacaaatggtgacatgttcagcatgggcacatgatgatatggtgacatattgtggagttgtgtcttgtgggtacagtggtacacctctggcttgagtaaaactattcgaatagccgtgcccgcggtcatgggcgggtctaacaatgtctttcgtgattagtctcatacttcttaccataataaatgatgctataactggtaataatttgattagctcctggtttggaatggtgcattcctggtttggagatagatctttacagccgggtatggttgttcaggttggttgggcctgtgcagcatgggtgtgctgttcagtgttgattaatattgatgattaattactctattcttttacaattcttaaatgtttgctaaatgctgcttttgcaaatgagccatatattttgccattgtttggtatccttgtgcacctgcatatttgctgtgtggcttgtcgagtattccatgtactcaccttgcaataatcaatcaaacctcggttgaagacaagttgcgaaggagaagacgtttggcttataccctagttgagctgcctgtgggagtagagtcggagcttcgctagaccgtaattccgctgttgttttctcttttcttttgtaagtatgtaacgttattattatgatgaatctgtatattaaattatcggtttgtgtacctcggctgattcctggacgaggatttcatgcacaaattagttcagaaattactagtgaatttatgggcgtgacaagttggtatcagagccatctcgactgtaggataagtcaaatggtcaaactttaaggaggaattttccgaaaacatgatttgtgaaaattttcctttcttccttctccagaattctctgtaaatcattttatcatcctctcccctcccgctttcaacttgagtagttctgaaactagttgtttaaacttgaagacatcgatgtggtcttcttatggagattgagtcaagtggatcgaggaaaatgaagttgatggtcaatctgaagtgcccaaatgtcaagatgggatcgtgcattagaacctaaaccaccaaagtgactctaaagaatagttagtagggtagaacgtttgttgcttgcttctttgtaggtattgttgcatttcccatcattggtgttgttcagcgatgagcatgtaacgatactaggttgcttgtttaatcaacttaaacaatataatggtctacatacaccagattagtattaacctggttaaggtctgtctttagtgtaacccctctctttctatcttctctaatctgcaacaaatggtgaacattcgcgccagtggaagtgggaacaataacaatgaagggaacccaactcttactcaagttcttgctcaacagactcagttaatgaacatgatgatgcagcagatgcataaccagctcaaccaagggtacaacaatgctccactaccccggagcaagctagctgatttccttcgtgtgaggccacctaccttttctaagaagcaggtgattggctgcacactattgagaagaagttgaaattgctccagtgcactgatcaggagaaagttgtattcgcttcacatcagttgcaaggatctgcttcagaatggtgggatcactttcggatgaacagagcggaaggacaaccaatcacttgggaagagtttaccgaaggattcaagaagacacacatacctgcaggagtggttgctttgaagaagcatgagttcagggcattgaagcaaaaggatcgtaccgtgatagagtatcttcatgagttcaaccgtctagcacgttatgctctagaagatgtgcgtactgacgagaaaaggcaggagatgttcttggaaggcctgaaggatgaactgtcagttacgttgatctctcatgactatgctgattttcagcagctagttgacaaagcaattcgattggaagataagaagactaggatggacaaccgtaagagaagaatgactgttttccaggaggcacagggtagtagccagaggcagcgtatcaagccactccaagttggtgaatcaggtctgacatctcaagaacaatcgcaacagatgaacatcggtggtgagatcaattcagagactaatgcaagcaatgaagttaatatcgagcaagctactcagtcggagccagttcagcaggatcagtctcaagaaggtaatagtagtgcaagggagcagcgggtatgttttaattgttatgagccaggtcacttcgcaagaaagtgtccgaagccaaagcatcagtagccgcaaggtcaagtcaacaacattgtcgtcacaggagccaatgcagtgccagttgcgtcttcaagtgttacagttcagccaccagtctcaaatcagcagtagttttctttaaagccttagaataattatcggagttatggaataggatagactgtagtttagccgttccgaatcacgggacgagattctttgtaaggggggtagatttgttacagcctaaatttccatttcaggatttataaattgttaatagaaattatattaaatgttcattaatttacaagtgaagttaaatgtgggaaataaaatttcctaagtataaagcatggctggatttaatttttattaaattctctatgattaattatactctctggaattttctcgaattttccagtgctcaattcctaaattctaataatacaaaaaatatttcagtaattcgttaatcattaaattaatcaattaatgatctaattataattatgttaaatgattttcttgtttaaaaatccttaaattataaattgttgtttaaaaggaattattagaaatgatcttaaaagcctaaaagagaatttctaattttaattctctaaatatcaaaataaaagtgggctagataaaattttattaaatacttctctcatttctatagttcctagatttttctgggatttatttgagcaaaggaagtatttttaataaacggaatatcatttcatgaataatttaaatagaaaaaggttttaaatctctctattggctttgggccgaaagtcggtccaagtctctctctccccggcctgcgtgtgctcggcccagccggccaagtccgccacgccctcccttctctctctcagccgctgataggtggggcccacctgtcagtcgtcttcaacctccggccgctcctagccgcgttgcaagccgccgcctccttccaaaatccggccgccaccttccttccccggccaaatcaattgaggggaaataatctcctcgatctcctcttccttttctcttttggaaacttcggctaatttcgtttggaaaccgacggatttgagctcgattcggatcgatttttcttcctccaaccatagctttccttctcggcgccgatcgccgtgggcctccatcgacacacctagacccctatagaaggacctccgggacctcctctctgcatcaccatctccaccttcgactgccgccttctctagcgtcgcctccgcgtggttctttgtatcgccgccgccggcgggtctccagtcggtcccgctgtcgcttcggtcatcgccgtcggtcgccgtctccttcatcagcatcgcgatgtcgtcgccgtcctcgtcccgtcctccgtttccgccgcagatcatcggagcgccgccggcaccgtcgactcgaagctctccaccatcatcgtcgatccagccacaccgcgccgccgtctcagccgccgccttcggtcgctgtcgccaccgtcgagatcgcaaggaggagccgcaccttgtccaccccttcgttgccgccgtttcccgccggagcactgccgtcaccactgactcgaagaccgccgccgtctcagccgccgcctttgtttgccgtcgcccaagtgctcggtgagttcactgtgccgatccctacctgttggtgccctccgtttgtgctgacgagcatagtgtgccgagccgctgtcggcgatgacatcatcgctgatgtcagcgctttgtcagccgtagacccgtggtagaccggatcgatctcggccgtccgattcggtcaagtttaggtcaattagatcttggccgttggttccgtggaccgcttctgtgaacccggtttaccgtggaccgtccttgatgacgcaataaatctcttttccttttcaaaaataattctttattgcgccataattcaattaaaatccatataaatgctttaatgcggtttattctttagaaattcataactaatacattgtaactcggtttaatgcggttcaagttgcaaaagttgtataaaataaagatctatatattaaaattatcaataaattgtgttaaatttattcaatcctttttaaataggctttaattatatttaatcttgtaaaattggtaattaattcttatgaagtcagaatgaggccgttcaagtctcataattgatcaaaaattttgatctacatgtttgtttactttatatgtattgtttatttggtttttattagtcttttttctcgttttgcgtgttagcttgtcgtttccgtcgttttgaaggatcgtgagtgcgtcggaagtattcaagaagattaattgaagaccctttattgcaaggcaagtcacacagatcccaaacacaattcctttgagcatgttgatcctatatttaaattctctatttatttcaactgtacatttattttcgaatgtcaccggctggtgtgaaactattcctttgttatggccactttgcattgattactctatcctttgataccttggattacaatttgactagttgtacttatataatggttcaactagatgtattagatgtaattgcttagccatgcttagaaacattagcacacaattgggataactaatgtttcactattacttaatgatggatatttaattgtatctcacgatggttaatagtgattggttaattaattaatttgccaactaaaacttgataatggtgggatgtgagcacatggttttgatagtagtgctcatgacaattaaggaccggttcacgagtttcggttgtaaaacattagccgtgccaaccacaagccagaatgcgcaacggttggacactttgtatagcaaggctcattgtggtgtgccagactgagaagtggcggagataagcccacgggtgtcgctggggagtccatgcctctggtttttgagggggtgactacgatcctggaaaggtgcgctgctttcagttgagctatgcgaggggtcttttcacaactacacaaatggtgacatgttcagcatgggcacatgatgatatggtgacatattgtggagttgtgtcctgtgggtacagtggtacacctctggccagagtaaaactattcgaatagccgtgcccgcggtcatgggcgggtctaataatgtctttcgtgattagtctcatacttctcaccataataaatgatgctataactggtaataatttgattagctcctggtttggaatggtgcattcctggtttggagatagatctgtacagccgggtatggttgttcaggttggttgggcctgtgcagcatgggtgtgctgttcagtgttgattaatattgatgattaattactctattgttttacaattcttaaatgtttgctaaatgctgcttttgcaaatgagccatatattatgccattgtttggtatccttgtacacttgcatatttgttgtgcggcttgcggagtattccatgtactcaccttgcaataatcaatcaaacctcggttgaagacaagttgcgaaggagaagacgtttggcttataccctagttgagctgcctgtgggagtggagccggagcttcgctagaccgtaattccgctgttgttttctcttttcttttgtaagtatgtaacattattattatgatgaatctgtatattaaattgtcagtttgtgtacctcggctgattcctggacgaggatttcatgcacaaattagttcggaaattactagtgaatttctgggcacgaagattctattgtctacaacgaacaagatcgcataagttaaaaatgcatcggcttgtagttgataaaattaacagaaggtgagaattttaccagtgggacatcgtcagggaaaaggtttgtcaaatacatggacggtgattgatggaacaggtgttttttccattctatccaccatcggtcaaaggccatgctcctgaatgtccttagtttgatgttgtcaatattgccaagaggtggtcctggtagattcagcagccaatccatcatatggaatgatgaaatctctcctctactttgaatcctgtcggcaaagaataggctaattggcagttgacccatgccgaattgccttgcagcgcttgttggatgatagaattcgtaggtcatctggatattcttatcttgatagatgccaacagggatgatacaggggctgatagctgttgagaatacttctctggatttatcatatttttcagagttgatttcatcgaatcgaaaatcacatgttagttcaaagctagcagatccttcatatgcaaaccagatcctatcattcttggggaacccatcatagaaattgttgaaccactccttgaaaggttcggtcgatagcttggacacggcgctaaccgatgctgcttctccgaaggacatacatcatcagcatgtggtgcttgtttctccatcgtccctgacgatcggctcaaatcttgggaattctacattggctagtgctggctgattggcaacttttctggtatgaagattcagccaaatttggagtaaccacgatggaccccctgtgccgattgtttttccagaggctatcttgtcaattgcagtattgagggtctgatacaagtagcccagcagatacttgccaaggggaaaatgcttcttttctaccagattttcatctacccgttaccagtttgcggtcggaccataggttggaccacagaataagaacttttccagccacatcataagaaaagctgtgttcatggcaaccggcccagtcacatcactcttggggtaaccggcctagttcccatcttcttggcaacataacctgaccaaccacctatgcttctggttttgaactcatgggtaagttaggtgttcaggctggacaagttagctgatgaagtgatatctagaccagtgatcatgatgatatctaatagtattggggtcatcggtccttgagagaaaaggaacgtgttcatggctgtggaccaaaaataggtggatgctatcatcatgggttcattccttgccatacttgctgcagttaaggccaaagcttgcgatatgtcgatttcgtcccagtgggctaatttgctagccaacatcctcttgtaccaggcaagccagctgacttcggttgatggccaggatttgaaggtgcctttccaagggctaagatctggattggcaaatctaaaggggattcggttggtttctccattgatgaactctatggggtctaagttgccgattgggccaaggaaaaactggaattcatcggctacgctaggaattgcaacctggtgggtgagatgctacagaggaggaaaatcgaggattgagcgaaagaagaaccaaatctatgaggaaaagaagggatttagctgatgggtacttacttcgacgtattcggtggccgatgagctcggtggactagcgaaggttgacattgtcgttggcagagattggaatcgtcggaatcgtctgcggatcgccagaaagcttgaagggtgtcgccggagaactcaaaggagaatattggggaaagtttttggctagagcggttaaaacggaagtgacgccgtgaaacgagaagagcggtggttactatttaaaagggagcgctgtaacggccaaaacggaatcggtttttgaaaccctagatcggctcggaaaagaaatttgagaaaatccgccacattacaaataattacaaatatagcggacttggggggcatgtgttgacgaccaaatttggtaagatatgaaccaggttcgacattggaatcgaggcggattcggtaaagagatagattcgaagaacagagtatgcatcggctgcaaaggcatcggctggagtctgcatcggctaagatggatcggacagaggacatccgatacagctgatagaggtgatgtagccgattctgatgacgatggtttcaaggatttttctagaaacgatcaaagtgcttcacgaggattgccacgatagagataaagctcttggataggaaattgtatctattaattaggatatttcatgtaatttccttagagatatgtttgggcaaaagtctgccgcaaagacttatggtattttagagtttgttagagataagtgtcgtgtccggcagggacatattttgtaatctcgggtataaatagaacccgaacccatgtaatcaattatcagacgatcaatacactttcggtgcatcgccaccctttttacttttgttctatttcgacgagttcttactttcgggttgagcttcatcgattcgatcttcaactagaggtaaacttgtcatgacggcttgcgttatcaggattagtgcttccatctttatgacactctaatcctgttcatgtaattcatcgagttatcataaatataatctttgtgagcgtgcgggccgacgaggcggagccggaggtggctggcgatgggtagaggcggcggcgctcctcgaggaggcgaagcggatggcgctccggcggccttccgcgagcgggaactcgcggacagcggccggaagaacctggagaagaagacagggagtttagggagcaaagaacaggcacggcgccgagggaaatgttagccggaagcggcaaggatcggcgaagctcaccttggacggagggaagcggtctctcacgatgattcgcgaggagggagggctggacgggctacgcacgatgactgcggtgccgaggaaggcgacgacacagcgcgaggtggtcgggaacggcgtcgagaggcgactagaggtggctgctatggtggcggttcgggtggtgtggtggagtgacggttccagcggcggaatggaggagcggaggggatgccggggtacgacatgacacagcgaagccgtcggtggcggttgcgcggagcggtggtggcgggagcaacggtggcgaccggctagagggcgtcgacgggcggcggagctcgggcgcgcgttgcggcagtgtttcggaggcggagacgggaaaaggagtaggggccagggtgtggcatggcacggcgatgcaaatggtggtgcggcgtggcgcgacggcgtctggagcggcagtggcgtgcggctggaagcacggcggcgagcggcggagctcgggctcgcgcggggagagcgggagaaggcccgatgggctcaggaaagttggggaaacgagcgaggggagtgtggggaggagttttatgggcgcgggagggcgacagtgggctggggcgatgcggattcggggcggcaaccaccgacggtgtggggtgtcaacgtgggcgcgtggcggggcaaaccggtgccgttttcttggtggaaaattggtaaaatggtgaagaaggtggtgggggtgcagttccaccacttgggcgtgagcgggaggggcggggtggtgcggattttgcgacggagtgggcgacaatggcggccacgggcggttgctggcgaggtggctggaggaagggggaggagctgacaggcggggcctcgggtccacctgtaggcgagggaaggagagaggaggtcggggggcttatgtggacttagggagagagggggagcgagcgggccgagcggcccaaagaggagaggggtgggaggcggccgggctggaggggaaagaaggagggagagggattgggccgagggcggcccaaaaggatggagagggaattttatttgttttttctttttatgtaattggttaaatgaactttgtgactttaaaatcatttcatgagctctgaaaattcgcggaaaaatccggagagtactttagggcacagagaatattgcaaaatatttccggccaatgatttttaagggaaaattttaattctcccattattccacttcattaaattgctttaacttttatttaatttatagaaaatgatttattaattgatttttaatcccgaacgaaaatcggggcgttacacctggccattcagaccgggatcagaccgccaggcccgctgccggctgtgcacagcccttgcacaagccggcaacccccacacaataaaatccaacaaaaaaaatttttttggagcaattttgaaatgtatgagttgaaatatttcttatcatccataataattgaaaattatgaagacttgcaactaaactcacttaagtgctaggaggtgacctattatggtctatagggtttttttggctaaactgattttcaaataacttttaaatgatttggtttttgaaatagatttgaataccaaaaacatttgaaaccttctcctctaccaactttgtttaacacttttctcaaattcctcctcaaactcattttgaagataaatcccattttggccaaaaataaaaatctagtttcttcaaaagaggaccaaaagggcattttcattgaaacttcatttttcttgcaatgtgaggcttggaaaacatatggggaaccttttgaaatatttttcaagagatagttttcaaattactttgattttgcaaaagttttgacttatgttgacttctagtttatttgctcacacacaaagagagttagagcacatgtaagagtgcaaaactcccccttaatgtgacatgctccattttcgcaaataagagccaaatgacaataaatccaaagcataagcacaaataagagcaaataggcaaaatgaacaagaagcaaccatcgtgcacaatctcaagccacattagagaaatcaatcacatttaactcattcctcaatttgcaaaagtgggtttcatcaagaggcttggtaaagatgtcagctagttgatcctcggttcttatgtggctaatgactatgtcactcttggcaacatgatctcttaggaagtgatggcgaatgtcaatatgcttggttctagaatattggaccggattgttggctatctttatggcactatcattgtcacataggagtggggttttggtgaaggatataccatagtccaacaaggtttgtttcatccaaagcaattgggcacaacaactacccatcgaaacatattccacatcggcagtagagagggctacggagttttgtttcttggatgaccatgacacaatggatctaccaagtatttggcaactaccggatgtgctctttctatccactttgcaaccggcataatccgaatcggaatagccaactagcttaaacttagtacctttttgctaccacaagccaatagttgaggaatgctttaaatatgttagaatccttttcatggccactaagtgacactcgttaggagcggcttgaaaccgtgcacacatgtaaacactaaacatgatatccggcctagatgcggtaaggtaaagcaagctaccaatcatagaacgataaagctttaaatctaccggtttacccccctcctcctcatcaaggtcgagatgcccgttggttgccataggtgtcttgatgggcttcgcatcctccaagccaaacctcttgagtagatccttgatgtacttggtttggctcatgaacgtcccgtccttgagttgtttgatttgaagttcaagaaagaagctcaactctccaatcatggacatctcaaattccctagacatcatatcaccagactccttgcaaaatacctcattagtagaaccgaatatgatatcatcaacataaatttggcaaccaaagaaatcatcaccaatgatttttgtgaaaagggtggtgtcaacttttccaattttgaaattctttgacaaaagaaaatctctcaatctttcataacaagctctaggagcttgttttaaaccataaagagcttttgagattttataaacatggttaggatttttagggtcttcaaaaccgggtgattgttcaacaaagacaagttcggcaatttcaccatttagaaaagcacttttcacatctatttgaaaaagttttatatcaaaatatgatgcaaatgcaagaaggatacgaatgggttcaagtcttgccatgggggcaaaagtttcaccgaaatccaagccttcaacttgtgtgaagcctggcgccaccaatcttgccttgtttctcaccaccaacccgttctctcttgcttgttcctaaagacccactttgtccctatgacattgtggtctctaggtctttcaaccaaagtccataccttgtttcttgcaaagttgttgagcttttcatgcatagcatttacccaatccggatcaccaagagcttcatctacatgttttggcttaagacaagaaacaaacaagtaatgttcacaaatcgaagcgacacgagatcgagtttggacacccttactaatgtcacccaaaacctcgtaaattgggtgatccttggaaagagcggtgtgtatccttgttagcataggtggatcttgtgccttctcctcctccacttcaacttgagcttttcttggcatagcggaagtagataactcatcttgagtggaggtagatggcttgttttccacttcaataggcttgacatctccaatagacatgttcttcatagctcttatcaagccttcatcacctacatcatccaaattcccgtgcccctcttaggagccaatagtctcatcaaattgaacatcggcggtttcttacacaataactttgttcttgttgtagaccaggtatgccttgctattggaggcatatcctagaagaaacccttttcatcacaccgactttcaaatttggttagtctaacaccctttcggtgtgatgaaaagggtttggccccttgatgctggtgggggagtactcccacccaccaaaactagccgttgggggcgaaatcccccaactctatgtactgccggtctgaccggatgtgtgtggccggtcagaccatgctactctacaacggctagttttctagccgttgtaggctgtcattgggccccatcggcttggccggacagactggagttgggtggccggtcagactggcctcggctcggtcagaccgcccccagctcggtctgactgaatgcggctatagatcgccacgccgagagcaccacagggagaggtccccttggctggtctgaccggcattcacccgtcggtcaaatgggccgacctacgccggtcagaccaccactaggcggccggtcagaccggccttggtcacacagcaagcacaacaggaaaatgagacaaagccaaatctaaatgcataataatctaatgtggcaatttaaatcatctctttgctaggtcattacccctcttaatagtacagtaaagctataaataaactagcacaaattgattgaccaacacctcgatcgatttagaactcaactactagtttaccgtcatctatactttgctttgcgccatcaatttttagtccatcgataattatccatgcgcacacatgatgtgaacctaactcaaaacacataactcgatagaacggttagtccacaattagcgcttgtcattaattaccaaaactaacaacgggggcctagatgcttcaaagatcatgcacgatactaaaaggctagagaacaatggacgtggtgataaagaatctatatagtatactgttggcggatgttaaatgctgattctataccgcccacatctgcataaagtttagataataaaacatccaacatagtgataggtgcttaatctcacatattccacaagtgttggtgtgtacagttgtatgcagaa

SEQ ID NO: 30118 - DNA, 10148 bp, Oryza sativa
aatgagtacttgttgaaaagatctcgtcgtctactgtcagctatgtgtggcctcaccatcaattttgacccaggctgctcagaatgacgaaaatagttctttacatcagaaacttgggcttggggccttgtatcattatagcccattaggggtcccacaaaacctagggtttgctcccacctcctctcctggtcattcctccacctatataaactcctagcagccaccattttgcactttgggttttgtttttgatgtaagtttagctgcagctacttccttgtactcgcgtgtgtcggctagaccacccgaatacttgtattcagaaccccattttggtttgtttaagtttcatcatttgacaagtgccgtgagctgtttccttgtcaacttgttcttgcttgttcttcgattgcttgcaggttcaaggttgttcttggcacggcaagaacagcaataacgtggagtcggtgtaccggttgctaaggcgtagcacccctgtggtagttgtagtcggaccgccaacgtcgtatccttccccaaatcgaagtttatcctcctctcatcgaaagatcgggaacccccgttgctgcatcagtggaggcatacgacgcggcccgtatcgacttccatcagatggtgcgtcgcgggttggtcaagaacaacatgaagatcctggagctgcgtcaggagaatctgcagttgaagaaggacttagacgcagtggaggcgcagctgcgtcagctcaagatcgcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgccgagcccgcgcccgtggttcctcaggaggatggagcctccggcgttggcagtacggaggatgcgctgttgctcaccttccgccctggcccgtcgcagcagtagacgagcagttagtaggcttgcgcgtgtgttcttctcgttttttgtttttctgctagagtcgtatggggcatggttatgccggtgtgtggtataactgtgtcggagcctgtctttattttatttgcttaagcaacttgaactttaatgaaccaatttaatagcagtaataaattcaagaattatggtagtcgtgggtggttagttttaattgtcagctctctctgtttgctggttctgtgtgggattttcagatggtgacaaccaggagaagtgctgctaccggtgaaggcagtcaccccgaaggcagcaaccacaacaaccatgtcagcccacctccacctccttctccgcctccaccaccaccaccagacaccaacgccatcctcacccaaatcgtcgcccagtaggccaacatgatggctgctttcctccaccacatccaaaatccgccacaacataatgctccaccaccacccccacaacactctaaactcgccgagttcctccgcatctgtccgcctaccttctctagctctaataaccccgtggatgcattggattggttgcatgccgtggagaaaaagttagacaccgtgcagtgcagtgatgaggagaaagtcatcttcgccgcccaccaactgcaggggcccgcatctctatggtggaaccatttccaggctacgcagctagaggggcaacctattacttgggcccgcttcaccgccgctttccagagaacccatgtgcccgccggagtcatggcccttaagaaaagggaattccgagagttgaagcaaggcaaccgctccgtgatggagtatttgcatgagtttaacaacctggcctggtacgccccggaggatgttcgtgaagatgaggagaagtaagagaagttcttggcaggaatggatcctgagctgtccgtgcgtctggtctccggggactactcggatttccaacgtctggtggacaagagcatccgcttggaagccaagcacaaggaactggagtcgcacaagcgtcgcttggcgaatttccgcaatcaacagggggctaaccaaagggtccgctacaccaatccctatccagggggatcatcctcgcagcagcaacagcagcagcaacctcgctccgcgccccgacctcaattcgtggtgcgcatcccacagccgcagcaacagcagagtcagcaagggactcgtgcgccccgtccccctacgccagccgtgcagcctggtcaaggccgcagggacgttcaaggtcagcagcgtctgtgcttcaactgcttcgagcatgggcactttgcggataaatgcccaaagccgaggcgccagcaaggccaagcgcctccccgctccaacaacggtggtaaggatgtcattcggggacgtgtgaaccacgtgacggccgaggacgtgctgacaactccagacatcatcgttggtacgttcctcattcattccatccctgctaccattttgttcgactctggagcttcccactcgtttatatctgtgccattcgtggggagaaatcggttggggatagaaaggcttaggaaccctctgctcatcaccacccctggaggggttatgacagcaaagtattatagccctgccattcctatagaaatccagggaattccttttccctcggatctgattcttctagacaccaagaacttggatgtgatccttgggatgaattggttggctcaattccaaggagtagtggattgcgcaagacgcactgtcactctgtaccgagggccggaacaaccggttgttttctttgcacccccaacttctgtcggtagttcagaacttcatcagataggactgtcagaaatccccatcgtcagagagttcggagacgtgtttccagaaaaactacccggtatgctgccgaagcgagagattgagttccggatagatcttgctccaggaaccactcccctgtacaagcgaccctaccgtatggcagcaaatgaactggccgaagtcaagaaacagttggaagagttgaaagaaaaggggtatatacggccgagtacttccccctggggtgctcctgtgatttttgtggagaagaaagacaagacaaagaggatgtgcgttgactacagagctctcaatgaagttactatcaaaaacaagtaccctcttccccggatcgatgatctgttcgatcagcttaaaggtgccactgtattctccaagattgatcttcgttccggatatcaccaattacgtattcgtgaagaagatatcccgaagaccgcattcaccacgcgatacggactgtatgaattcacggtgatgtcgttcggtttaaccaatgctcctgccttcttcatgaacttagtgaacaaagtgttcatggaatacctggataagtttgttgtggttttcattaacgacattctggtgtactcacaatcagaggaagaccatcagcaccatctccgtctggtgttgggaaagttgcgggaacatcaattgtatgccaaacttagcaagtgtgagttttggttgtccgaagtcaaattcttagggcacgtgatatctgctaaaggagtcgctgtggaccccgaaacagtgaccgccgtcattgattggaagcaacccaagacagtcactcaaattcgcagcttcttgggtttggcaggatactaccggaggttcatcgagaacttctccaaaatcgctcgacccatgacacagttgttgaagaaagaagagaaatttgtgtggagcccgcaatgcgagaaggcattccaaactctcaaggaaaggttggtttcctcgccagttttagtctgaccggatactcgcaaggacttcatggtgtactgtgacgcttcgcgccaaggattggggtgcgtgctcatgcaggaaggtcatgtggtggcctatgcctcaaggcagctacggcctcatgaaggcaactaccctacccatgatttggagttagccgcggtagttcatgctctaaaaatctggcggcactatctcattgggaatcgctgtgaaatatatactgatcataagagtttgaaatacatcttcacccagtcggatctgaatcttcggtagaggagatggttagaactcatcaaggattatgatgtgggaattcactatcatcctggtaaggccaacgtggtcgccgacgctctaagtcgaaaaagccattgcaacactcttgacgtccgtggcattccacccgaacttaatcaacagatggaagccttgaacctaagcatagttggtcgtggattcttggctacgctggaagccaagcccaccttgctcgatcaaatccgcgaggctcagaagaatgatccggatatgcatggactcctcaagaatatgaaacagggtaaagccgctggtttcacagaggatgaacacggaaccctatggaacggaaatcggatatgcgttccagacgacagggaacttaaacagctgatacttcaggaagctcacgaaagtccttattccattcaccctggcagtacgaagatgtacttagacttgaaagggaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggcggatatgattctatatgggtagttgtggaccgactaaccaaggtagctcggtttattcctgtgaagaccacctatggagggaacaaactagccgagctctacttcgctagaatcgtgagtctccatggcgttcctaagaaaattgtatctgataggggaagccaattcacctctcacttttggaagaagctccaagaagagctgggtaccagattaaatttcagcaccgcgtatcacccgcagacagatggacagaccgagcgtctaaatcagatcctagaagatatgcttcgctcatgtgtcctagatttcgggaagacctgggataagagtctcccctatgccgagttctcctacaataacagctaccaagccagcttataaatggcaccctatgaagcgttgtatggacgcaaatgccggacaccgctattgtgggaccaagttggggaaagccaagtgttcgggactgatatcctgagagaggctgaagctaaagtcagaaccattcgggataatctaaaggtggcacagtcccggcagaagagttatgcagataaccgacgccgtaacctggaattcgcagtggacgattttgtgtaccttcgggtcacgccattgcgaggtgtacacatgtttcagacgaaagggaagctcgcacctcggtttgtgggtcctttccgtatcattgctcgacgcggggaagtcgcttaccagttggagctgcccgcctccttgggcaacgtgcatgatgtgttccatgtgtcgcaactcaagaaatgtcttcgagtgccatccgagcaggccgattcagagcaaattgaagttcgcgaagacttgacctacgtggagaggcccgtgaaaatcctggacaccatggagcgcaggaccaggaactgggtaatccgtttttgcaaggtccaatggagcaaccacgccgaggaagaagctacatgggagcgtgaagacgagctgaaggcagcccatcccaatctcttcggcagttcttccgaatctcggggtcgagattccgtttaagaggggtaggtttgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagaacacaaattataattattaagaaataaacaaagttaaaatgattttataaaaagaaaaactctaaaaagtcccctttccctccctctccctcttgggccggctcggcccatctccttccccctccctctcctctccccacggcccatccggcctctccccgcgcgcgcgccgctgacgggcgggcccgcccgccaccctcgctgacgggtggggcccacccatcatccccttcctcccgccgcctcgcccgcgccctagcgccgcggccgccgcgaatcccgccgtccccgtcctccccgcgtgcaatcaataggggggaattattccccgtgattccctctccctttccccccatttttccctctctccctcgcattcaaacgggcggatttgcccccgcaaatctcgccggcgccattgatggcggccggacctcccgcacctattccttccccgccggccgctctctcccccttccaaccctatataaaccctccctgcacctcctccgtccgtttccgcctctcgccgcccttcctcctcgccggaatcgagctcgcgccgtcgctctctctctccgccgtcgccgccgagctccggtccaccgtcgttgtcgccccggaccacctcccacctcggcaccgcctccttcggcttcgccgcatcctcgccgacctcgtccacccctccgtttcgctcgtcgaccgccggagcgccgccgtccccgtcgacccgaaccgcgccgccgccttcctccgctccggccgccttttcgtcgtcgccgtcgacctagggtgagccgtggaccgccgcctcatttccccctttccctcccttctctcggccgccgctccgccatgcctatggccgccgccggcgaccataggggcgcgggcgcgccgcctcccgccggccgcgccgccgtggccgccttcgggcgcaccgagcggcttccgcgtggggcctggccgtcagccgctcgcgccctcgggtgtggctgacgcgtggggcccacggcgccggccggtgtgagcccgggtgcacccggtccaccgtggatcgtgaggctgccgcgtgggtcccactcccgtggacccggtccgctcgccccctcccctcggctgatgcaataaacccttttaaaattaaaatttaaatgaagaaattcgcaaatattcatttaaagagcatataaacttcaaatggtcataacttggccgtttgaactcggaattggaccgttcaagtctctaatttttccttaagaagtcaagaacccatttttgtgctttgttcctgcttgttatatggagtttattagattaaaagccttttcttttccattgatcgtgtagacgctgcagcttcgaaagatccgctcttcgtggaagttgaagccgacggttgggaaagcgagcaaggcaagtcacatcatccttgaacatattgaatcccagtttataaaattattttgatttaaattattgcattatcgctttatttaaattcccgcgttatcactgttttatctagacatgcctatttacctttgttatgaccttattattgttattgttattatttccttgttcaccctagaataaacaaaaccccaactagtggacactctactcatggtaccactagtatgaatttaggtagatgcttcgctggttaattaggcaacattaggtggttttacaactctacactttgggaatattctcatcacctggacactatggaattgttggatcattgtggaattggattcacacctccccctctattcaaaaccctcaaaatggttttaggctgggctcggggtgcatggttttgatagtagcacctcggccatataaggaccggtcttcgggcctctgttgcaaagcgctaccgtacttccacatgtctagtgggtaaggcttagtttgtggctcagtctggttataaacaaaagtacacggatggagatggacgaagtcgggggtcgatggacatctctaggacaaatgaaggctacacgagctacggcctggtagccaagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaacctaaccctttatattacaacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttcttgtttgtctttgtgtgtgctgggccttcgccgcccatgtaataaattaactatttacgcttccgcttgataaactctgaaatgtatcaacttttggtgtaccttgcctcctgggataaggaataatacacgcacgtaaggaacgcccgttgggtcaattccggtcgtgacaagttggtatcagagcccccttgaccctaggacgagccgtagatcccaagccttagcaatattttcaaaataaaaatcctttcttatttgtgaaaatcctctagtctctctctgtcctgctgcttcatttaccgtcaaaatctgacctttaaaatgttgcttttctcttttgtttttgtttgtagatggccggcagcatcaaccgtcgtggtctggacctgactggattcgttttggaactgcggggcatgtgcgttgttctggggtatccgcatggagtggactaccagggcaagcagctcccggagcaggagggtgacgatgcagagccccacgctgcttgggaggttactgcagtgatcctcactggctcacccgagaggacttcgttggcggtcaccgcgggtggagattccttctccgctgcttgccagaacgccgcactccttgccatcggcactcttcaccagcgctacccggacgagttgcagcacttgccctaccgctaccaccctcgtcgcggaggagcccgcgactacgccaccttccgggatgctagctcggaggatgacgctaccatcatgcacctggcgcacatggtggatgatgaggacatcccttccaacgatacaaccacgcctattacacagcaaggaccaatgactagagctcgagctcgtgaacttaattatcaggtaaagtcattcctagctaatcatacaagttcttctcagaattgggtgctactaaatggttgttgtgatctacttgttgttaggaatatgggagaggaaccaaatcgcaagcaacactagcagcgctgatttgatgaagtcaatgctcttcactccggagggcaaacggggcaaatgagtacttgttggaaagatctcgtcgtctactgtcagctatgtgtggcctcaccatcaactttgacccaggctgctcagaatgacgaaaatagttctttacatcagaaacttgggcttgggccttgtatcattatagcccattaggggtccacaaaacctagggtttgctcccacctcctctgctggtcattcctccacctatataaactcctagcagccaccattttgcactttggggttttgtttttgatggaagtttagctgcagctacttccttgtactcgcgtgtgtcggctagaccacccggatacttgtattcagaaccccattttggtttgtttaagtttcatcatttgacaagtgcc

SEQ ID NO: 30119 - DNA, 1340 bp, Oryza sativa
cccgtcctcctcctcccgtcgtcaccgccggccgcctccgacgacgaccgaccggctctcccgatgctctcctccctctttttctctctctccacagttacattttgggtacaaaaatctccaaagtggtatttcattcggtaggcaatatattgagtggcattttatccggtgcattgtattgagtagcatttcatccgaacccagtttagggagtggcataacgtccgttttctcggcaaattgtagcctcgatttgaaaaaaaaggcaaaatcatgaaccctaaaaaaaagtaaaattgtaattacaattgaaagtaaggttaagaatgcaattgctccttaatttttagttatttgtttgatataatataataatctagtattgaatgacctatcttaataatacgacctataatgcgctatgttgttatatttttaattgaaggagtataacaaatggacagtgaaaggtatacgtgaaggaaagcaataagccaataaataaaaaaattgtacatcgtaagtttaggatcgaataagaccaaaaaaaacctaccagatttgggggggggggttgaatggtaggataaaccaaaaacctaaaatcttttgcggaataaaagatttacctcgaatggagtagatgacgaagctcgtcgccaccggtcaaaacacccacctgccgccggtcaaaccaccgaaaccttgccggtcagaccgcccaaacacctgcggtcagactgctacactcccacctgtcaaaccgcgcgcacactgcagctagaccgtcgggacctagaaaacaccggtagataataaactcaaagatgtacattgaaacttttaactttgttgcatcaactagtatttacaaagtgcatcaacagcagccctcacaaaatctcgaactaaactcgaaaccctaacttttctctcaactcaagtctctctaaaaccgataccaggaggccacaccctccccctctatttatacatgaggtaggctgtgcaaagcccacgaatctaacacaacttagaactcctaaccatgtaggaaacactctcttgcaagtatccaacttattcctttccttatctctattaatcttcccgaattcggatcctaaatttgactcctctttccatacgtacacaatccctcttgtatatgttggtatttaatacggttacagataaaatccacaagcgcacggatataccgatgtagcacttcccctacgaagtattccaagggtatcgaatcctagggaacgtgtgtggtcagatcttcctccggtttatccaaggacaccaagcaaatgataggccaagataga

SEQ ID NO: 30120 - DNA, 837 bp, Oryza sativa
aaacaccacgtctaagcagttagaatctactttagtgtttataactaaccaaagcaatcactatattttagttgattatagtgaacaataatcccgtatgctatttaggaactaaccaagagataattctcacaagataatattatattgaattcagagtataaacagaggagaagattaccgataactccggaattcttccgacttcttctactatactctcttcctattctagtatacaatatagtacaatagagcctcttataattcagctcaatcttggaagtgtgtgtgagagtgaatgaagtgaggtccttttatagggcagttatgacggttgtgagaaggggaaatgtccgaactgccccgcaactgtgagttggacgccctcgcaccctcagcactgtccgcaagagtacacgaccccgggcaagaagcccaagccagatccggaggccaccacctctgagccgtggggactcagatttgcatgagcatgcgataccctcttcccgcgcaaggatcctgcggatggttggacgactagaatggaggtctactgcgacttcgctctcgcttcatatggtttttggatagcgcgagacacaccccccacctagattgacgagtagtttgatgattagctcgatgtagcttttggatgaactctatttgggctgcgtacttatgcagtcgattgcatcatgatttatgtgctatttgtggaactctgtgatattctttatgatattattattgttgtgctatgaatgagtttattccaccatgcttgctaaacaaagttcacatcaaaagaactcccttaactgcaagaga

SEQ ID NO: 30121 - DNA, 329 bp, Oryza sativa
cgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatttgaaagatggagggaatacaaatagagaataagatgatgctgggcgataaggtacgaccttaaatggaatttagatagcaacaaatgctt

SEQ ID NO: 30122 - DNA, 12345 bp, Oryza sativa
tactaaaaatataattcccagcaatggcgcacaaatacttctggtatattatggttacagagttcatccgcaagcgcatggatataccattatagcatttcacccgagagtattctaagggtatcgtatttattttatcccgtgggaagatcatgtagagagagcttgactaataatttatatattacttgtgataatcgtattctaaacaggggttaagataatcaaagcgtagagtgacacacaagcatgaactactcattctcatgataaatcatctaagctaagtggatagaaaagagacagataatctattcctatacttctaatatacatagtacacatacattcttgttaactgatatactagctaataccctctttccgatgcgctcctgttacttcgagtaaccacccctgactgctgagtttcttacgacagcccgtcatgactatacaaccggggctaaatacggaggaataccctccccaggaaattaacttaggattatataccggcgcggaggaatacccgtactgagctatcaccataagcggccacctctcatccgcaatatataaccccaaataatgatatcccgtaatctagacaccacgtctaaactaccagatactactctaatatcatcgtcatgacatagagtaattgcataagcaaacattatacccgcaccaaagcatctcccagataagctagccgtatattcagtataacatgaacatagtgtaaagtaggtactaatattctcggaaagtatttcaatattgtaaatgtatatagaagattattttaataaaagtacaaagcttacaaaagaagaaaggaaagctgctagagccatacccgaactcttccgaagacttccggactcctgatttctactctattcctattccaccagctagatactactaaactaaaattgagagaaatgggagagctattgcttgaggtgtgtgagtgaagtgagaagaggagctccttttataggtaggtaatgacggttgcgacggttggaatggtcggtaataccctcctaccgtcattggggatcaatcccagccgtccatccaaaccttgcatccatcggcgccacgggaggttcagccgaaccccccgaaccatgggttggctcaacccagcccatctttggctagcggcctccttcgtagtcctccttcgtagacttgtaattttggcccaatgtgttgtgttatttctgagttcttggcccattcatacataagtctggttctcgacactgtccgattggtttatcgtctgagttgatgtcgattctcctccactttattgtcattctctgcaaaaggttactgtacctaatactagtggaatattattattttaacagatatatgcattgcaagcatcactagttctcctaaattttggctatattgacggtcgcaactgatcgataacgaccgtcaacaccgattcacagctagtcgatttggctttccagtgattgattgggtcgataagagagaaattttcatcacaagactttgagagcttagcacatctggctcagaaggtatcggctcatgagcaacgttttcaggaggccaagaaggtcaagaaggttaactacgtctatagatatgtttatgattctgaggaggagacctagagatcagtttggctaagtggtccaagatcaagaagacaactaggaagacctagagatcagtttggcagagtggtccatgatcaagaagacaactatgtgtcaatgggttaagtatataaacaaggaagaggaatatgactttgatatcaataaagccaacaaaatctttgatttactgttgcaagaaaagcaaatccagttgctagtaggtcatgttctaccatcggctgaagagctgaagaagaggaagttttgcaagtggcacaatacaggatctcatcatactaatgggtgcaaggtgttcaggcagcaaatccaatccgccatcgaacaaggaagaatcaagtttgatgatggaaaaaggtcgatgaagattgatggacatcctttttcctgtaaatatggtgtatgccatgattgatagcattagattgattaacaagtaccagaagagacatgacaaacaagttcagaggaatttcagaattttagacatcaccgagatgatagatattatcaaggtgatcaggatgaagaatattgtcaaggtgataagtttgatcctcattggagttgtgagttctttagattttgttggaacgaaggaatgaggttactgttgacggtccttaaatcataatatctgaccgtcaatacttgcatacaatgaaataaaatgtggtatccaacttagtggtagggattattactaatcaattccactagtgttggtgaaatatgtgtatgcaagtattttaaggagaaaacacacccggcatacaaggaaacacacctccggccaatcagacgcaagtacacggattggagggcccacaagtcaggtgatactgccacggaatgggtcataactgtcataaccgccatcagggccaaccagtcagtgtccctgccaaaggagaggctaggaggtggggcccagggttcggtcgaaccaccataggcgcccctcatccttgccttccacgtgtacgttcctgatgacttcacaatgatggttggagggcaaattggacatttcacatagctgtaaccatcatatggaggctataaaaggaggagctcatctcacttcaccaacacacaactttgagctgaattacaagaggctctattgtatcttttgtacattagaaataggtagagagtgaggagaagctctagaggagtgcccaaaagtttggcgctctctctgacttctgccttgatgagtgtagctttctaggaggaattctggaggagtatcggagctatcggtatgctctgctcaaggttcggagaaatttcttctataaattaagtattcgagatcctttcttgtgctatttaattacttagtctaagtgagataggtttccatctttgcgggttcattgtttagtattcatactaagtgctctagtactaggactcttgataaagaaggaagttcctgcgcaagtattagagtaataattaataacttaggcgtggtgtctaggttagagattaccttttgtttgttctgtatcctacagatttgtcagaggtagacggcaggtggtgacagctctgaatctcatcctagtaatcctccacgttcgggtacatcatagagctatagccggaaccacgctagtagaccagcagaaaattaccttcacttagcttagataattaaaacacatagaaagtcctgtctagcctagctagcctaccattagttgttgtccttggataatcttagccttagatagattacacacgttccctgagctcaatacccttttggggttacccgaaggtgaaatgctacagcggtattccgtgcgcttgtggatttatctgtggtcataagaaataccaataaacatttctggcgccgttgccggggaacggttgctaatttatccgagtctaggtcatcctcgtatctttatttttattccttcttcttttattcctttctgctcctcgggttgatctttgtgagccatcatgttcttcaaaaccaatcctttcggatggttacaaaattggtcctagctttattgccttgattcgagagcaaatcttctccaggagtattggtgaaaacatatacttccatcttcgggactttgagctagtgtgttcatgcctatccatcgtcatgacacatgaaactctaaagtggaagctgtttcctttttctcttagagatgaagcgaacttgataacccgaaataatgatgtattgttctatttcatttttattaatttttttgccgtttatgttactaacatgtgaaaaccattaagatgggacataagtattgtgtgtgctaaaataatgttgcaacaagagtgtataatttttttctcattacaacgcatatataggcaactaactagtgtcatttgaaaccatattggcagcaggccaacaatgcaatttatgtaccccatttgcatatacaggcccgtgcgtcaacaaactactagcttcagcggaccacctatatatttgtcgacaaattttcttctaaaaatttgacagatgtaattataatacaatcgtagtgtaattacattgtaactcatatataattacactgtaacttctatgtaactacagcgtaacttatatgtaagttttatgtaattttgaatcgttagatctattacaagatttgttttggtgaggaagaaaacaaatcataacacacacatatgtgaaagaatttgttcccacaaccttcattttacccaaataacaagttacggagagatttttgaaagttacatacaagttatattatagttacagtgtaattgcatacaagttgcagtgtcattacactacgattgtagtgtaattacatccgtcaaatttttggaagaaaatttatcgacaaatatatagcaaaattgtcctataattaatccaggcctacataaattgaatggggtccgaacgctaaatccagttggcctatatatcgtacaaatctctcaaaagcttatatataacacttgcggttgttttttttttgtggggaaaaaacattgcgaatttgactaagatatctagagaaatgcatgtgtccacacatctaaagcaaaatcgttgatacttattcgtgttaattgccttaatttgttcagtgttgtaccggctggccagaccataatatctacacaacaagacctgtactatctgggaacagtgaagacaatgctgtagtgtaacttccgttacttgcatggttaaaccaggcaaaatatatagttcgtacagtaacgttaaattgccattaggttttatgggaggttcttattctcattaaattccatgtggttgaataaggcgttgccacgacaaatctataaataccacataaagctcgacgaaaccaaataatatatacctggagaaagaataaggtgagtgatggcaacgatagtagttcctccagttaccccttctcctgctgaagatgctgatgcactcctgaaggctttccaaggttataatctgtagtattccatctctcgttgttctagctagtttatagctatatggtaatgcattaggttcaaggtatttgctagatttcagtcatctaaaatgtagcaaattttaagtcaaattttaagtcaaatatggtaatgcatttggttagagtttctttcgtgggtttctgtgctactgttgttcactgtatcgaataacgcctaactcctatgtggatgatttcgagaagaaaagagaggctccataccaggagctcgatttgtagttttctacgatggatctctcaagtttctccattaatcctcctgcagatgggctcgcgactcgccaacgacgtcttcccgttgttcaccaggggcccttggcccttttgacgatatttagtttttgttgcaattttaggtgctcatttttcaacacccccccaaacaactaatatattaacgtgcaattcatttgtgcgttaaaaaaaatttcacccccaaatccgtagatctagattatattttttgcatgtgttttgtctctttagagaaatccgaggtcatgttcctgcacaacacaccattgtgtttgcaccgctagttgtggtagatctatcggctggaggaagaagatgatagatagtggtctgactagtgcatttacacggactagatgtgcacattgaggaactagaagccggctaatcgaggaaacacagcaacagcggttgggtccaaagtgtgcccttttggatacaatgttcttcctttttattttcttcttttttcatacggccgcagttgttattttgatctgttacatcccatatgtttataaaatctatctatcctccatgttgtttaatgtatgacgctgttgaccttttgagatacatttgactattcgtcttattaaatatatatatacatatattatttattttattatgacttgatttatgatcaaatgctttttaaggatgatttaaatttttttaatatttgcacaaaaatttgaataaaacgaatggtcaaacattgattaaaaagtcaacgacatcatatattaaaaaacataggtagtattaaagacaaccttaaaagcatgcaccacgttcgctctacaatctagaaattctcaacggtacagattggttgatatagttgtatacaaaatacaattatatctattgaaatagaagttaagatatgtatataaaatccaaatatacttacattatgataactatagagataaaatttcagttgcatattaatctaactctatacatgaaatatcaagctccgtgcaaaactgcggggacaatcccctagttttaaaataaaccaatgtaattatcaaggaaaatcatagttaaaagggtggttttatatatttatatatattataatgtgaaaaaaaatataatcccgcagattatgttttcttttttcagtgtatatcatacagttgaattttttttaactttttagtaatatttcgttgtcttaatgtttctaccattactttgttagttgttctgttttttcagttgtttgttcatttttatcgtgaatatagctaaagttttgcatgtaatcacatcccaatcaatgcgatgttaaatcttaatcaaatttcttttatcctgcctgtattctcatctattaagtatagaacatgctaattttttctatctcacaaatcgcacatgatatttatcatcagttacaattgaaatttcttcgctacctttttttttttgcaaaaatttttcatttgtagactttcgaacaaaccaaacatgctagagaagctaaatattgcagatttacatcagtggtacaatgctgttcatatcttcacccgttacaattatactgaggaaattaacaaaggcaaaaggatttttgtgtccggataaatgaattatagccgttttcttttaatacatggatcacgctcttaatagaaatataatcaattcaaattgcttatacgtttgttatattttgcggtgtaaattatacatactgcaactttttactctatggtatagaaaatttttaaataatatttatcatatttctttgtaccaactattgtaccctgttagttgtaatactcttttgtaattgtttgttcatctataatttctataaatttacaacccgctaagtctaaagcttaacataaaaccatgccacattatcacccactagctataattatatatttaatctcatgtatgcatgcaatatcatctacaatatatttaattatataaattaacatgcaagcatatccaatcatcatgacatcacccataatatttccatagatctatctttttgtaatatatttaaaaataaataaaaaaatgtttcacattaaagtgtgggtatcatttttttttactcctaactcgattatctaaaaaatatattaaaatttactccctccatttcaggttataaaacattttgaagtcaaactgctttaggtttcaccaagtttttagaaaaaaatagtaacattttcaacccaagacaatttttttatgaaaatgtattcaattattgatttgatgaaactagtttagtaatataaatattactatatttatttataaatttagtcaaacttgaaacagtttgactttgaccaaagtcaaaacgtctaacttaaaacgaaaatagtacttagcgatttccacaacaaagcacagaaatcacctggttttcctcatgtgtatggcctagtgtgttttcgtgaaggtacttattttgttttgttcaggcttggtattccttccaaaaacacgtaaaatttcttaagtcgaatgaagcccacttattaagatggaagaccataccagaaagctacaaaataaggccgacatagctagcgcagaagtccacaaatcggggggtaacaaacagaagcccaaacccgttcaaattgctcaataagtttgtgcagaaaacatggattatctaccaccataggttataaaatcaaacgggtacaaatgtgactgaaatttactggaaaactaggttcaaatatttggtgacaaaagttcattatttgcatataaaagggtcttcaaattgtgcccacatgtcgtagatacacgagaacccatatgttatagacaacgagtgataaattcttaactgccacatcttaaaaatggcaaaaaattaaatgccctttttgtctcgattgtaaagactgaacaagttattagttccagccttccagaaacgaaaagttattcaacactagcactgttttctctttgcattgttccatcggaaaaactttgttgatccagtgaactatttttatggtgcaggctggggcactgatgagcaggcagtaataggcgtattagctcaccgggacgcaactcagaggaagcagatcagactgacctatgaagagaactacaacgaaaacctcatccagcgtcttcagtctgaactttctggtgatttggaggtaagagtgctgcaaatcttcataaacacaccacaagaactcaaattagttaaaccaaagctagttaagtatgtgattcttctttcccccttctaactatatttaactgcagagagcgatgtaccactgggtacttgaccctgttgagaggcaggccgtgatggtgaacaccgcgacgaaatgcatccacgaggactacgctgtcatcgttgagatcgcgtgcacgaactcgtcctcggagcttctagcggtaaaacgaacctaccatgtcctctacaagtgctccctagaagaagacgtggccgctcgcgccactggaaatcttcgcagtgtgcgtactctcgctagtacagaatatctctgttatgtgtttcatcgtccctgttgcttcgagctaattaatctactacgtatcctcgtctgcttcagcttctgcttgctctagtgagcacctacaggtacgacggggacgaggtgaacgatgcattggctaaatcggaggcaaagattctccatgagactgtaacgaatggtgacacagatcacggcgaactcattcggatagtcggtacaagaagcagagcgcagctcaacgccacattcagctggttcagagatgagcgcggcactagtatcaccaaggtttacttgagcttcctctgtccaaatatataatatgcctgatggttaacgcagctgcatgctccgcgttttgatcaccaggcactgcagcatggagctgatccaacaggctactcgcacgcgctgcgaaccgcgttaaggtgcatctctgatgcgaacaagtacttcgtgaaggtgaggatgagctagctagctggagtagtagcgaagcatcgagatagataaactgaagctgaactgaatttcgcgtctgcaaattgtgcacgtatgtacgcatgcatgcaggtgctaaggaacgcgatgcacaagtcagggactaacgaggacagcctgacccgtgtgatcgtgctgcacgcggagaaggacctcaagggcatcaaggacgcgttccagaagagggcctcggttgccctggagaaagccatcggcaacgatacatctggtgactacaagagtttcctgatggctctacttgggagtggcatctaagctgactgtcaacgaatatattggaccatcgatccaagacttggcctcctcttcaataaatctgttgaagtatctatctaaataaggttgttatttagtaataaattctcctgttatagaattcgatcggcagaatgtaggcttcatacatgctctgcatttcttctccactaaaatttatcgctgatataaattcatgtcaaatgtaatcttgtggacaacctggaccttttgagagagactcttgtgacaaaatggattgcctctctcgcaatatgatattttggcccatgcatcaccatcacatagattaagcctctactgcaatctatttccacagcagagcttttggcacgcaatacttaggcagagtccaaagttgaaaacctactaaaatgtcaaaccgtaacacaccgtcaaattgaactgtaaacatgctgagctgcgttcacaaactgttgagagataaatgtgatgggctgatgatggcattttcagcgcttagatcttgatctttgagaagcactgaaaggcacaaattggagcgcaagctttggggccttcttgtacccattggtcattccaagcctaagtcaacaaagtctaatcctacaaaagtctaatccatattcctccctttatccattagcttacacaaacgacaacttcaaaaaaattcctccatcttttaatcttactagatgctggggcgcgccaatggcgcgccgcctgtacataatttttattatctgttgtttacacggttgaatgatagacactaataaaaaatatgtgcatttcatctaatataaaaggtgaggtacacaagaaggatcactaaattatgctaaacctattgaggaaaagcatataaatgcaaaatcccaagtactgacgctaaacctacaagcagaatgctgttggttatgaacctaccatttccaagtttccaacaaatttatactttgtagtgatgtcctttagggatgtgggctgggatagctagtatctctgaccaaacactaagtaaaatggctacttgtcagcaaaatattagtatattttccacagatagcttcttgaatagcttgcgaagaatatcccctatggtcagcaaaatattagtacaatttccacagatagctttttgaataacctgcgaaggacatcccctagttagtttctcttgagtagtttgctccactggttgtaaatcattgttttcatcccctagctagttagtttctcctgagtagtttgctccactggttgtaaatcattgttttcatataaggagcaattatgaaattcatccagaagcatcacaaatatcttatgcaaacagctacaatctcttaaaagtcatgcatgaatatggtaagtctggaatcacatagttctaactaaaactaatttttgtgcatgactatccctcggtctctgagcatgattaaaagttcttttactttctccttgaaaaaacaggaatgtatttttactactggacagacactgtaacattctatttaatttgaaccaaatagagtgttctctgcaactaaacactcaactgaacactgaaatgcatgtaagaagctagtactgattaacataacacgcacaacatgcctctgacacaacatgtttgtaacctatcaccaaccatgtttcttagccagatttgaatcctggctaaaaaagcagtatctacctaaaagaataagttagttcccagttcccacgccaaaaggtttacaaaaggtttagatgaatttccctcttatcaattttgcatatctagtctgatcaattgtacttacgggaatccaatcaagcaaatccaattgatccttgagaaatgcaacaatcttaaaacctaaactactactacattactcagctcatagtacactgaacaaaaattaaaagcattcagaaaatgtgtttttgaccctgagataattgaatatggtttgctatatgcataagtggttcttacgagggcaaattaattattcactaattctcattttatcaggcagtttttaatactttatacatgcaattctgttaacatgcataagtggttcgctcatacaagttgcaatttgtaaataattgatttattctttatgtagctatacaataaaacaagtaactataaaagtgaacacgaatttagtttgctaattgtatctttttggcctggtgttatttatgttgtcttattttctatgaatgttatgtacattttcaacgaaggcatgtgtagtatatgcattttatgggaaattaatggtttgtagcttcatcagggagagggcagcactgtgagttgtgcacaaccacatatttctgtttattgccaataacaacagtggtgggcgactgatcatagagaatagagatagccctgcctcagcttgatcatgtaaataaattaatgtttcatattctctttctcgtggaaattgaattttgtaccgttatttcattctttctttccagtccaaatcggttttagattgttgg

SEQ ID NO: 30123 - DNA, 13202 bp, Oryza sativa
  unsure (1)..(13202): unsure at all n locations
agctcaattgtccgtgtttgccgtctggctaggtcacccttcaaatttgggcttcagcgtactagcattgcttgggccaatatatggaaaatctgttcattataatgagccacatcatgttgggccgacacagtgaatgagaaaatcccaaacatgaattctaacacattgagggtgtcccctcatatacttttttctctttaaaatttaatgcagatggttatgaaaaaaaaatcaatatagagcatagtagcatctatcccttgattgttatcattatgtcaaaatggagttgctagaaatatgacgccatatgctatttcagccactttgcacagtagtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaaacggaagccaggacttggaccattcatcacaggcgcgacttgggaactaggccgaaaccctaaaactcatcgtagccgacttgctcctggaagaactcttcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaattctaagtgagtgcttctcaaacgacacggatgagacagtgcgtctcgtccggtcggagtatgtgcaatgtatcagtctttaggattgcaacaaggttggcacccggccaacagcttttcaaacggccacccgggccaacaactttttaaacggccacccgggccaacaacttttcaaacggccacccgggcctagctgatcccatcagctacagatttttcaaacatcgaaccccttttcacaacagcaatttcacaagcagtagtcagacaaaactacgctaggaatcacctcacatccgcccttgaccgtgggcacgactattcgaacagttcaatgacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacatgttaggtcccagaccatattgtgccaagaagcccaggggtcctccccgacaccaccccggcgaatccacatgtctctcggcatcaaggctcccctgataagctagttactcagccaggggtgtcccattccacccatgtggtcgtacttgtcttatgtttggatgaaattacaaggaatcggtccttaagtgcgagagcgggaaaccatacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcgcagagtgcacgaatatcgaggtgcaactgggtggttacaaggggacatggtataacaattaataaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaattctcgcactgcgggtcttcgggttccggaactacacgcgaaacgggacaactcaacaaacggcgaaaataaagccctattaaagacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggcggctagggcgcggtccaaggtaaatggagcggctcggccgagcttaacgggccggccggcccaagacggcccaagcgcgcgcgcgggagggaggagagagagtccggtggaccgggctcaccacgcgcggtcccgggtgggacccgcttgtcagcggctcggctcaccgtgcggagggagtacgtggctcatgcgcgcgggcggggaaaggacgcggtgcacgcgagcggtccgtggtggacgcaggtgcggcgggcccacgcgcagcctcacggctcgcggtggaacgcgcgcacggggagggactgaccggggtcggctcgatccggtctaggctgagctggcgccgacgtggcgcctacgtggcggccacgtgggctggcgggaggtagacgacgacccggcctcgaatggacggcgggcggcggcggcgagcggcggagcgaaccacggcgatacgggcaacagcgagcacaccgggcggttgcacgtgacaagggaaggcgagccatcggctcggattcgccggaggttgctcgacggcggcggattgcggcggtggcaatcggcggcgggagaatagggaaacggagacgaggtcacgagaggtcgattcccgccggtgagagcatctacgcggcttcgggaactcgacgctagcgtcggattgggtggaactacgccgagcgaggccggcgacgagcgggtgctacggagctcgagcggcgacggcggcgaacacacggcgaacgacggcaacggtcggggcggcgccggctaactacggggaggctactcaagctactaccgaaagctagggggaggagatggagcgaggaggaagaacggagagagacatcaccgagaagaggaggggcgatgtgacgagaggccagcggcgcgggagtaatctctccggcctcgggccggggaagaggaaggagagggcacgcccgaagtccccttccgcgtcctcgaacgcaccggctctcccggcgcttggcgaaggacggcggaggcgagacagagcacgggggcggcggcaacggtgaggaggcgaatgggagaggaagggaaagggggaggcttgggtttataggatggcaatgtcggtttgggaaccgacttagggcggtcaagggcgcgagctggcgctcggcggtcgcggccaaagcggcgacagggaggatgacgccggcgaggaggaaaaaggggaaaaggagggggagaaagggggcttgcccctttgccgattcgggaaaaagggggaggggagcgggggcgacgcggcagagagaggagggcgcggcctccttcccttggcggcttgcgcgcggagtggcgggggccgggcggtgacgacggcgatgacggcgggcggtttggagcggagcggcgacactggcgacaggcgcggcagacgctgacgacggcggcgaccgggcggtcggccactcggcgcgcgcgcgcgggaaacaacgggcggcgtccgcacgggcgctcacacgcgaacacggcgcgcgggaagcgtctttgcgagcggggagctcgcgcgaggggaggggcgctcggcgcgggcgactcccgcgcacgcgcgcgcggcgcgcgggcgggccggagggggggagcggggaaaaaggcgctcgggcggctctcgcacgcgcgagcagcgtgagggcggggaagagagagagagagagagagagagagagcgggagagcgcccggggggagagggagagatgggccgggaaagaggggaagatgggccgagcgagattcggcccatcgaccttgggggaggcaaaatagacttttgcggaggaatttgattggaaggaattggattcggagttgaactcgacgatagatcggggattgatatcttgagatggcacggacactagacaacaagcaaagaaacaaatttcgcaattagggtttttaagagataattttcccgctaggcgccacgacggaacgggcgctacagaccaacccccctaacaagaatctcgaccccgagattcagcacctaagggagcaggtccgggaactcggcgcggagaagatcttcttgctcccaggttgcctcgtcttcggaatgattgctctattggactttgtagaacttgatggtcttccttcgagtctgacgttctgcctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaacctcctcataccacggaggggtgatactcgcatgtatacatgatctcctttttcgaactcaaggtcacgcctccgattgtcagcgtaattcttctgacggctctgtgctgtcttcaaacgttctcggatcagcttaacttgttcttctgctgacttgagtatgtcaggaccgaataccagtgcttcgcccacctcattccagcacaagggagtgcggcactttcttccgaacattgcctcattcggcgacatcttaatgctggcctgataactgttgttgtatgagaactccgcatacggcaaacaacgatcccaagtgccttcgaaatctaaggcacacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagctaaatctacatacgacatgggtcatgtagagttctgctagtctctttccatcataggtggttttcactggcacgaaatgagctgatttcgtgagtcggtccacgattacccaaacggagtcgtacccgctgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacgtctcgcttcattccagcccaccagaaatatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaattggtgtctttcttctcctgtattctttttattaattcttttatcccttcgtcgtctttctgagcctcccgatttgcgactctagggtaggctgtactgtcaagctggcagggacacctgactgtaccacggtcagtcttaacttctccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacacgagtgaggacaaagtgtgtagaaaagacatgtgttggtctgtgagggcagtctatgacctatgaaagctatcatatgtaagcgggcccggcctgggggaaggcgggacgttacaaagtggtatcagagccgactctcgcggtttcacgggcgcgtgtgtcgcagttgcgcaggcatggtgcgcatggctggtgtagaccgagagtggttacacagcatggcacatgcgctggcactggacacatggacgtggccaagaaaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagactcccagggttaagcgtgcttggcctggagccatttggaatgggtgaccgtgcttggtctgtaggccagtctatgacctatgaaagctatcatatataagcgggacatgtgttggtctgtgccagggttgatcgacgggggcgtcgatcagtgtgcccgggtgcacacgagtgaggacaaagtgtgcagaaaagacatgtgttagtctgtgagggcagtctatgacctatgaaagctatcatatataagcgggcccggcctgggggaaggcgggacgttacaagtagttacacctcatttatgtcccacttacatatgtaattagtatgtaatttttaaatttacatttataattttagtacttacatatgtaattttgagacttacattgtatatacactaaaattacatatgtaatttagggacttacaatgtaaatacatgccgactattttttgatgaaaaatatgacgccataaatatagctacacccatgtcaaaaatcaatttcaaactatatttacaaattaagaaagaaaaatattcaggtgtgaatattaccaaatactagtatcatacattgaatctcttttttatttctcgatacatagtttttttagacttcagattttctatgtggtatatgtatgttgtataaatgctattaaatttttaaatatttttttcgtagctatttgaatgtttattttacaaacgaaagatttcccgagcgattgaaagagttcccttcttcaaataaaagaagagtttcccaaactgatgcccttttgtttcctccggggatactgttgtaaaaaaaatacgaggcacggcaccatgataaattaagggactataataacaataaaatattaaaatatgccgtcataaatttagcaaatccgtaaatgaaataaattgatcttcaatccgttttacagtacaagaataactcagtccttcgagctaacgggtcctcctcccttaacttccattgacaaatctgcagctcttccggacctccccctggctgcccgtcagcggctggatgttccccatgttgaccatggacctggcgaagctcttgaagaaggccttctggctgatggcgaagctgttgacgatcgccgccgtgggcgcgcccggcgtggacaggagctcctggtcggactggaggaagccgcggttcacctcgatgttggcgaagtagttcttgtcgaaggcgtccggcgtggtcgggtccaggtcgttcagcgccgacgagttcccgccccgccgcgggcagctcttcgccagcgcccgccggtagccggcgtccagcgtcgggtccggcttccccgtcccgctgaagttgtacagcctgtccgtcacgaactggcactgcaccctcccgaacgtgtgcgcccctgcccatttacattcattttcacccacaattttcagtttcagttgattgctattccctccgtttcaagttataagacattttaactttgatcaaagtcaaactgctttaagttgtaaaaaaatagtaatatttttaacacaagacaaatttattataaaaatatattcaattattgatttaatgaaactaatttagtattataaatattactatatttatctataaaattaatcaaagtctaacgttttataatctggttcggagggagcagtaggtagcgtcgtacgttatctccctatctgttactctgtttatttacctgagagggcgacgaggtcggtgacgtcgaggccgacggcggcgaacttctgctgaagggtggtgaggttgtcgcgggggctggggaggttattgtcggcgccggtgaggttggccgtggtgccgtcgcgccggccgaggggcacgcgccaccgggggcctccggactgcacgcattgacacacggacattgtgggcgtcatgtggccgtgttggagtaaagtgcggcacgaaaagaagggatttggtgtgggatctcgacgtctggtcgtcgacacagccgatgccacatgatgtgtgcgaggacataatccacgtcgtaccatgtggtctctgttttttggtgctcataggattattatttttttacagacggttaatgttggtgagattatgatctatctgcagcattgcggttcaattatttggcaccgacgtctagctagctttatgtctcgctccagtccagttcccagcccagtcacgggcatattgtaggctgtagcgtcaacctttctactggagataaagctagcacgaactactagcttgccagtacgttaatttgtcactatgctggcgtgaaaagtatgtgaaagaacgtagctaaactgcttcgttggttagcttccaatgaagttgacgtgcgattgttatcgggagataatgacgggtttacgtgcaaagcatatgcacgtatatatatacttcgcgccggcagatcgatttctcgcgagcgtacacataccagttcgacggagatcttggcggcgatggcgaggatgtcggcgcaggagacgacgccggggcaggcctcctcaagtgccgccttgatgtcgtccaccaccgggtacccccgcgccgagttgttgttcggcgtcgcgaacttctccgacacgatgctcgtgctgttgtccagcaggatcgacgcgtcgcaaccctggaaaaaacggaaacgtcgcgtcagacgaacatcctgcgtggcgcggcgtacgagtgcgcgcgtgcacgccggcaatggtgtggcaatagctagctcacctggacgaagcagtcgtgaaagtggaggcgggtgaggctggcgaaaatgcgggggtcgtcctgccgcgccctcttcagcacgcgccgcacgatccggtgcacgtccgggcacgtcccgtcgtagtacttgtcgcacagttgcgccgacgcgccggccgccgccgcggcgagggccacggccacgaccaggaccgcggcacgaaccgcagccacagcgcccatctctctctctctctctctctctctctccgctgcagccttgagctagtaacgtatgtacactgctcactccgtgacgcacaaatgagaaatgaccaagtgttaagtcggtgtgacgaagaagaaaggaagctggctatatatagacacgcacacgcgatcaattaatctgacatgtgtatgacatatctcgccatgcacaggcttaattgtttaagtatgacaaactaactagcggcacctttgcttgaacccgaaggatatataaccaatcattcgcggaagaatcgaacgtgttaacaacgtagatagctcttcggctatcgcggcgtcgttttcagagtgcaacgcatgcatgcatgctggtgtgcgaacagaaacactgtgctttagaatagtttcccctttgcatatggccttcccttccctgtgcgttcgttgggtgcacctaattctctcgcccgatcgtgtgtgctagtgccaccagattcaggcagtacaacgctgactcccgtttagtttcagtttgttgcaggtgcagcaatgcagcagctaagctgtgatgccttgactgcacggtccctcgctctccccatcactttctgaacgaataattgcagggccaatgaaagtagtagtagctggcaatatttggagccttcttcttccatcgatcgatcagagaggtggtcgttggtcgtttggaggggaatgatttctccggttgagtggttgctgacaactagtgctatatccgtacgtggtaagcatacacaaattaaggacaacgtacctgcttcttccctctgaatattttgtgtacagtatgtagcttgtacagagttctcgtcaaactaaaattaaactcctcaccgacgtttttccatgacattttagcgaatttttcaccctttgtccttctccaaactaaaaatctgcctgtcatattcaggatcatcaaggcatgatttttggccacatcatcagtcactgtatcatgcaccacgtaatgaaaaagtagttgcagtagtagtacgaaaaagctaaacctgattggatgctggagagaaggcgaggcatcgttctcggaacataagtggtcgatgatgagattaggtggcagatcgatccagaaatgcaaagtcaaaaatctaaaagtttctttgcaacggagtcgttagcattcattccggttttttccttgcttgttcaaggagctgcatcattcagttcggaggacgtacccgagcacctactgataaaaccatatggcagttgcatattctttcttttactctgatagacacagcgcgtttgtctgtgctctaataattggtgatacacccactgaaaatgcagctgcagattcgtgtaggacgagcaactttgcatgctaattgcttattctactcgtgcattggagagagaatcctagatagcttgaacaaaacgaaacatgtagcgctccacaacacattaaaaacgacagattcacacttgagtccaagaagacgatatagcttctggcaaatccaagatggggtcatggcagatgcaaaaaatctttgcctttttgctcatcagttgacggccctgcagttcttgcgaatctggccggcagagccggtgagagggctgatgttgcccatcttgaccatggagttgccgaagtcgcaggagaagcgctggccgttggcgctgtaggcctgcaccagcgccttggtggcggcgacggcggggtcgccggagctggagacgaggccctggtcggaggcgaggaggcccttgttggccagcaggttctggtagtagtggttgtcgaacgcgtcggcggagttgacgtccagcgccgccagctggtcagcgccgccgcggcacacctgctgcaggctggacgccagcgacgagtccagcgtcgggtcgacggagttggtcgccgagaagttcgccagccggttgctgaacagcaggcagcgagatcgcccgatcgtgtgcgcccctgttcaggttcagaagagttcagatcagtcttggattgattcgtagccaaacataactatattttgaaacggagggagtaacaaattggtgcagaaactagtttttgatctgacaaatgctaaatcatgcataatccacgtaaactgctatgcatgccacaccgagtagagtagatgcgacatcgttattgatatcataatttgtgtctttatcaattcatttgtcaaatcccaatcaatgtttgattgaagaattgacgaggtaatttttgctcgatgcatgaagatataggagatagatagaggtacctgataagaccacaacatcggttgcgttgagaccgacatccttgaacctcgcagtgataacgctgatcgaatcgaaagggctaggcaagttactgttcgcccccgtctgatttgccaccagaccatctcttcttcccaggaggacatcataatcaggtcctccactctgcaaagaccaacacagatatattcagcatgactgaaaaatcaattgttcttttgctcgattggtaatactatagtgctttactatcaaagatgaattttcatccctccattcgagacataggaacgtacaagtagtactccgtatttagctgcaagggctactatgtcggcgcaggagacgactcccgggcaggcgctctcgaggtcggcctttatcgcatcgatgacttcgtaccctctcaccgagttgttgttcggcgccgcgaacttctcgctgtttgtgccgtcaaggaggatggacgcgtcacagccctgcagaattcacagtgtgtcggtaagaagttcagagttcagtctctgaagttcagtaacatatatcacatgaaagttcagagtcctctatacaggttaattgagatcgttaatttcattttcttgtttcggtatgtgtacgttttgaatgcgacttgcatgcacgtagtgtatctagcgcactgcaatgagcagcagaaaaaggggaaaaataaaatagttggatgattacattacgaagcagtcgtggaagtgaagcctgagcagggaggcgcccatgcgcatctcggccttcatcgcggcggccaagagggaccggacaatgcggtaaacctgggggcagcaatagtcgtagtagtcgtccgtcagctgcccgctcgccgccgcggcgcgaggcccagcaagancggcgatattgcagaggaaactcaggcagctagccgtgcgatctccacgagtagcgtactccatggccaatcgatcgaattgtaattgatcttttacttatgcacttgtgattggactcgatgtctactcgcattgcttcttgcagtgctttatataggctgttcaaagtggccagtgattcagtgttgtcactgtgtcagctcatatcatatggaattatggatatcaattctttttggacaaaggttagacctcgtgcatgaatggcagagtaaatgggcggctagtgagagatcgatgtgtcgtcgtcagcttccataactggtaatcagttttccatatgctgcatgcatggcgatgggtcattggacgctaggacccttttcagcgtttctgaatctctgactctgaagaagtgtgtgatcttcnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30124 - DNA, 967 bp, Oryza sativa
tagaatcgaaggcgccaattccttggttcctttacgcttagttcatttgttccaaatggatgaacaataaactttcacaggtatttacaattttccatgagaaatctatatgagctctattctattctttgagccaaccactggtcacgttttttccccttcttgcattataaataaacaagagttgtggtcacaatcatatatatttctcataacgaattccttatcgctgaattttctatgcctacgtatgttcacttctatagcaagcattcatcatagttatattgctatgaatgttagagagagagagaagtaggagtcattgagtatacacctaaccattcaatccaaaatcaaacaaccgaagactacacactccctcacaccgataagtttttctcataataacaaaataactcatcgaatataactgtactttatacaacatgtcgtggtcgttaacatggaatacctcataacctacaagctcacatattggagactttaacttttatcaaatattttgttccaaagcttacataagcatatgaagaattgggggattaagattctgaaaagccgctggttagtagccaacttttaagaacataaaaaaatctatatctttcagtttttagttttttaactacgtaattttagaatctagatgattaaagatcttagataaattttgctagaagctccttagaagttattatgacttgggacggagagactccgagagcgctgcaaccgcaaacccgcaacgcggccgtgctcctcgaatttgacgagatttggcgaagccgcccgcgcgcggcgcgccctcggtccctcgccaacaacaggcgcgacgaatccggttcaaatccattaaagaaaggggccccacacgcgggggccacttcaccgacatgtcgtccccaccgccgcagcgcccgccagctacgttcccgcccgcgcc

SEQ ID NO: 30125 - DNA, 97314 bp, Oryza sativa
ccgcagcatcccctggcgcccacgcatggccggtcgttccccgccgccccgagggcggtggtggcaggtgtgtcgtcgcgccccgagcagcctccccgaggagtccctatagctcagcaagcacagcccaaggttagtgactaattttagtctgcgagctttgcaaggaaggggaactagacgagaacttgaagtcttgaacgttctactctctagagctttttaattaaacgctacttgtagatttcggtggcgatttatggtagattttggaacttattacctgttgggcatgctacgtttcatgtgcatgttgaattgcttagtgaacttatatttggtaatagcacaatgctacttctgaggtaaattaggcccatgtgaatggttccgtactggatttagatcttgtaaaagcgaagacacgaattcatgggtttttttattgttattttgattataaatggtgctggtctattttgggtgctgtgttaattaggctattccttattgataaattctggacttaaatattgtgaattttgaagttccttaaattatgcttttctggcatctttcttaggtcattccactaccagctgtaactccatctcctcaagagatcaacaactcaaaagataggtaagaaaactacaaactgtagtgtgttatctttttcttttgaggggatatagttacaaactatagtgttttatcttttggacttagacttcccaactgtcaattttgattgtttatttgtagtgaaaggagcaaggaggactctacaacagtggttattaatgaccgtaaagtaagtttatgtttcttaaacttttttctagaacatttgcgctgtgttaatgcaaatacattggctagatgaggagaatacctgtacctttggatagttggaacatgcccaatcacttttgcccattatcatgaatctttgggataccagttatggctcaccttagacgttttatatgatacaaattctttttctttgctctgattagtgacactatttcagctcctatgataaacatgattttgtttggtttaacatttaccaaagaaatttaaaacgtacggctcttcacaccttattttttctgttcatgcaaatgcaaattgcttctatttcacaattcattttcttaattatccaaatggttttgtagatacttgggctacgaggctgaaattctaatttctaaatataattggcccacatatgaggaacctcacaatataatctataccttgttttatcccgacagatcaagtggacagcacaaactgacatttctttttattgttccaaaggttaacttgatggatagtgagtcaggatccttgtatgcactttgtcgatcatgggtgcgtaatggagttccacatgaaagtcaggttagcatgctcactcgttacaaatgaatgatttgggcacttgccatgtgaaaatttctctatagttatgttaaactagatcctaacaggttcttacacgcctcaattgtcattctggtggtcttataatttctagagttactctaaagtgtatttcttctcagttataatttataaatgcaattctaggactacaacttgattgattatgttgtatgcctgaattttcctcttactactttgaacggacacacatttgctctctgttatttaaagtttggtttaacatcaacaagcttcaaacttgtgagaattttgccaggtgcactttgtatggattgaattgtcctataaaatgtaattgcctagtggagcgatgtctcctgtagagacaatgtgagttgttttgcactgcatgctttcttctttcctttgtactaatagacaggcaaggctcctgtcactttactcccctccaccaccaccacaaggaattccccttttggctcttaatatgtgaatatctgcagttcatagtccatattttgtatgtgcatcatgctatccatgcacttgtcttactagttcttgcagccaagctttggaactggtgcaccaattcttccaagaccactgcctgcttcagtcgtggactctaggatatcagaaaaggacaatgatgctgagaaagagaactcagaggaagagaaggtatcttgtaaaaaactaactttgaagttttgatctttgattcaatgaatctagcattttagttatgctaattcatcgtacagcataacacttagttatattctttccaggcaattctggatcatactggcattttctgatttttggcatgtaagcgtgtatgccttttataactaatattatgactaatacatgcaaaaattgctgtatttcttaggagttgcacataccaactctgaattttacgctttaccctgttatttaaaatgaagtatattgtctatcttatgtcctgcatatcccactcttgcttatttgcagttgtcttggtccattatttgcccatgtgttccatttgctcccaaaatagttagatttgcttcccagttacaaccttcaataatattaggtattaggtgacggtttcatccaacatgtttgagaaatccgggttcatttcaaccttgccatagaaatgtagtatcccaaaaagttcttgagactgaagggataaaggagtccctttttcgtctgtaaattgatattcttggggagagctacttgcttgtgacttctgttactgaccactttgtagctattgttactatttccttctattatcttttctatcaccacaagcatagttttttacatctataatcgcagtgttactatattagctcaaaaaccattggctttgatcttctgtgcagaatgaaaccggtgaatatactgcaagtgacttgctgaagcagcatgtgaagcgtgcaaaaaagatccgtgctgggtatgtatttgttttcatcttccagcccttttacgtatgatttgtgaagtgagcaagtaagttcaaaatatggtgatgcaatagtgatgattggcttttgcttccaatatgtaagtccagcttgattcttcaggtatccaacgaaacaataatgatgcactagcaaaaatggtaagaagatatattatgaaagtgtttcacaagacaaatgaaaatatgtagtgtgatgttgtcatgttgattgttttggtgtagtcagtttatataacatatattaacaccttaatcgcaagctcaatcaaacttatattgctgggtggagatattaagttagctaacttaacgcccttttatgtggtgtagtggagaggttttaggttgtcattttgatagacggcagattgaaaacattagttgaggaatggctgtttgagaatgttatcttcattagacagagttactgagtgttgtgttccactttgacataaatttctttggcagtttgcaaaaggagcggctccgacggattgaaagatacaagcagcgccttgcacttctcttacccccgcctagcgagcttgggaagcatgatggtcattcgtagaagtgtaaaaccgacccaatttgtattcaagtgttgtagtagctcttatgtagccttggtgttgccgttttagttaagaaaagaaaaatctgaagaagctgaaacagcatttcatctgctggcctgtaacttcgttagcatagtcgttcgagcgacatatacttacccaacaacaaactttgacctccatgtaaacgtcttctccggctgtgttcagcgtttgagtttaacatagtttatgcaatgacttgtgctatttatgctgctggatgtttgtactagacaagaaatttgatggctgtatgcacgagtgtttttgcatgttgtgccattgcgccttgaatgcatgattaataatccttttgtgcttaatcccgtcgttacttcgtcttagaaagtatctgtcaaaccatttctcttttgatagaagctattcatttttacctttttgcgtagctaattattaattcacgtgtacatttcaatcttcatagaaaagaaataactaaacgaaattaaaacataaaacacatgtgcaatctattatattactaaacaaattgaaaggaggcaccatgttcgctgtgggggctagaaatttccacattaatcggagaaaaagaaaaggagagtccaactagaaattcgaaataactgaaattcggaattaaaaataagtacggttgaaaagagagttcgtataagaacccaatacaagattaattaatattcagaataaaaaataaaataaatccgaaatttgaaaaaacgaaagaagagttcgagtagaaatacaatttaaaaataactatattattaaaaacagctttaaaaggaggtatcgcgtttgctatggaggctagaaattctaacattaatcgaaaaaaaagaaaaggagagtccaactagaaatacaatttaaaaataactgaaattcggaattaaaaataagtactattgaaaaaaagagtccatataataatccaatacgagattaattaatattcataataaaaaaatgaaatccaaaattagaaaaaaaaagaaagaagagtttgagtagaaatataatttaaaaataactaaaatttagaattaaaattaagcaatattggaagaagagtccatataaaaacccaatacgagattaattaaaattcagaaaaaaaataaaaaaatcaaaactagaaaaaaaaagaagagttcaactaggaatacaatttaaaattaactaaaatttagaattagatatatgaaatattgaaataagagtacatataagaacccaatacgagattaattaaaattcggaatgaaaaataaaataaaatctgaaactagacaaattaaaaatataattcaagtatgaatacaattttaaaagtaaattggaatcatgccattataattttgcaaagtttgagatatgtcatcggtatctcaatgacatataggacccatatgagtcaatgacatgtgggtcatgatggcatatctcaaattttacaaaattataatggcatggttccaattttccattttaagaagactgaaataaatattaaaagaacacaatacaatattagttaaaattcgaaataaaaaataaaaataaattatgaaattagaaaaagaaaaataagatttaactaggaatacaatttataaataactaaaattggtgataaaaaataaagactattgaaagacaaagatcatctaaaacatatgacgagattatttaagtaataggcctataaaggagtagagtgatggtggttgatgggacatctaaaaactattaacaaaaggaaggatgacgggcaggccgtgaagcaaccggttaaggtggttggcgggacttctataaagtaaaaaaaaaaccaatgataatcatatttgattttttaaatctcaatgataataaaatgaagaggcagtggacgggttgtacaggagtacaatggcaaagccgcggatggttggtgtgacttctagaaattaaaaaatgaattccaatgatagttatgtccggtttttagaatcccaatgaatataaagagtaagcggcggacgggtcgtacaggaatatagtggcatcgtttgacgtgatttcaaaaaattataaaaaatgaattctaacgagacaataaattataaaaactataaggtccaactttaaaagttcggtcttctaaaaagtaaaaaaaaacttcaatgatattcatgtttgattttaaaatctcaatgacaataaagaaggaaggcaacgggcgagccatagaggagcacattgacaaagctgctgacgttttggcggaacttcttagaaagtaaaaaatgaacccaagcgataattatgttctattttgaaaataacaacgacaataaaaaagaagaggtagtggatgagccgtataggagtataatggtagcgtttgacgggacttctaaaaattataaaatcgaaacccaacgggacaataaactctaaaaaccataagatctaattttgaaaggctccaaatagaatgaatagaaacagtgccagatcggacaagcaaataaagaaggatataacagaagtaacagatagcaactggtgtgacttttaataaaaaatataaaattagaaacatggaaatgataagatttgaaatttcaaagtcttaacaacaatataactatttaataaattttaaataaaatcatattaaagatatataattttgtataggtgctaaccgcgcaattgcgcgggccacccaactggtttcctttcaacaaacaatttcacggagacgctgatcaacctgatgatcagccgcggttgaccaccctgcagttcctcctgatctcccccatgctcccggtgagcgggctgatgttgcccatcttgaccatcgccgtcgcgaagctcctgaagaagtcgtcctggctaccggcgaaccacacgacgatgggcgcggtggtcgaggcggcgccgcccggcgcggagagcatcccctggtcggactggagcaggccgcggttgcgcaggaggttgccgtagtagctattgtcgaacgcgtccggcgtgggcgggtcgaggttgcgcagcgccgcgctttcggggtcgctcgccgggcagctctgccggagctcgttgaggtaggccatgtccagcgtctggtccggctgctccgtgccgctgatgttgtagagccggtcgtggaagaacctgcactgcgccctcccgatggtgtgcgcgccctggagagcgacgaagtcggtgtcgtcgaggttgaattcggagaatttccgtctcaggaggtccagatcgtccgtcggtccggggaggtctctggcgccctcgaagttcgccgccgtgccgtccctcctccccagcatcacgttccagctcggccctcctgactgctcgacaagaaagcgtacgtgtcagcgatccacagatactatatggttcggcgtgattgaatgtttgatggcatgggtgcgtgcatggactgaccagctcgacggagatctcggcggcgagggcgaggatgtcggcgcaggagacgacgccggggcaggcgttctccagggcagccttgatgccgtccaccacgtcgaacccacgcgccgaccctttgttcgggggcgcgttcttctcgctctgcatcgcgccgaagtcgtcgagcagcagcgacccgtcacacccctgcacacacaaacacgttaatcccagctcaaatatgtcacgcaaacgccatgcatggcacgcaacctaggacacactgtacgcacattgacgaagcagtcgtggaagtggaggcggaggaggctggcgggggcgcgcgggtcggtgcagcgcgcctcctggacgacgcgccgcacgatgtcgtacacgcttgggcacgacgcctcgtagtacgacgggctcatcaccggccaagcgctcgcgccccccgccgccgcgaggacgaccagcgcgcacaacaccaccacagaagccgccgccgccatgcacgccggcgaattaaagtgatctcgctaggaaatttttgctctctgtgctagctatatctatctcgccagctacctcagctcggtgactgtgagattagctaagcttggtgttgcgttgttcgtggagcggacatggcgtcgccgggtgtatttatataccagggctcgaacgaggtttgacatgttccggctacggtagttgcagacgccgctttttcgtgcaatgatgtgtggactccctccaacgccaacgcgtactacttgcctacttgatcgtgtacttgtgtagtggttgagcacttgagctgatctgctgatgtgacagaaggggtctaatttcttgatcgtgaccagatagaggtgattactcgagagagcaactcgtcggccagaaatcgctgaattgttagtttattgtattattattagtacaaacagtaaaccttttagtattatactctgcacacacgcattagataatttcaaaagcgtgcaacatttggcttgtcaggtgttttgccttgcaccttcttcaggcctccaactgctccagtatttaccagttgatgaactggtcttggattcttactgctataagtaattttcgtgacatagaattagtctgatgattagaagggatcttcacgtactttcttatgagtctgtataactgaaaaaatcaactcaaactaagcatctaactagtacaagaacgtttacttcttgaagaaaaaaaaaaggcatttcctaattttttttagtgaccaatcatctacggaactaggtgaaacccggcgcgttgctgcgggatttcagtatgataacaataagtaaaaataatatgtaagatggctaacaacatatacttacataagttgatatggtttatgataatttaaatttaaatagtatatagacgattcaaatgtaaaagtaagatattgaagtattataagagaataaagggagtgagatagtttggaccatagattaatcatttaaggctaaaaataattgatgtgatatgatttaatgggagaagagagaaataacactaactaagtgaggatgtaccatataggtatatatgatattatcataaatgatgaagatatatattgaaatattatgtgaattatttggagtgatgatttaacatgtttacatttttaaactctaaaatttaataaattataaaattatagataagataacatgcttgtatgatgtttaaatgtaataattgttaatggatgatgatgtgatatattgttaatgtattatgatgtgacatctttgcatgttgagctttagaattagtgggttataactttatagtaagataggataagttcattattgtccctcaacttcacgttgagtcagtccgaggtccctaatctcaaataccagaaatcttcacctctcaaatgttcaaagccgtacaaaataggtcccatagcataggtcccatagcattatatatgggtggttttgctgacatggcatccgcctagtcagcaaagaaggaataaaaaaattacagagcccatatgccatttacagagcggtgccgcgccgtggagttgaggaagatcccgaccttggagaggtcggcgccatcccccacaacggagaggtgggaggagatgacggaagcggccaccagatcggaggcggtgagataggtatcttccccggagaagtacgagaaggggtctcggagaccgtgctaggtttgacggcgagggcgtaggtgccgccacgaccgccgccgctgccggcaatggaactaatcgatgggcgctggctgtggcgatgggaaccggcttgcgagaagaggacgcagagctagaggccatagcaacgtaggagaatggcatggccggcggtgaggtagttgcgaggatgaagcaggcgaagccagctggcggagcggtgagcggagcaagccgctcgccgccgcccgctgccgcgctcgcccgcagtcgctcttttttctgccgctggcgcccctgctccgctccacgcgggcgcgttgctctgcctactcgctctagactcttgtggtcttgccgccacccgcttccacatccttttttacggcgaagagaaagaaaagagaagagaaaagagaaaagagaagaaagaagggatgcataccccacatttttattcgtctcccttacatgtgggtctagattgctaactgggatgccatgtcagtgaaaacacccatatatactgatatgagacctattttacacggttttgaacatttaaggggtgaagatttctgatattggagattagggacaccacagactcgacgtaaagttgagggatggtaggggaacttattccatcatcatctacctcggcaagaacttgcccggcccactaactagaggcgcagctgggccaactattccctcggattgtgcggaccatttcggctgcccgtcttacactccacgctcccctcctcttcagaccaaaccctagctcgcaccgtataaatcggcgaacatccagcctcctctccccccgccgccgcagcagcaaggagctagagagacaaaggggagagagccccggggaagaagaagaagcagcagctagggcgccaagatgcaaatcttcgtgaagaccctgactgggaagaccatcaccctcgaggtggagagcagcgacaccatcgacaatgtcaaggctaagatccaggacaaggagggtacgcacccactacaccctcttcttcttgttgttcctcctccttcatctgtggctttgcggcggtagctcatgggggtttgtgtcggcaggaatcccgccggaccagcagcggctgatcttcgccgggaagcagctggaggacggacgcaccctggctgactacaacatccagaaggagtccaccctccacctcgtcctcaggctccgtggcggtatcatcgagccgtcgcttcaggcgcttgcccgcaagtacaaccaggacaagatgatctgccgcaagtaagctacaaacttctcaccaaatcatcttactttacttttatccagccatacaacatattcgttcctttcttgatgctatggatagtggtagcatgtttataagcaggctagctagccagcgcgtttctcctgtacttgtgccgtttatcttttgagtatatggaattgcgttcgtcaggaatggagccaaaacctagagacacatttttattcagccttggaataaaaaagataatatttttattgtttcgttacttatttgtggtgcactcttctagctttaaagataagtcacttcggtcaccattaagtggacctgaagctttcttttctgaagagatgcaagataaattatggggacctctggacatgcggcttcttccagtagattctcgcattttctcgtaggtccaacacttatataacattttatcccctactttcagctattttgtgagcatcagagtagcaaaaaacagttatttggctcgatgatgactactcttgctttaaccacaccgaatttgaagaccggaggaagtgtaaaatctcatttctttcattactctttgctcttccttctcggtgattccttatgaaatctcttccttttggtgaagaactactacggaatttattttcgtagtttttgtcctttatcaaaagattgcgattgaaggatgcagcgagatagtggagcatagtgtaaaaggaagtgggaagctatcttctgatggatcttcatgtgtggaaaactttggcctagactgagagccatcaatgtaaatgcccttagatttttgctgtggccatcagttctgggcacattgtcttcatagatactccggaagagtgtaagactctggaagatgcaccatgcacggccaaagaatttccatgttggcatgttctagacagctattatttggtttagtcttttgtgttattttttctgtgttttatgtgtcgagtgtgctacttttctacctggcagtagtgatgaatcaattagatgtgtgaagtgaccttatgaacttaacttttgaggcatacattctgtctgaactgccatatgtacttctcttcatagttgcaaattgcagtgcctatttgctttgttcattcttgttatttttggttattgattatcggtgtgtgaatttggttttctttatttgtttgtatggacagttggtccttttttaattggcaggaatgatgaatcaattagatgtacgaggttaccttatgagctaaaattttgaggcatacaattgtctgacttgccaatctactgttgtatttcagtgtttcgttacatgtctgtggtccatgttctcttattttcaattgcctatgtatgtgcatgcttttatttgacatgctatttgcaacttttcatgctgtacataactcccaaggggtcatgttttatatttctgtatgtatcttggactgtaaaaaaacaaattttaactttgaccgaccttgttatttatctacagatgctatgcgcgcctgcaccctagggctgtcaactgccgcaagaagaagtgtggtcacagcaaccaggtgagcttgatgattgatagtggggcttactattattttacagtagtcatgcaattcagtccatcttctggtaaccctttaggaattgttatgatgattggatggaagtagggttttcatatgttctagatttgttatttgtgcctttaagcttgtaaataatggccatggcatttgctagcatgatttcaataacatataccataacatatcaacataccctttttattttggctgtttgatctaacgaaaatttctggtccttccactttcagctgaggcccaagaagaagatcaagaactagagcgtcactcgccgggttcatggactggttaaatcaatcgtcatattagacttttatgcttccgttgttatctccctggatgttgttgaaccgtgttttactgtgctggatgcttcagcttcttgttttgacggtcgtggtatatggtaattggcagcaaactatattggtcatgtcgaaattgtcgtgcgtttcaatattttctagtgttgttttcgatggcaagcggctctgctcccaggctcccaggtcccagctctctgctcgaccttatgtaaggtgtgcaactgtggcaagtcacacctcgtttgcaatgttaagagcatcaccaagatccatccacaaaatttagtttccgtgaatcccaaataaaatttaaggtgcaaaaaataactctcaataataaaatgtgggctactcttaagtcttaactaccacggaaacagaaattgctatgcacatctcttgctataaattctatgcacatatctttcttcttgccgtaggaagaaaattgagaatgagagcgctttccgactttgtgaagagaatgcattctggtttagagttttttttaaaaaactttgtgaagagagtgctttctgatttatggagaacgagaaaggaggacaaaatgtaaatttttaagacatatttgaagggaatcgttagagcacgtttttcacataagaaatccaaattttaggattaggcttcacaaaggaatacgataggccatgctctaagcatcatccaaacaactcctacatatcgaagcttaaacacagaagaaaaccatctttatttatgttgaatcacaagaacaaaacatcaggccgtgcttacaacaattgtaacgtacacaccgacacactcagaaaaattaaacgagcaaattaaatggcacaaagtgaatgggcgatcaagcaacgaaatcaacatgggctttcaactatttgtcactcttacgaatggtgcttaacgatttaccactagacccatacgtcatagacacatgaggacccacatgttatagacagtgaggggtaaatcgttaattgtcatatcataagagtgacaaatagttaaattgatttacacgggacgtcgatggagaatcatgcatgaagctgaggcagtacgcttataacagagcgaccggcttcatcccctccttgatggccgcaaccaggtgctcgtaggcttcgccccacgcgtttttcatctcggggctccacatgctcgccggaatcccatctttgatcgtctcaagcagcgcgaacctcgccacctgcagtttaatttcgatgcaacaacaccatcagaacacggtcgagttttcacgtcgatcaaacgatccaagcaactcctactacatccgtcttatactcttatttcaagtacaactatcggtttctatatccaacgtttaaccgtccattttatttatttttttattagtttgtttgttattagatgataaattataaataatattttttacgtgatttattttttaaattttttaataaaatttttaaataagacgaacggtaaaatattggatataaaaacatttggctgtaattaaatgggacggagcactacgtatacatacctcgaagtgggtgtcggagacgccgttcttgaagtgcgtggagcccagcctcttgatggtggtgtccctcacggtgaccctcccggttttccgcagctgcgcagccgcctcacacgtctgcatgcgagatccatcgatcggttgatcgcggcaaatgcgcgcacaaaatctgtcagtgtcagctgcaaactctagtacaaaggtcggcgaaactgttttttgtttaccatgacgaagacggccatggcgtgtttcttgagattggggttcttctcgagcggcacatcggagtttcgcaggaacgagaacagatggcgagccgacggcgcgacctcgaagatcctggagtacagatagagtagcagcagcaatcgatcaacaaatgcacttgaaagttgcagaaaacggcagtgaaatgtactcatactacgtacttcaagaagaagcggtggccgatgttggcggaatcgtccttcatgatagcccacgacttgagcaccagcgcctcttgctcctcggtgaacctgaccgccccgttgcttgcgctcgcgaaagccatggccttcctgaatgaatcttgatctaccaagttcctgctttgatttcacaggtgatcgattcgatcgcagctagatcaacccgatcgagctcagtgcaactcaactgctggatcgatgctatgctatctgaatacaaactgcagcagtgcgaggccgatttatactggtcgatcggtccggaaatggggccggccattggctgtcgatcgtgtcgacgagcgagacgcatggtggtggcactccacgtccactccagctgcacggaaggaagcagaaaaacgacctgaatatggcgaatatccgtccatgcaagccgtgaaaactgtgtgcccgagtgcagctgcgagagcgggaagctgcacgaaggcagcatgcctgcaactctgcattgtctcgcggttgcatgatggattgatgggggcggttttgggcgcgccgcgcgcggaaaccagcggcaggtttgagttaagaatccagtttatccaagtcaaaccatccatggtcccggcccttaatttctttcttgcctgaagactcgaactagaggcgagatggtttgttcgtgctgcccaaaagggcagtggtggatggaacgttccacaaaaatgggagaaggtgacgaccattttttggcctaacttaatacatattgttacaagaaaaaggtccactttatatccctcaattataggttgagttttattcatgtcgcttaaccgcaaaaccagatacggagcatttctcaagtatatgagatataccttatccataacattgataaattttgcgttaaaaaatctacttgttatttactatatatatacactaactgtacaatttaactttaacaaagatctcgtaggcagatgcggggtgctcgaccgcacaagggctcccaaaactaaaggctcttataggttttaattcaatcaaatattgtgttttaataggtttcaggacatccccattccatctttgtaagtttcacatcccctcctccagtgatctcgctggaacgagtatgtttttttttcttttgctttgataagtctttgagggtaattatagtcccctgaaatacacatagctcatgacaactatgtgatcacaccgttctagatattgaagattatttttttttatatttcgtaaataaaacataatcatttcataagggtgcaatgattttcctaagcttaaaaaaaccatcaccggtgaggttagtaagcttcctagcttggctgtccatgtgtttatactgtgttctcctatataaatccagccgttgttagtcgtgcgttgctcttttattgtttagagggagcacattagatgggagtgcattttcatccttgaggagatatccccttgttatctacatgtcacttaaatagttatgaaaaaaattgagaagatgtattaacatgtgatatatcactctacaaacatgcaagtttaaatgcaagttgtacatctcgcaacgaaaaaaacaaattaaactacaactagttaacatatattcacaatcaaatttgtttttttcgttatgaaatgtagaagttgaatttgaacttgcatgtttgtagagcgatatatcacatgttaatacatcttcttaaattttttcaatttttttcataatcatttgagtgacatgcatacaacgaggggatatcccctcgagggatgaaaatagtttttccacattggatttagggacaatacttctgatgtggatagaagatcaccagccacatcgtggctgtggtctgtggctgagcaaagcatagagataatgaatattacaatgaattgtaaattatgtggcattaagtgaaatagtctataacattagtttatttgtaacttcaatttacatgcacagtcaaaagtaaactctactattttacttgctgatatttttaaaatagagggtcttatcgtaggtttagcgccagggcctccaatttataggatgaccgggggaaagtgattttatccctcgagagaatatccccttgttttatacatatgccacctaaatagtcataaaaaatatgaaaaaaaatggcaacgtagattaatatgaaatatatcacttcacaaacatacatgtttaaactcaactactacaagttgtaacaaaagtaacaaatatagttacaaatgtgcaataactattttcagtttaatttgttattttttttgaaacttgtagaagttgaaatttggtcctgcatgtttatagagtgatatatttcatattaatctatatgtttttataattatttagatgatatttaaataacgagggaatgtctcttcgaaggatgaaaatccacattctaatgatcgaaatgatataagtcggctgagatgtacttgccccaattgtcttctcttttctaaatgttacatatccaagcgcatgcatgacatgtggaacaaaaaaatgtctctttattaatattttgtcacgagtagaaaaacaacagtgcttgcatccaacgtacacacacggacactccattctcggcgaagaatatatatcagacgagcatatatataatggaaaaaaaaacataacaccaatcggcgagcaacgaacgatgtcgagatatatatggaggatcttgattcttgaaggcttgaaggtgcacacgtattacgcagcagccggcttcatcccctgcttgatggctgcaaccaggtggtcgtaagcttcgccccacgcgcccttcatcgcggggctccacatgctcgccggaaccgcctccttgatcgtctcaagcagcgcgaacttcgccacctgtttgttttacaaaaatcagaacacgatcgagttttcgcgtcgatcaaatgatcgatcgaagcggccattaattagctagagatacctcgaagtgggcgtcggagacgccgttcttgaagtgcgtggagcccagcctcttgatggtggtgtccctcacggtgaccctcccggttttccgcagctgcgcagccgcctcgcacgtctgcgacacacgcacacattctccgtcagtgattgcggcaaaatcttactcatcgacggcaataacgaactatatatggagtagttctaataccatgacgaagacggccatggcgtggatcttgagcttggggttcttctcgagcggcacgtcggagtttcgcaggaacgagaacagctggcgcgccgacggcgcgacctcgaagatcctggagtagtacagatatagattagaaccaatcatatgcagacacacacatcaacaaatgtacaagtgaaaatgtattgcttaatgcttgagaaacacatggttggtgcagtaactgattctgccaaaatggcagtaacatttttcttacttaaggaagaagcggtgcccaatgtgggcggagtcgttcttcatgatggcccacgacttgagcaccagcgcctcctgctcctcggtgaacctgactgctcccctcgacacgacgttgcttccgttcgcagccatggcttcctgacaaaattcctgcttcgatgtggttactctgcgtagcaagtgatcgagcaagggacactgctagatcaattcaagctcaactgaactcaaatgttggttgctgcctgaatccaaactagagcgtagtgaggctgatttatacaggtcgatcggtcccaggatggagctggatttgatggtcgtcacgagcaagagaagcatgcttggtggtggcactccactacagctttacgtactggccgaaggtagtagcgaatatccatcaatcaaacccgtgaaactgtgtgcccgagagaggccggaaagctgcacgacggcatgcccgcaaggccgcaactctgctgtctgcatgtctcgctcgcgtctgcataataggggcggtttggcgcgccgcgcgcggaaacctgtggcgggtttgagttcagaacacaagtcaaaatttgttagtattcgtgccgcccaaaagaccagtagtggatgtcacgttccacagacatgagagatagccacggcccttttggaccaaattagccagatgttccaatccaggtttggcagccgaagggctacgcacaaatgcctgggcattttacctctagaagattgtcaaaagttaaatctggatgcagcaatatcacgatcggataacaagggagctgttggagcagtgtgtgccgtactatatcaggtgaatttgtggcagccagtactatggtctgggaagggttctctgactcagccatttagagacacttgggtgcaatgaagggttagcaacttagcaatagctatggactgcaacatgtcaaaggtctatgtagtctcagactgccttgaggttattagaagcatctcagagaagccaagacaccaatatttagtagtccttaatgatattgaggcaataaagaagcattctgtgaaagtagaatttcgtcatgaaagtcagccttgtaattttgatgctgacaacttagtttgtaagtttgcttctactttataggaagggcgtcatctttggttttcaaatcctccctgtgatatgaataggaatgtaaacgtggatgataatgaataaactgtccgcttttactctaaagaaatgtccatgcttttctctttcaccacattgtgggcagtggcaatggaagtacagtgagacgatgatgcttcgctagagttgtggagatggagggtggtaggcggtaataacaatagaagaatcttggtaaggtagttaggtggtggggatggtagatctagtggtgggagttgctggagacggaggaggtggggtaggacaggggcacctcatcgaagtagttaggtggcaatggagagtggtgatggttttaaaggctctaacgccagaggcaatggaggaaggcagggtgcgggcacctctctgaactccgaagtgatttaattacaacacatatattttttttatattagaatagtactcactccgtcctataatataagggactttggctataattgtatatccaaaatgccttatattatgggacggaggtagtatcatttaaaattttgttatgaagatttaattataatgatataatcagattgttgatcgaataagtaatttaaaaggaaaaattatctaaaacttagctattagtatctttttcttactattgcatgtttggatactcctcacataggaaagagatgcatggtactttttatcatttattcatgcaaagatagagtcgtacaattgacattgcgcgactaagatttaggccctgtttgaataagtggaaaacaatatatagaaaatgaaatattgatgaagggtgtttgtaagacatgattttttattatatattaatcttattttcttagtactaaatccttttcatttaggctctactgacatgttattgaaatcttatccatccttttatctagtctacttgcttatcaagtttttgggaaccatgatatactttaaataaaagattaattcaaccttagctaatgcactagctctctcctttgttgtcacttccatgggaaaattgtcattagtcttcactacatcttttttcctttgaatgtaaaggaagattgaatcacagagaacatttccaaaggaattgttggctccattcctccattctaaagactttcaagggtagaaaaaaatactacagtttcaaattgctttgattttttcctttgaaaatccttcataccaaacacagtctaagaggagttagttctttgggcccttggttagaacaccgtaaaatctgtatacaatccagtttcatcttccccatgaagaaaagtccaatataactccctcaactatatatcgaatcttgttcgtatctcttaacttaaagccgggtatatcaactcccgttttgtgattgggaatacgaataaaattcgacctacaattgagggggtcaaattggaccttttcccaatccacagtggaaacacgccttggcccagtcttgaatgggctggatgggttgctctgcctgtctccctccgtgcgaagtctttctatttccctttttggcaaacgtccacaacgtcagaatttgacctgtcgcgagcgagtgccggtcaactcatccattgacggcacgccaaagttctccttttttttcgtttgttcaaaagcgcatgcaagcgtagaaaaccatctttatttatgtcttatcacgagaagaaaacagcaggagcgtgcaccaatcgtacaccacatacacactcctttttttgtgggacacgatgaatatgaaacgagcatttgaaagcaacaaaagctaatcggactcgcgaggcgaggatcatggaggtggagcagctagcatgcctgtcgatcactccgcgggcttcatctcctgcttgatggcagcgaccaggtggtcgtaggcttcgctccacgcgctcttcatcgccgggctccacatgtccgccggaacctcctccttgatcgtgtcaagcagcgcgaacttcaccacctgtttacacgatcgatcgatcgcatgtacgttgttcgacaaagacacgatcagaaaacgatcaagtttcatgtcgatcgaatggagcgcaggcagccattggggatcactgtacctcgaagtgggcgtctccgacgccgtacttgaggtgcgtggcgccgagcctcttgagggtggtgtctctcacggtgaccttcccggctttccgcagctgcgcggcggcctcgcatgtctgcaatatcgattgatcgcgacgcacgcacacattctgtcagtgtctactaccacaacaaatttacttgcctgaaataatgatggtagtattaccatgacgaagacggacatggcgtgggtcttgagcttggggttcttctcgagcggcacgtcggagttgcgcaggaacgagaacatctggctcgccgacggcgcgacctcgaagatcctacaacacaatcagacacacatgtatcagcgaaatgcattgctcaatttaatgcttcacaaacccaatctctgattccgcaaaaagagaaatggtagtaacacgcatgtacatacttcaagaagaagcggagggcaatattggcggaatccttcttcaagatcgcccatgacttgagcaccagcgcctcctgctcctcgctgaagctcaccgctacggcattgttatcctccacgagagccattgcttcctgacagctggttaatttcctgctttgatcaatttctctgtaacaaatgatcgagagctagctgggctctgaaaacaactgctggtttcgatctgaattcaaactgcgcaggtgaggccgatttatataggtcgatctgacccagggtttagcggcctttcgcgctcgcgacgagccaagaagcatggaagcgttggccatcgtgccgtggtggcagttgccgttccactcccaagtctacggcaagatgtacagggggcaaagaattgaagatgattcgagccaaaaaaccgtgtgctgaatgcagctgcgaaagcgggtagttgtgcgaggcagcgtctcggggctgtttagatacccaaaaattttacgccctatcacatagaacatttcaacacctacataaaatattaaacatacgctaaaaataactaattgtatagattgcaactataaatcttttaaacctgattgctccatgatttgacaatgtattgctacagtaaatatacgctaatgatagattaattaggcttaataaatccgtcttgcggtttactgacagatactgtagttagttttttatattagtgtctgaacaccctgcgataacctatataatatttgatgtgagatctaaacacccctcaataacgtgggcgcgtggaaaaccattggcgggtttaagaatccaagtcaaaaacgttccactttctttcttgtccaccaagacggaaatcgtcgtccgttcgtgccatccgagagaccaagcaggtagaacgttccacaaacatgggccaaaagccacggcctcttttcaggcccagataactaactttccaagtttgttgggccgggcccaaaatatcaactttacaaggctctgtacattgggccgtgaaactttacgtggaggataggtgggccgttggcgcgggtgggcccacgagctcccgcgcgagcaggtagcggaaggccgggttgtggggccttcactcgacgccgccgccgccggcgcgcgaccgcgccgcctgttgcgccgccggccggagcggctccgggaggcaggactccaccgcgcggaggaggtcgtgcgcaccgaggccggcgtccctcgagtacggctcgaggagcttcgggaggaggaggagcacccggcgcccgcgcccgcgccgccccccgcggacgccgacgttggcgcggacgaactcgtccctcgccgcctccagctgctggaggaggcgctccggccggtacaaccgcaccaccgggtcggagtggctccccgacgacagcgcgaagtgcaccagcggctccggcctgtcgacggcgaacccctgcaggtcttccttctccttggacttccatttcgggtacaggagtagtctcagccactgcacaaatcatatgcaattcaagatggcaaattttaccaatcactcaagcaggtcaaactgtgactaaattttcagggactttggaaggggaggttgtgagagacgctccagggtcttccggctagcttcttaaggtggtgagctaaccggttcgaagcctcactccttatatttatttgatattaggtcattccctaatattttcgtttttcttttttttttgatggggaggttgtaaaatgcaggaagtaggacaaacctgtgtaggagagtgcactcggcagcataggatatggtactctatcaactccgggtttactctctggccactgatgaggtaagataactgtggcacagaagttgttaccagattatgatttcatacggaatgagatactgctatatcattctatctaagaaaattgcagtttgaggatgttttccaccttagtaagcaatattctcttgctgttactttgcggaatcccgtattctatatgggcctaaaagaaattgtcaacattagactccacaattgaagaaatatagcaagacagaaatgtgggttaagaaactagttacatgcatcatcatggcattgtgcacattgatccagaaagcaattttttcttcatttttcattccgttgagatcagcactttctagcagctgtacaagagacctgcagaataacatcttttactagtctgcaaatagatttatgcatcatttccagcatgtcatgaacaatactcacttgtatttgtgtagcatgtctttaacatcagcagacctctgggcccccttgcaaagagcagacacctcaatcacagaatcatattgttgactgaagtatcttgattcgccagttcctaacgcatcgtcttgccaggcctcaatatagccctctttcctacatcttgggctccatatatccccagtgtatttggaagagagcccgctcgctgatgaaaatgatgagcatggtgaggggaagaagggatgttgcacggcattgaagtccctaatccttatgtatatcgaagcaatgcatttgatcatgtcctcagatattttgttcggtgtttgaggaacatgatctgctatcctggtccctaggatatccgccaggctcacaataccaggatccatgcacttgccctcctggtcatttcaattatgtcagtatcaacaccgttacaagtatatgacaaagatctgatagcaaagtggtttaacaggtcagaaatgaaagagagttttcagacatcgtcctgcacctcgacaaaggatagaggcaaagtatggcatggtttgagagccctagcaagattgtttgctgaaggagatactctggctgaacaaatggaacgctgcaggagcgaggaatggctgcgtccgataccagtcttgtcattgtaatgtgaagttctggtttcgctagtgagagttgtcggtgtagacttgcgtgccatgaccatgccactggactgcaggagttggtgtttccttggggttgagaaatccagttctgaagatcctgtgagtatacctgagaatgaccttgctgactgcttgttgatttccatgtcacaggaagaagacacgctgcaaatttgttgatcaaaggccttccggtagagtgctaggagatgttgctccaagcatatgacctctagctccagcacagcaatctcctttattagttcctcagtaggctgagacaacatgagaagaaagacacagaagctttcagtaagcaacgggaaaacacagccttcaaaaacatttgcgatacaattgaggaaaaaagtggaggaaaattttacctttggaatgcagctctcattggatgaatgaatggcacaaggcttataacctaatgctttctccaaagcacgccgcatagcaaattgatcatttagtcgcttctcaaggtgttggacctgcagagctaactctatgtatcaaaaccaatctgcagttctgcaattctgtagtatcactattaccttacaaattacagtagaaccatttgtttagtcttatgctacacttgggcaggacaaaataaaggataccctgtacttggcactactcaaaattgggatgtctctttaactctagcaatgcaggaatgaatgcctgttacggaactctgtactacgacttcccaactgaatcttaaaatttcacatcattaacacgctttaaagtagtccatgtatcacacaaatatgctacaacatcggaaactttgtgcaatacttgcgatgtctacttcttacctcttgtatcaaagagcatgggagctctgtagtccggggcagcctcttattggtgctattctgatccttcagttcttcggcattcttccgtgaacagaaaaatagaaagaaaagtgagatgttttgggttatggactgaaaaaaagagagattatattccaaagggacatagcaaatgcactagtcaagagttctgtactgatcttgggcagaagaaaatggttcagaaagttaaggggaaaaaggaggggaaattctgctgtgaaattttttaccagcaaaaatgacaccgacccacatgcttggagtcaagagaatgaacaaatgaagcaataagtaacaagccattttatctccaccaccaccaaattacctgtagatgctgaacattgcaccttggggaagacaaatccgtgccatccattctgagcattctaacagagtcgctgccgatgcaaattcgtcaagatcattaggcattagccaagaactgatcctatctaaaacatgtagaatcatagcatctggtcagagatcaatatctgtaacttggtaacaagaagtaaagctacaagctttattttcaacctgcaaccccaaccagggtgctgtaaccaaagctacaagcttctcacctcttggagcggctatgatacattgagcaggttaaggaaggagcctacaagtgaacaactccgctgcaagcctgcactgcacctctgagctcaagaagggctcctcctctctaatctttgcacaggtgagcccatcttagcgaagagttgaactctgtaaccactaaaactacactatcagttagagaactaaaaagagcaaatgatgcagggtagagactgcatggaatggggaagcatctcacctttgcagataaaatcatccaaaggaagtgggagcctgggagttgttgctgtggagttgatcacctaataaagtctttgagcctttgagctcttgacaccttttttcctctctctttttctcgtgtaaaagttgcttcttctaaaggcccctttctttctctgctaggaggatgagggtgatgaacttgatgaggtactacactactactacttgtactagcagtactgtccctactgctgaagctcttatatcagtatcatgccggatcgatcctgtccggctattcagatactttgtttatggtggaagatatatttatgtctgtcctaaaacttaccaacttcctttcttttttatgcaagatagaggtgagagctcaggaaaggcttcactctattccatccagatctggttgattccagttatttatgcccaaaaggaaaatttacttcacccaaagtggctgacatttttaccccagtaatatcagatcagaaggtgaatatataacctaatcttctgccacattataagcctgtcccacctgccacattagcttggaggacctctaaaactagtattcttcagatgtcaacacatgcctttttttttccattttcttacaaaagaaattgtttcaaaaagttgagtaactctcgtttctaaatacgaagaagtctacttttggtctctcaagtatgaccttggtttggttttagtgactcagctaacacttgaaattatccgtatttcattactccacccaacctaggtggttttcgatgacatgacgccatgtaggattaggcagagaaataggaaaagaaagtaaggttgatgttgtcactcctcatccatgtaggcaccgcgacatctttcagagctgctggatcaaaagtaaatggttttagttaagggatctaagattcaaagttggaccaaatacatacagttcagtgacaatgtagtacagatttttctccataaacgatggtaccgtttcactgttttcctgcaaatgttctgtgttccccccctacaatgatgagcagctcatatgcagataaaattgcagcagcagagaaggacagtatcatgcatgtcttttctttgacctgtgactggctctgctccggtaattgatggagctcgtcctatgcgtgtacaagaccacgccagtgaacaccacggacagcggcaagtgtgtgcggagaaggcatggagttacatgggagacccacacaagcagccaaggaaatgtgcagcccacacccagtgctgtctcggtgaatttgtcattttttttcgcctaggaagaggcgctcccttgccctcgtttgcactgccttcctgagtgaactccaaaagaaaatttttggcaggtcatgtgacacggtcacatatcttactgtctaccaccagtgcagcagcgcagtgcacgacagtgctagctagctgctgctgctgctactaccaagtactcgcgagtcacaagatcgtcacagccaccgtcctgcactgcggctatagttgctaccatcctgttcggatcaatcataatcattaaccagttaccgattgttaagcaacaatgtgaatcaattgctcttggcttgttaactgtgatgcattccagttactgtcaatgccacagtttttacacacagctgtgttgcctgtttgtttctgtgcgaaacatgacagaggaatcggcacgttagacaggcaacggcacacatggtttgattgtgccaattcatcccacaaagtgctttgttcgtggcaagtagcactgtgagcatacatgacaaacgctacatgaaaaatggtacatcggtttgtatcggtagatgcctcattgccccaaaggccaacactacacccctaatgtggcaccccatccaggtcccagacggagcgtagttgcttgtcacagaatctttgggtgacctaaaatcccagtgcagttgagctatggctttggcctcacttggcctgcgtccactgttctggaaacaggatgcagaagcagcaccacaacagcacatgtggtgcacgtatggatttgtaataaccttttcaatataaattatttaaaaaggatcctcttgaacttattttaacctaaactttttggtagctgtaaaattttacggcaagtttctcttgtaaactcggttgactctcttcttctacagtgaattacaataactttgcccttttcaaaggttcttttagagtgttcgttttaaaattttaataaaaaaggttttacaaaattgtatgtattgttaggccttgccttggaacttctttgtgtttgtgcgtgtgaatcatccatgctataaaaccgtcgtaaatgaaatagtaggaatccttacctgcttgtaagagtacaatgtgagtactgtaccatttgtatttatcacatctggactctggagtgaaggctaccggacaaccaaaattggcccttgtttattccattattatttgtgaacgtgtgagccatcgagtagacagctcctgcaacctagccacttgttaaggcatctctcatgcaatagaagagaggaggaggcaggtcaggagaaggcacgctcggtgttgtgctcttttccccggcccagctcacagatgcatgcataagtttacaatgattgttatctcgaccactatgatacaatgatgctgccaatgacgactagggaagccgtgcaggtaaatgatgacaaaagtgaaccttgagaaagcttaatttccatccctaatcaaatctcagtggggtgattagctgattaaagaaacatccggcgacagacatgctcgaggtttcatgtgctcttggaccctcctctaatttgatacaattccaatactatgtccatctactagaggtaaataattgttagtagaaagagcaggtgaggtgagatagcaataggaaactacatatactgtgattgcaattggcaatgctaccaatgaacataggaaaccagctccagttcatttgattatgcaagctagtagagtccgagatccagaaagattcttcccatcggttttccaagctgtcagagaaagatttaacttaaccaaaccacagcagtagcagagcaagtactactatgacggcaatggtgtcttattgacaaagtcaatgagctgcagagctagtaatattgctgggtagtagagtctagcaagtagcaagtgacctcttgagaagaatggaccaacacgagacaggagaggacaacatagagtgttctttcacgcacaagattcccataagtccagcgcgctgtacgagtgcatcgccgtcgattccgatgggtcaccgtatgcttgtcctttgcatgggttctagaaagaaaaggcaagctagatgccccgttttatcaacgcataatccaacgattgacttgagagtttatgtgattcttagctagtactccctccgtcccatattatatgggattagaggttaaaaacgtgtctcaaaatataagggattgggtaggtggagtactaatgcaaacagacatcgggcagggagagtactaatgcggacagagagctgtcggtggaatttgtccctaccttatcctctcaccgagtcgcccatcgaccaccgctcgttcccctcccgattttcttcgctttttctccgtcccctccatcagcgcctccctcccacccgcatcttcttctacctcctcccatccatccgagctccttcccttccacctcccatccgttgacgccaacgccggcggtgcggcagccaatggcggcggccaacctggcccatgcgccaccgccaccggtgcccaacctggcccgtgcggtgggggcaccaccggagaagcgaatcgaggtggtgtgggagcgggagaacacgctgctctcgttcggccgggccgccgcgcacgccgccgtcgccttcgtcaagttcaacgtccaggtatatatatacagcgcagccgagttcgatgtgcgtgcttccgtttccacgttgttggtagtacctgtgtttgttttggatcttgcattggatgtcagtttacgctttggattgtttgattttgacaccgcagcatcgcaatgcaagatttggaagctagcgtgggtatgacttggatgtagccattgattggtgtggtactggacatgaaatttgcagcaacgttctagccagtgaactatatgggacaagcctcacaagtaggagtatcaatttaatcgcatttaaccaggatctagatgccaccatgctaaattggtcaagaatgaagaatggagcgattttaggtggatgttttgcagggatgtagttatccattaggcaaagtgctaggatttgaagttgcagttcttatttagagctgaagaggttcttaatacattgccaactactcttagatcatacggagtactaggaaattaacggtgttaaaaaaactaaagtgtcaattttattaatcttagacgctgttaggcacatcatatcttagattcatgttagatttaaagtttatatgtttcattttgatagtttaaaattaaaaaatttatttaaaataggaatataatgatttaacatgtcgccggcagcggtttacgggctggcggcagaatgcggcccagcggcagggttcgcgggacgtggtggttgctaggcaaagagccgcgtccagtggcggaaggcgtttgttttgacgacttgatgtttgtccctgacttggatgatgaaggggctggcaatgagttcaactcacaaggttgtgatgacgaatttgtgcctgaaacacaacaagatgttccaatcgaggagattggcatagggttcctctcttatttatttaattattagtcctttccattcaattttgttaaattatgtgctttttgatgttccatttatttctccttacggtgcaaccatccagtgacaagcaaatcaggagggccgcgccagctcggagtgcgtcctcgcttggggtatgtgattcacactagattgtcgatttgggatggttatgcatttgtagcatgcaaattgagtcacatcttgatttatattgatttgtcttatcttctttacagtacaatgttgcacaattggcttcgggctatttcagagtatgagaagccaagcatcgacatggaaaccatcgagaaggcatgggctgatgagaaaaaggcaatcgctgatgtggactatgagggaaatccaaggaaggtgaacacaagctccgagaagaaggcatgcgtcgacgaggggaagtcaatctccgatgcagaaactgatgatgagggcgtcggtgtgcctgagaagaaggcatgcatcgccgagagaaagtcaatctccgacgcagagactgatgatgagggtgtcggtgtgcctcggaatttacatatgaaagatttgcacgatatcatgtttcctacctatacccaggtatgcaagcgtagaagaatttaggactaccaaactgttgaatgtgattttgttgtggtattttgttgtggaaatgcacaatggacgtaggagtacttagtgcaatatggatgtaggactaccatgtttataagtgtacaaattaccgtagtgttccatatggttgccagactagtacggagtattttgttatggaaatgccctagttatagtcatatactcctataatatattgttctaatgattgtagtattgttccaaagttagtgctgaaattaactatgcaatgacatgttctgaaatgggttcaattaagtattcattgttatgaaattagtgctgaattaaatatagaatcacatattgctgattgctaaaactagttatgctgaattacctatatataacaaaagtctgaaatcatatttacaaactccatcggagtacgaaaaacaaaagtatggctaggctggactagttgttcaacatggtctgcatcaccacatacttacaaactccatcggagtacaaaagacaaaagtatggctaggctgggctagtttaacaaggtgtgcattaccacatacttacaaactccatcggagtaaaaaaaaaacaaaagtatggccaggctggactagttcaacaaggtctgcataaccttgttgtaaagtgcaatatcacaagtcagactagtagggagcatgtcaagcctctccaatcgatccttgttcatatggggtatcttgtagccattgcctccatcggctttcatcacttctatgaagcaagcttgtaggtttaggaaaaccctactcaccaagttagaattatactcattgtactcttcgtccacattgctgattaattcatccatgttactacaatttttgaggtatgtcttcgattgaagagaagcaaagaaacccagatcaagcacattcatgtctggtgaattagggggctggttcatgatgcgtatgtctaggcctacttgggccaccgcgagggcaaatgcttcgtcgtttggcagaatatgtgtcagtgcattgtcttgctgaatccaaatggtcttccctacatcttctctaggccaacaagaggcaatagctggaataacctttgtaatcaagaaagccctacttgtttctctcgacaccataatagattttgtgaccaatgtacccttcggcctgttgcgactactcctttgtgctggttcctaacatatagagcaaagaacaagttagctacaaagtgacttgaaagcaataaaaacagattgaatcaagttgagacttcaccttcctaacaaagggccatattcctattttgccatcgaagtagcaatttccttcctcatcatacctaggctttgcaagagttgataaaaacataactttatctatggcatttttattttgcacacatctcacaggttcatcttcattgaatacaaggtagaaggtcttgtttttcatagtggcgttgaaccatttttcatcaatatgcacaatgttttgcatgtctataaatcttggttcagcattcaaagtagcagcatctagcatggatacacagaactcgagcctttgttttttattagcttccttcaagtaaggtttaatgctatttgagtgacggcgaagggctccttctttgactaacctatgcacctggcttttgctagcattcaatgcactagcaagagatctgatgctacaccttgagttcaaaggaagtgctaaaacctgatccaaatcaatgtcacttcttttttggccacaattaccaggcttctttgatttaaagtcaacttcaacacctgctgctaaacatttcttcgcctttgtccaaatgtcttgtacaactctccttgtcacatcaaacatagctgcaataatttctgtagtatctctatcagcaagtttcccattgatagtacttgcaagtaaagctccataaatagctttcttctcagcttctggtaaatatttccttctctttatattgtcttgttgagtatctgcacaaagaaaatatttatatatatgcatatcagttggcaatatattttatacttgcagtacactaatgaatgtcatttgcatgtcataccttcctcatcacttgatgtatggagatcttcatcaaagacaacatccatataaggagaataaacatcaaaatcctcctcgtctgcatggacagaaaaggtgagacatgagctactcatatgatatccccatctgcatcactgctgattacatatgagcaaaaaataatgtatgtacctgcataatttgattgatcttggagaacatagaattcgtcatcgtcaaatacaatatcatcttctccataatttgctgcatgacatgtgacgaagataaatttaaagttgaaggttgtacaaagaaactagctaatgaagtagtgcattcgcgcggctttaaccaccctgtcatgtgctttgtatgatgaaatatacagaaaagtgcattataaattaagtaaccattcttgaccacaaaagttttttttttgcattaggtcatctaccacaaaaaaaacacatgttcccatacctatatgggtcatcctgcagtggtgttatatataaagttcatactattcattttttgggttgttttagtagtttctgatattaaaaccagctttatgaaataaaactttaactatgctgattccaactatttagaacacatgatgtacgcttataaactttggaggttgttgggctaatggctggttatcataatgagcaaataaaattcatagagccatttatgatcatcatttttgcatagtaccacataagagtatatatatgactgatggctgaagtttacaactcctgactaaaagcaacaactgattgacactaatagcaaagctgcaaagctctgtgttatgcaaagaagtaatattgggcttgttagtttatgaatttggtcataaattttgatcatacaaactttgctactttcaacatttatgtttctgttatttcagcagaagggaggatgggaaatgtgaataagcccataacttgctttgcattaagattttgattccatacctggctccatgtttagatgacaaatttcttgtgcactccggccattggagagttcaactgcttgcatggcagggcctggatgttcatcttcatgagcaccaaaacattggttgtcaggaagctcttcatcttcatattggaaggcatcttctccttgcacagcaggaaccaggttaaggtcagggatcccatcaccttcatcttgcagcacttcttgcacaccaggatcaaggttgagatcaggaatctcatattcctcttcttccatggattagttgagggtctctcttggtgtaatgatggagtaggttgctaatatgagtgtaatatgagagctttggtttttagacctgtgagtgagagcaagggagtgaaaatggcgggctggttctgagcatcaagtttaaattttgaacagctaatgcatgtgtatttgtggcgctaatgtgtagtgcgtgtgaattttgggcagcaaagaggtgagtgggatttaattgactcttgtcaacatgtgcattaatgtcattgtgtactgaggaatgcttactctttctttgtgccaatcatttgctggcaagcttgtaaacccaaatattctcactgctagtgcccagtactaagtaaatgaggggtacatgcgtcttttgctaacctccttattttggatgaacagtgcccagtcccatataatgtgggacggagggagtacaagttgtgacaaataatccaaaggctctaggatgaaacaagagaagaaaaccagaaatcctgtcctgaacagggaccaagatttgcatcttgcacttcagcagatgggaatcggaattcagacattcccagaatcccagcaatgaatgcttggatatatgtcaaccaaaactgacctagagatcagctgccttctggccacaaaataggtttgacggataagatgagcccataagctcggccaagaatatgtcgcgactcaattagtttgtttctattaatttccaggtgctacgcatccgcaggcacttccaatatgcttcatacattaccttgcatgtttgcaaaaggacatttcaaaattttatcttccaaaatgccatcgtcttgcccgaggggtagatttagcattataagagctatgcaacgtgcacattgcacattgccaccaattcttgtcatgatttacaagagaataagtgaacgctaccctattgttggtattatagccccccgtttaaacttgccatgtcgacactctaacgcaacaaaaaagagcagagttttcctttatgtagctgaagaagcccgggtcagctgtacacttgcaacggaatgtgctgtaagttatttaagtttcatatcttgtctgccacttcagctggcacattgaggtcaaaaagggcagccccaccatgggcatcatttctttctcgcttgtgaggccgcccattgttattagaacttgagccaagttgccgctttccaaaaatagatgaacctacagggcatgttgaaatatgcatcagctatcagaaacatataaattgaagctgcaatagaaatgaaaggtgtcaatataagtaccagataaaccaggctgactcttgtgttcatcttgactgtatttaattggttgcaaaccttgttcagaagaatcccaacaaacattgagctctgaggccctgtcaaggcccttggatttgtatggagcaatattatgaggcgtacgcagtggatacaacaaatcattctcaatgcactgatacctgcaaggtaatatagttagaacagtaatttacagacactaccaaacttttgttgagctcttacatttgcttgcagagtctatcaaccacattggaaagattgatgacatgcttcattgtatccataacctcatcatcactaaaattttgaaaatccctctcaaggaaaccagatagtctttcaacgttgaattctaattgttgttgttggtcctcaaataggttttgctttagttctctttcatcagaagtcatctcatccttgaaaatctcatcaccaaacatgtagaatgcaaaaggataagaatatgaaagaacccgccttgacctgaaaagtctgtttaatccatttatcacccaagagtaatcttttatcttggaatccttgttttcagaaatggaaatcttcccctggatgtcgcccttaagctttgcttcctgcttaagagaatcagtgtgagctttgtatctgttgtggtagtgcatgtaccgataaaggtttctcctagcttgctctgtcttctttgactgatcttcagtgaatcgaccacaactgtggccactaatacttgaccatgtgtgatctctgccagtagcaccaccgcataaccagctacattcaaaagcatcaaatcagaataaatttaaactaaattttcagtgaaaatgaaatttctgtcaaaacacattcaccacatgatacttcaaaattgttgttttgggttttgacaatcatctaacaccatgtccttcactgatgcaagttgcaaacacgttaaaatagtttgaattttacaagctcttggtgtgatgacttgtgttactgaaggagaagaagctactagagagatgtcaatgtaacaccagttcaagtaatcaagtgagtgaactgcctaaataggttcaagcttatacaaaaacatcaaccatcccatataatcaaggttaaactgtttaagtcatagaatttcagaaactaccattagcctgtcaaccatatcatattgcaatactgaagaaagtatcatattgaataagctctctagttcaggaatgcattcaacttatcagctagccaggtggtggaacctgtgagttcattaatgaaaaaaatcatgttggatggtacactgaagcttactcaaagcaggaagtttaagaaaaaaaaggttgaaatgctttgagtttgtttgtatgaacaaatatatatctactagaaaaaggcatggatatatgctaatagtagtatatcattatctaccagcaaatgggaaccagtaaacatgcaaaaatgtagaagttgaagcagcataataaccattaccagaatgcttgcccacatatacatgcaaccagattgcagccaccgttcttctcaacaggtttgtggcacttgggacagggcttagtatttactgttatccaattcacggtctctgactcgtcacggcatttcttgatccagagctcccacatcacacaggaacatggtgaatgtgcttctgaggagcaattaaaacaaaactggcgtccacatgtacattccacctcacagtgaatatcacctttgacgcgtatagcatttccacaatgcggtgtgcttgggcaccacttgactgtatcattgtcctcaatataagattccaacaagaacctttcaaagcgctctgcaatatctggccgctttgcatttactagcttacgaactattgcttcgtcacagatagtattgcacttcagagccatgcacttgatacggcggctttgtccctcatttatcttcacaatgaaatatcctgtccagcctggaagggggcaggaatacacaaattagtagctagctacccaggaaataaatcatcatacagcaaaaggattaatccacaaaatgtcatatactcttctatggcaacacctataaactgaggtcaagacagttagtcgacatagaattaagataggtgcaaagactaaggataagttgaagcatgtgatagttttataagcataaatgactattcatacaattataaagtgataaggcaccatcctatcccagaaaataaagaacacaccattcccatagtttagtttcatgcatttagtagacaaaaggtgcttgctaaaagaagctgttatgtcacatcatttcctttgtagcatgagggtagtaagacgttagccaatacgacaacttccacatacctaacagattagtaactactagtggatgaatttcagactgttgtttagcattgaggtcaaaaggtggggcattgacccaatggctttgctacggaaagtgcatttgcatttacatgatcaatctaccagcatatccaagcaaataactagcacatacgcaaaggtgaaaacttcatagtatttccttttccccaaacggttgttgcttacattcattgcagtagttgtggccgcagtccatcttggaggcgtccgagaggggcacatcgtcatagcaaacattgcaggttacctccgttgaggagggcgagccgggattattagcaggttggagagggataccagcctccgagaagagcctgtccctccccttctgatcaagcagctcgaaaatcctttcgacatcccacctgtagtggatgagcagcgtccgcgcgtggtgctctctcaaccctagcaactccatcaccttcctaagatcctccctctgcaaaatcccaaacaaaccaaacaaaattttaccaaggcaaggaaagggaaaaggcttcaatctcaggaaaatcgcgtccaccccccggaaatcgaatgcgaagagatcctctctagtcgcggaatcacctgcgccgccaagagggattccttggtgatcacctgcaatcgaaggaacccatcaacaaccgaagcgattgggactcggacaacaaatacgacgaggataaaacgatggatagtgggggggcatacggaggtggaggaccaatggcaatcctcgtcgcgttcgtcctccagcacctggaggactgacttctccaaggcgtcctcctcctgatcgctcaggttgcagtcatcgttatcgtgctcctgctccaattccgacgaggacgccgtcggggagaccttctcggcgtctgtcaccatctaggggggggcgatcggatcagacccaaatcaaacccccaccggcgacgcagctcgcggcaaaccggggcttccccgggtcgggggaatcggcggcgcctgcaggaggggcaccgggaggggcaatcgcggcgcggggcggctggctattgggggcggcgccggcggcggaaaagctcgcagtcgcggaaggggaagtgagggaggggaaacggaagggaggcggtggtggttccgccgaaaaaagggactggtttgcggtgctttgctgaggaggaggggcgtaaatagaaaattgccgcgatgttgtgtgacctgctagattccgttggattttcgcttgcgtttttgcatcgtaaaagcactcttcacccttccgattccgatgtgctaaacatccgccatcacgaagtacgaacgaaaattggaacctctgtgcaaatgtgtgaagcattgagatacgactccctcacatttttttttctcgagtttgcgctgaatacacaagtgatgatggtaagcaattgtgtacaacatatttgtttaagctggactaacaacattttcttagagaagtagttgtgttatttccataccctatatctcattgaaattgggatgttggggcgagtggaggatgcaaaatcaaagatgtcgacggagatgacatgtggtatggtgttgagtgttgtagcggcatcagccatatatccatgactataccgtctctatgcaagggatctctccttcccttccaacatccacatcgatgatgttctctaccgacaacgccagatcttgcatgaccacattcttcttccctccaaccccaaggagtccttgttgccatcggaagcaacagtcatcccaaggaacaatctgtccctaccaaaccctagcagaagcaaaaatccacctccacaaccacagatttccattgtcattaataaactcttggtcacccaacctccaccctcctactaataggcccatcaaagccttctgcaaacagaatcaaccctcccccccaactaaaagcctgagaaatcctctcgccccaccaagaaaaacagaaaaacagggacaaggccaaggtcaagaagcatcgttgctccgagcacattgatcttgactgggagacgtgcaccaaaaccgaggttgccatcattcgacactagcaccgatagatagaatgttgtcaagctactcctctgtggaggcgatgtctagatgatcgacgacaagaaagtctcatgagattttgaatatgtgaattccaccaaggttaagaagagggccagattagtcacaaagatccgaagggacagagagaagtagaaggataacgggaaagaagcaacctcatcagcgagagtactcttcatgctctatagttcatcttcttattgcttaatctgccagaccttggatcatgaaaacccactcacctatttgcttttacttgtagaaagttcatttttatatagaaatgtagtatagcacgcctctagtgatattgagctcaaaaaaagaagaacgttggtgacaactcccttcatcatatgtagatggtagcaaaataaaaaggcaaagttgaggtttttaatcttttccttctagagaatggacatgagttaacatcactataaattataaattagagaacttacttcaaaactatagtataaatcccctagaatatggaacaatatgaaacaacgatgtatgtatggaccgacataaaagtagaggtcaagttcacatggtatacacaatgcactagccaaaagaacaatattataatcattggatacattttaactacagcgatttcacgtagaatgttggatattgaaatataatttgttgcttgtgtattcctagcattttctctaattatgtgtatgatgtatgtttattgcagtggaaacgttgatgctagtattagatatggggtgaaagaattagattgtaccattcaaactctgaaaaggtaaaaatgtgataattaatcaataactatgcttagatgataaatatattttctttaacataaactttgcagatctagattaattgagtaagaatcaaaaaacaaagatacaatgtattttcattgaaataccacaaatagagtactagaagagtggattaggataggattccctaacggtgactttagaatggattgaagccaataatcacatgttggcgatattgtcattgatctgaaattaaagcaatccgattcatcttatcttgtacatctatcatgttttggctaatgcccgctagatattcagactattgatatcttgcctttctagagttataagcattgtgtttgaaaatgacaacttgctaggtcatttaaaagttttttctgtagatgggtattgcatgattgatttaatttgtttgccctgtcatgtactaaaattcatatgggtagtttgcataattttagctgtcaccgttggcatttggaagaccgtttcccataagaattaataatggactgaatggtaaaggatgtctttgtgagctcatttcgaccatttttgtaggtaccttgatggagtatttctcatacaggatgaacaatatgatgcttgtcattcaattttgctttttttgttgatctatagggttgtgattgcaaatttacacgtgaaatgtagtttgaattaaaaataattcattcgtcgcgaataaatgagatgatgttttagggtccaattaatatatctaatttattacatagctaaacattattatatccttaaaaagaaggataagaaaagtggtctaaatatggttgaataaaatatctcctaataaatgctaagagccgacgttgagccattgttatacttagcaactatatttttctttcctctcatctctttcttccacgacactaaatttaaatttacttgcacggtaataaagagagtccactaataaagaacgttgtacatgttcttaggccttagctctctgctttagatttttgagggccaacttgatgtcaatatgggccatatatgttaaaaatgccctaccaagagaaagcgataaacattaagagaatagtgatccaataatatgttaggaaatatattgatagagccctttttttgaactttcagcgagtatttccctacgctctatgggccgggacgggtgagaagtgagaatgagcgtaataggatgggaatattattggagccatggagagtatttcctaccgtggtcatgacagagagaatttgagctgcatcgcactgcggtgggttgctgtcgtctggtggtctatactccatgaatgaagtactgtaaatcccatgatgaaggttctaggtgttagggcatgtacaacggtctttattagtagtctctctctattgccatgcaagtaaatttgatgacatggaagaaagagaaaggagtatggttgttagggcatgtacaatggtctttattagcggtctctcttcgttgtcatgcaagcatatttgatgacatggaagagagaggaagaaggaaagagaaagatggttgctacgcatgacaacggcatagagtcgactcttagcatttattaggaaatttttcgttgcatcgagtctaacaaaggaaagatgactagtaaaaaagtattttggtacattaatgattagagatcatattgttttaactattgtaatatggtagcctctaattgacgtagagaccataccggtctctacctttgtacttgcccttatgtaggacaacggctcagagtcgactcttagcatttattagagcaaatttttttgcatggtggtgaaaggaaggaaagaagagtaaaaaaatttatttgaatacattaatgattagagaccatattgtttctatctgttgtaggatgctaatatctagataacgtagagtttatatctgactatatatctttgtacatgcccttattccgctccggctgcaacatcattaccttccttacataatccatatttctttctgttgataacgatgcccttgtgttgttatctgacgggaaaacctccaatcagatggctgatggcggcagaccggttccgttgttccggctgcaaaacggccgctcatgaaagctccgttcacaagatacaagcaggccgacgccctcacaataattttctgatcaaatgatgcgtactattgtgaactaatctaatcaggcgtgatgcagacacagaaggaatggcatctgagccgcgaggagggactttcacgaccgaatcaaaagcagcagagccgcgacaacagacgcaccggcgtttgacccgaacaaaaaccccacgctgcacgttaactccactgaaaaaccgagctctctcactcctcacaactagtacgttcacaagcaccgtgacagccagctccaaatggaacacaagggtttgtgcatcctcgccgtcgtcatcgccttccagctcgccggcggggaggccgtcaccgatgccactgcccgggcacgtcgcttcgcctgtaacgtgtcggcgccgtgcgacacgttcgtcgtgtaccggacgcagtcgccggggttcctcgacctcggcaacatctcggacctgttcggcgtgagccgggcgctgatcgccagcgccaacaagctgaccaccgaggacggggtgctcctgccggggcagccgctgctcgtgccggtcaagtgcggttgcacgggcgcgcgctccttcgccaacgtcacgtaccccatccggcctcgcgacaccttcttcgggctcgccgtcaccgcgttcgagaacctcaccgacttcgtcctcgtcgaggagctcaacccggcggcggaggcgaccaggctggagccgtggcaggaggtcgtcgtcccgctcttctgccggtgcccgacgcgggaggagctcagcgccgggtcacggctcctcgtcacctacgtgtggcagcccggggacgacgtgtccgtggtgagcgcgctgatgaacgcctccgctgccaacatcgccgcgtcgaacggcgtcgcgggcaactccaccttcgcgacggggcagcccgtgctgatcccggtgtcgcagccgccgcgttttcctccgctgacctacggtgccatcgccgccgatcccggagcgggcaagcaccgccacggcatcatcgtggcgacgagcatcgcggggtctttcgtcgcgtgcgccgtgctgtgcacggcgatcttggcgtaccggaggtaccgcaagaaggcgccggtgccaaagcacgtcagcccgaagctttcttggaccaagagcctgaacagattcgacagcaatagctccattgctcgcatgatcaatggaggggacaagctgctcaccagcgtgtcgcagttcatcgacaaaccgatcatctttagagaggaggaaatcatggaagcgacgatgaacttggacgaacagtgcaagctcggcagctcgtattaccgcgcgaaccttgaaagggaggtgttcgcggtgaagccggcgaaaggcaacgttgccggggagctgaggatgatgcagatggtgaaccacgccaacctgaccaagctggccggcatatccatcggcgcggacggcgactacgccttcctcgtgtacgagttcgccgagaagggctcgcttgacaagtggctgtaccagaagccgccgtgctcgcagccgtcgtcgagctccgtggcaactctgtcgtgggaccagaggctgggcatcgcgctggacgtcgcgaacggcttgctctacctgcacgagcacacgcagccgagcatggtgcacggcgacgtccgtgcccggaacatcctcctcaccgcgggcttcagggcgaagctgtccaacttctccctggccaagccggccgccatggtcgacgcggcggcgacgagcagcgacgtgttcgcgttcgggctgctcctcctcgagctcctctccgggaggagggcggtggaagcgcgcgtcggggtggagatcggcatgctgcggacgaagatccgcaccgtgctgaacgccggcggggacaagagggcgccgaagctgaggaaagggatggacccgaccctcggcggtgagtacggcgtgaacgcggcgctcagcttggccggcatggggagggcgtgcaccgaggaggacccggcgcggcggcccaagatggccgagatcgcgttcagcctctcggtgctcggacagccgctgtccgtctccgacgcgttcgagaggctatggcagcccagctcggaggacagcatcgggattgggaacgaggtggcagctagatagatcaaaacacagcaatgggtatgtataacactgttgggtagtgtttggttgcaaggtttgggatggaatgcgatgggacgaacccacttttaaataggtttggtttaggggtgagcgggatgggttggtccctaaatagaataactcttaaatccgggaccaaccgatccggcaaaatcgagcggacgaactcgtcccacctgagatgggcgcacggcatgagtcccgttgctactttgctcctcgcatcagtcacctggggatgctcgacgagagcacgtcgggctcgagcgacagcaggcggctcagtgacggcggcagtgaagtttggcggtagggagggcggcggcggtggatccgaaggccggggactcggcagcggcggcagatccggaggcaaagcacgactagccatagcacgcagaaataaaggagacccaataaggggctcaatcgcggaccagtaagacccatgaaccagctagaccaaaagacaatgcccttacatatatccctgtcacgaggacaattatgtaaaatcattagcacaccaaaatttaaaggttgtaaacctataaatagatctcaaataatgtgtaataggagatccaattttagagagaaactaatatactatttattattttcctttccacttaaaatgaagcttgactttggtacaagcgtttgtccttcgataacagtgtgtcatggcccatatatatatatctgggccttaaaaataaacttgcgtttgtacgaactcaaatgtgattcaatcctttgtccaagcatgcactttacattgctatcgacttttcatctgctacggaattgttgccaccaatccacctccacagctccactacctccactccaccgatcaatctgagccactacgcctatatttaggcgtgaatggcagaagttgggcacgcgacgtccggcgctgctcgtgccttcctccgaattctcaacaaactccgccatgttctctccagttcccacctaatatctgaggatatcaccaacgtccatataaacaagataatcaccgggcaaattactaaaaggtgctagttcaccatttgcgcatttcctcttctattacccgcattgttcaactgccatttctctcctcaattccaaaaaaaaaacacatattcattttttttctcattcgagctaaaccatttcaatccatggaattcggacgaactccagcccttcaaatcatcgttggtaagtctgagaaactttcaggttaactttaggctgttagcatacatcttctttattcttcaacaatgcgtgtctcaatgcaggggtcctatggtcgcagctgcagttcggcgctgaggcagtcggcacgacggtcttcacgctgcgcaacaactgcacctacaccgtttggccggccaccttgtccggcaacaccgcggtggccgtcgggggcggcgggttcgagctgtcgcccggcgccaacgtctcgttcccggccccggctggttggtccggccgcttgtgggcgcgcacggactgtgcaccctccggcaccgcgtacctcgcctgcgtcacgggggactgcggcggcgccgtgagctgctccctcggcggcgcgccgcctgtcaccctcgccgagttcacgctgggcggcaccgacgggaaggacttctacgacgtgagcctggtggacgggtacaacgtcggcatcggcgtggcggcgacgggcgccagggtgaaccgctcgacgtgcgggtacgccgggtgcgtcggcgacgtgaacgcgctgtgccccgcggagctgcaggtggcggggaaggagaacgaccagcagtccggggcggcggcgacgacgacggtggcgtgccggagcgcgtgcgaggcgttcgggacggcggagtactgctgcacgggggcgcacggcgggccggacagctgcgggccgacgaggtactcgcggctgttcaaggcggcgtgcccggcggcgtacagctacgcgtacgacgaccccaccagcacgttcacgtgcggcaccggcgcgcagtacgtcatcaccttctgccccgcgcagcagcagtgatgatcaccgcaacagacctcaggatttctgattaggccatccatctccggtgattcaagtccctctcttttttttctcttacctttgcttcgtagtagtagcctagtaggtcgtgaatgactgaatgcaaattgtatcctctgtttcgtttttagggatttgcactaaaaaatgggttgatcagcgctgatctctctattgtagtactgtgtagttgcatggagccattttttagttgcgaaaatcaagccaccatccccgtgacaaagcgggggtttagtgggggcatggaatcttgggcctcgtaggctgatggttcgccaaccaggccgaccgaccaagttacgcaatcacggcccagcctgttaaggaacagagtggctaggtagcgggtagcgaaggaataagttcaccggaggtccctcaacttaacagcgagattttctgagatcccttaaccaaaaaaccagaaatcttcacccctaaactatacaaaaccgtctaatttaggtcccaaggcaatggctggttttgatgacgtggcatcctagtcagcaaaaataataaaataaatatgtgggggcccacctgtcagtgagagaaaatgatgtgggccccacctctcttttttcttttctttttctcttctgttctcaacttctcagctctcacgcgacggcgggatcggcggctggtgcccatctctacccatctagagccgcggcgggcgagcgggcgagcggcgacctcgctgtcgccagccacgccgcctccacggtgccgtgcacctcctcagcgcgacaccggcggaggatgcggaggagcggcccacccgccgcccgccgcaggccgagcgcagggagtccgccaagctgcgcatcaaccgcgccctcaaccagagcggccctgtcggccgcgccttcggcagccggttcggcatcgttgcgatgctcttcaccaggaccgagagtttcattcgcgaccagtgcgacgtcgccgacgactgggtcaacaccgtcgccgcgggggccagcgccggggcgctctaccgcatcgcgtccggcccaaggtcgatgattgtcgccggcatcctcggcggagtcctgtccggcgccgccgtcgcggggaagccgatgcttcagagattcgcaccgaagctatccgccagattggactatttactttgagtaaaatttcaggttaattactactcagcgttgtgcgcgcctggagatgtttttattcgtagtatctagcaaatctgatctcaattaattcatagtttgtaactgttcatattaatggacaaacaaacaccaccgcccgccgcaggcccgcccgaggtggactggtccttgaggacgcgcttcacgacgcgtgacgccacgttggccgtgtcgcccgcgccgcccctgccaccgtcgtcgcagccgagcgcctggagcacctgcctctgcgtcgcgccccgcgcgccgcccgcagccgagcaccagggagatgtggacgacgagggcggacacggccgtgttcccggtccccgcggcggcgaggacgcgccacgcgagcggtaggcaaaaggcgcgctgtgccgcggccagttgctaccgcgggcgccccttctcctgccgctcctctcccccaccgccacgtcgcgcgccgttactctccgccgtcgagctcgccatcatgccggccgtctctttctccctctcccactgccgccgccgccccagttctgccgccggccacctcacgcggagtctgccgctgcgcctgctcgagagaaagagagaagggaagagaaaaaaaaaaggaaagaaaggagagatgtggggtctacaccattttctctcacttacatgtgggccccacataattattatttttattttttgctgactaggatgccatgtcaacaaaatcgggtgcacatactgccatgggacttctttgcacggtttgagtaagtttaggggtgaagatttctggttttatggttgagggatgtaaaaaattctcgctgttaagttgagggacctccagtgaacttattccggtagcgaattagcgaccctgatcgtggcccgtcagggaacctgattacgggcccagcctatgaagaaattggatcgctatagtgcttgtgggccgtaaacacttcttagttacagaaatgctatttcctataccaatataccatcgggatgggatacattttgtcaacctttcccatccaaagaggaacgaggctgagcgcctgagccgtgaggaggaggtggccgtcggtgactccggcgcaggctggggaagaagacctgctcggcgagaggagggcgcggccgtcggcgacatggttgccggattgtcgcctagtgctcgagcaccgctgctcgccgtccacggcaccgccgttaacgcccaccttcggctccatccgcgtggccagccggtgcgccccaactccgtcgccggccatgtggccgttggcgacgtggtcgccggattgtcgcctggagctccagcaccgccgcccgccatccacggtgccgccattaacgcccatccccggctccatccgcgtggccggccggtgcgccctccgccggcgtcccaactccgtcgcgggccttcttcggtcgtcgccttcgtcgccggccgtcgatcccgctgctaagtccgggcctttattctatccatctgctgcttcgagagagcaaagagacaagatgtggtgcaaagagcttattgacttggtcatggctgactgttgagtgtggtagaatcatcttctacgtgataagaatcgcatgatacctgataggtatcatcttctacgtggtaaaaatcacctgatatctgataggtatcattttctaggttgtaagaatcgcatgatacttgttagtatcatctgatacctcacacgtatcacttgatacgttgtagaatcgcatgatacctggtaaggggtatcaggacatgatacatcacaagcatcacccaccacgtggtaaaaatcgcatatcatctgatacctcgtaagtatcatctgatatgtggtagaaacgcacctgtcctgatacctacccggtttcatctcgtttttgaacgtgataccggtatatagcagccctccttagttaacatgtagatttctgaagaaaatgtagcgcaaatcacacatgagtggaaacttaaactattgttgaatctaaaattgaacgcttgagatttatccgtgttatctggagaaaaaattttacttagtgattcaaccaatttttcagatttctgaccgaataaatggctgctggtacagctggacatcatggactcacccgagtcccggatcgtccacgtctcaaactacgtggagtacagtattactgtactactcctagctggcaactacgcacgcgctcgacgtcacacctaattagccacaccaaaaaaaaaaaaacaccctgctgctgctgctaatgaacgtgcgtgacgtgctgctgcctcaacacgatggcgtcgcgcgccgcgacgccgtaccgtgctcctcctcccacctgctccttcagcgcctcgtaccgggcgacgtcgaagctgcgcgcccgcatgaggcgtcgctgcctggacgcgaggcggctgcggtagaagccctcgaaggacggctccgtggaggtgcgcatgaagaaggcgtatccggacatgaagtagagcgacgtgacgtagaagcagacgggctccatgacgtcccacgagagctcccagaaggtgagccgcatgaaccccagcgtctgcgccgccaggaggcccagcccgcaccacagcttccgccgcacctgcgccgccgccgccgcgtcgatgcccgccttctcctcctccatcggccgcagcttctcctcctccttccgttttttccgcacttcgacgacgcttgctgcagctcgcgtcgcgtgtgccgtcgccggtatcatgctcccgatcgctttcgctatctgcacgacaacggagacacgttagtgtgggacgtaatttgcaggtgttcgatcatggattgtgtgtttgtgtttcgtgagtgcgtaacgaaagacgtacgtaccatgtcggggcggaggaagacggcgtcgccgaggacgatgacgacgccggagtcgtcgagcgcgcgggcgagcctgcgtcctccctcggcgccgccggcaatgtcgacgcagagcgcggcgaattccgacccggacacgacgctctgggcgttggacctcagcctcgcccgcgcgacctccatctccgccgcacgcgccaccttcctcgcctcctccaccgtcacgcccaccccctcctcctccggtggccgcgtcacggccgtcgtaggcgggaccagcccgtcgaggcggagccggttgaacagctggtcgccgacggggagggcggggaagcaatgggcgggaagcggaacggacgccgtggtgtaccggatggttcccggtctgggccgcaggtacgcgagcgtcgggcagtcgtcaaccgccggcaacggccgccgcgccggaggttttggagccgcagccgccggacaagcggcggcggcgttcgcgttcttccccgcccatatgccgcgtgctagtgttcgtcggaacgccattttcttcgcctctccgagcaggcaaccaaaatattttgcagattttgtgttgtgtacgtactcgtgttacgtgacagagatgagagatggcggcaactgctggttggttggtttggagttggccgatgaatcgacacgattttgacgaggagtgaacggcagccgcgggtcggtatttatattgggctcaccggtgacgcggcggataggggtcgttagctccagcggcgcgccagaaattaaattaaattaattaaggggcgtgtaacacggcgcacgttattattaatctgacctcgacgcgacgatgcgtccaggcaaaactgtacgctggatttggagagaccttctcaacgattgactcgtcgtgggaaatgctacacgtacgtaccgactaatttggatgtcgatgacacgtacatgtttggagattttaccgggtccgtcggggccgtacaggaatgtggacgaggacgacctggttgaagcaacacgcccttgtgcaaaggaaaccaacgaactgaacatgtcaaggaaatcaactcgctacttagcttcgaattgattttaacccattttttttctcaaatatatataaacacatacactcgtgtacggatgtacggataagagcattcccagcagctcatctaaatttcatcctccatactcctatttggatggccatccaaaaagattcatattacatcctacatataccaacatcctatattttactaatatttttcaactaccacacatttttactcctatttttctcacctttcaccacttaaaaaataatcttgggaagtgggtggttgaggatggagtgaggagagagaacctccatatttggcttgggaagagctaagtttggaggacctcaaaaaatagagtatgtgatggagactctgttggagcactgtttttcttctccatacttcaaatatcggatggatgactagatagaggagctgctgggatgatctaagttgattttgtgatacttgatgatcgattaatcagtcagtatttcgatgctcgtcgaatgtagtcaaatgatcgattatgtagctttttcctgggcagaacttgtgccaaatgtgcgcagagcaagcggctgctgacctaaccgagataagaccacaaggtgttttccatgtctatccttgatgagaagcctggaagaggtgcatatgtccaagagtcgtgttctggagtactgaacatatatccccatgacctcatcgcttagctagttcacaagtcaaacaagttgttcgattggcgattgctaacggctgatcgagctgacagacattggataggcatggcaattttattatttaaccttcgaacagttatgctagcagatatatctatttagtactgtaatgcttactggtttagtacatgtgggcaaaaagaacaggaaaatatgaactacggttccttatcagatcacattgagcgcgtaggctgacgttgaaattttagccattttcatgttattgctattttcaacactaccaactttaatttcggcaatgccaatttcagtaaggtaacaaaattcaaacaagttttagtgtctgcttagattttagccaaaataaaccttaccaaattttggcaatttggcaatattgccaagttttgacagtatttcttatttatttactagagttggtaagaaattaaatggatgtatatatttgacaactttaccaaaaaaaaaggcattaatttgaacaagcccctagataataacctatcacatcctaccatgcaaaaatttagtaattttctagaatcttcttcacatagcttcatagaaaaatatctgggaagggaaataaactaaacaacaactacttagtgtcgacgggggatacccgtaaaccggatatatagggtattggggtccgttggcacgaggatctatgtaatacgacatcaaacaaacaaaagacaatgattatactggttcagaccccttagtaggtaatagccctaatcaagttgatatgggattatatgatggaaaccacggattacaaaaggaatagcagaactcgatgataccgacgataccgtagtcgagtaggtccaactagatctcccggcgacttggctcctatgcgctccggcttcgtaggctgtggtgggtgtgttggcggtgagattcgatgccttaggtcctgcccagggggtcccttttataccgcgggtcagttgatctccaagtaggactcggagatatcggacctctcacgatatggtaaagacccagtctttgtctgagcagaactctttccatccgtagataccatatctatcacgtgatagatttccttaatgtatacgggaactatctgtatacgcgcgggtataccgtattagtatacaacgtatatccaaggatagagggtataccttatccgtaaccctgacacttagcgttatcaaatcttaccactacttaatgttgccaaatcttagtattgccaaaaactttgtaggattgaaaatagtagtaaactaaacatgcccttcatatgtgcaacatactccccctcattataagaaaaatgttgttttaggtattaacatagtctttaagatacaaatttttattactactccatccgtttatattataagatgtctcgaccctttttctagttaaactttttaagtttgatcaattttatagaaaaatactaacatctataatatcaaataaatttagctaaatctagcactaaatatatattgataatatgtttgttttgtgctaaaaatatcgctatgtttttcctttaaacttggtcggtcaaacttctttaagtttgactagaaaaaaaatcaaagcgtgatatgatatgaaacatatatgaataatttatattgcaccttattttaaaatttgatgaactagcagtgttatgaaaaaaaaaacttttcaccaccaatctacatatatgattttttatatatccaaataaatatttaaaaggtactaatgttcaaagttccaaagattttactgcataacaatgtaattcatgaccagcattcaacaactgagggcttaagttcatttcagattatttaccggattattgaaactgattgtttgctccaagtttcaaaaatatacgttttctaaaaagaaaattctactttagacttaattttatttattaaaatatttaatttagtctcataagcaagtagataattcaaatcaacaataccaacaatatgttttaaattgaacctaagtctatgatgatagactcctacgactttcacaatttcctttttacttgagactttcacattttcgatgttcaaacaaaaggtaaaccatagcaaccttgaagttggcctaaactaccgtggcaaatttgccgatacacgctaggagggtattatatgtgtatgaggattttatgttttttttctcgattacatggaagatgcattcatacacaccactcttatgtacccgtgattgcattctctattgtacgctaaaaagacagattaacaacatctccttagttactaaaattctattctaagtacatcggcctgtacgtaatgttcactagaatttgaaccctaaaaggtggagtcacgctcacgcacccatgactcattgatcacacaactagtgcttctgtggattttatgtattctggttttgatattttccatttgtacctaaaagaatgtagttttatcattcaaaagacaaatcagtagatggaaagtaaatgacttagacattattaaatgaggagaggtgctttgtaagatggggagaaaattgaataggatggtttggaagcaaaatattaccttgtactaattgttttcttcaatgaaattttaatgttagaattgtattcttgtagtgacggaggagtatttgtaagttctactgatatataactcgtatatatatctcgtatgtggtacaactcccaatcatttcaaaatgtaattttgaagtttccatattgtgcgatacacaactaaattacattcttttttagcataacgaaaatgtgcacacacaattatacacgagaaatagattattggcacacacaacgaaaatgttttttcgagtcaagtatgaaaacaaaaaacaattataaaaatatgtagcttaattaactggttaggtttcttttgttaaaacttatccagtttaattaatttataggcacgatatgaatatttagatttgcaactaattattctttcactgatagacgacgtatgtatttcagaggtgttaatttataggagtaggttgtattgtatgcatattgatagaagtgagtgcgcgtcttttgtgagtgtctatgatttttactttttaaagaaccaaatagaaaacgatgaaggagtataagtcgagtgtgatctaagacatatcagttgacgatgaaaaaggttgtcataaaatacgtttaaaacaaaatgtccgattcgcagttaaccgacccctggtaccacagaatttgtgacccttcacattgccaaggctcaagaaataaaaggtgatctttcaaaaagaaataaaaggtggctaaaacaaatgtctgactcttcattcgaaactaaaaaatcgttgactagtagtagctctttgcaccggatctagcctaacagaatttgacccttcaaattagcaaggctcaccttaatcctcttgcgataatccatcatgaattcatgattacgaagcgcacctttgtattttaaatttcagaattgttacagcctcctctgcattgatcaggctgttgacaaatgtaaagctggagccatggcaagttgctgcagatgcgcgcgcacatcagaaaaatttgctaagaaaccacacactcctccagtggaagcataggcagccagcactgcgcgtctttgcctgatgcaaagttaggcagcacaaagcaagcaatgctgatgatcttgcggtggattcgccctccggagagatgacttcgcttccacaactcccggaacatatcccacccaaccgttacattagctgatactgattccactgacaagtgaagtgacaacatgcgggcagccaccaccaaattaaaactgttcgattgttcatcatccattcctggctgcttgcttgctagctgctgccgatccattgtcgtgtccttctcaaattcacaagttgtgtcattcgatcagaattgctcgtgtgacgcatgcgtatcccttcaaagacggctctcactgtccacaagattagatccttgttgcctaggcaggcaggcatgcgagcggtgaacatggattggggaggctagttgaatgaatccccagtctattggacgtttccatgcatgcgcaagaatcccaataattcggggaattttctcaccggccggaacggactccgtgtcacgctgcaattgcgccgaaaggctctttccagtttttctcgctgcatttcgtaggggcttagtataatcgattgcgaaggtggattccacgaagcgagctgaggtagctatagctagtgggatctttgattaatccacaggccactagcaaagcgatcgatcgatcgattgagcttgttgagcccttgctacgaacatatgcgacgagacacttgctcatatatgctttctgattcttctcctagctcttgaggatctattaggccgccaccaccgggatctgggacatgtgctgatgcttattccgatactacttcggaagtcgtcgcactggttgccgttctcccgttgcttggaaatcaactcactaaatggaaccttaaaatttgggacaagttgggggtagatatactgtggagggatcggaatacatggccttcatgttgatcagatgtgtttgcagccgtagcatgcagtagcatatatattccagattctgaaaccgaccgggaacttagcaatttagtactagcatgttattataacaagacgatcactgtgcatggcgtgtctggactgattcgtactgaaaaattgatagcacaaataacgtggatagaacatcatgaggaatacagatccatttttgttaggttgcatttcactaaccaatttagtaaaacatgctgcacaaatggttatttcgtctgtcccataaaaaaaataggatgtgacacatcctaatactataaatctgaacaaacatatcatgtattaggtttgtgtttttatgagacaggaaatattgctagcctactctatattgggcaaaactcccgacccagcgactccttccactgcctcgctcctgacccctcgtttcctctctccgctaccttgccgctgtcccaagcggctacaagaaaggcggggttgttccttagtagggacctagcttgcgccttgtgttgcgacggaggaggggggcatcgggtctaggattcctgcccccagatctggcggcataggagacgttggggaggggcgtagcggtggtggctaggcctacgcctggccaaacgggttggtgacgacaacgggtagcggtaaggcatcggtgggtgcattagaggacaacggcgggctaagcgtcgatggctagtccttggtagggagaaggtggatcaggcggaggtggtcccgtaggcagttgacactagggatggtggcggcctaggagttcgggctaaagactccttggtggcggcggcttgagcaccggtgcaaggttctcagtgaggggacggtggtacaggcagaggcagatctcgttggtagtggaggcctggaagtcctggcgtaagaggatatcctcggcgacggtgggctaggaatccgagaggcggaggagggtctgacgacgacggtggccctatgggcggcggaggcctaggaatccagcgaagcggaagcggatcatgttggcttgcgtttggtgatcagctaattctgactggacaatgacatatgaaggtggggctaaccggtggcacatggcgttagcttacttgaagcggatgaagatggcaccagcggaggttcgcagtgacgacacactaggggcggctgtgactagacgacttccacttgtcaaatctggccatttcaggagaggatgtcaggaagcaagtttgtgctaaggtagtagttttttttttctgttgttatgtgttctcctacttgttgaggtatgagtgtaagtactcttgtattattttggctgtgtatatcctttgtggaaatagagaccggattaacgaaaatccattaatcgagaagcggatggcgaggcctagcaaaaatcgagaagcggatcctaagaccagaaatttgcaagatttttgccttaaatttatgtcaaatattatttggcaattccgcatgttgacttaaacttgacctttcaacattgatagtatgatcttagttatacactagcaagttcacgtaaaagtttaggttgttacacaaaggaggcactatgcctatgctttaacactcccttttacccttctttagaaatgagccgggagcttttgccagttacagtcacagtggagaaaaggatacggtccatcttgacgagtaaatgagcggaaattgttttaaacactcaggtggacatccacctatttcttgcatgtcatctaaatggttatgaaaaattttcaaaaaaatgacatgataggataatatgtaatatatcatctcacaaacatgcaagtttaaattcgacttctacaagctgtaacaaaaataacaaatttgactgtgaatatacacatgctagttagagtttaatttgttatttttgttacagcttgtagatgtcgaatttaaaattgcatgtttgtgaaatgatatattacatattaacctatcttatatatatatttagaattttttcataatcatttaggtgacatgcaagaaacgggtggacatctacccgagagattagaatcaatctccgttaatgagctgattcatgatgttcgaaagctccttcctttccaaccaaagagtgctagaatttgatgggggcgtagaaatgagagatcattcacatctaacaacattcagcatcttttatgtttcacagtctgacgacatagcacactattttttttcttttgagaccactatcaatttgaattgggaatcgacctgttagcttagctcctaaagtctgaaatttgttttttctgacaaagaagccaaataattttagtgatgcttttgtggaatgcgttcagagactttggtcgggtggttagttaaatgttgatttaaccgatgcttagtgtgctgtaattatgagcttctactttacgtcttgtgatttttccccgttgtgctagatctgtcagaatgaaaggtacaggactgtaccagttgggcaactaacactggagtaataataaaaaggcatgcctcatcactggttcgtctagcgttagtttaaatttcaaaagaggtcgaagaaacagaatacaaatataaacaacacaattgcagttgagtggctctattcagaagctttgttaggttttgaaaaattctctaaagtttggtagcaacagcgtcaatacaaaaattcaagacggacggaatttgtctgctctgtccaaggaaaaataagtttttggcagtctgtattactgcacacaatgacacaaaccagcattctccaaggtgtttttatctcgtgaacaattgcatgatccaatcgagatagcaacactgaatctgaatcgaaacattctcggagaatctcgggtgaatgctcgatgaatcacccgtcagttgaatccaccatatctgcacatatcttgaaagcttcagtagatgcctcaactcggatatgtaattaactagtgtgacagtgtcccaggatcaccgtagctagttgcaacgaataatgtcagattcttgctggtcctggtctagtagtgctgctgctcaagtatggaatgatgcagagaaggcgacgctgatgcatctggaggaatacgagcgtggcatccggttctgggttctttgattcggcagcctgagaaaacaagtgcggtgtatgcagagctggccaaaaggaacaaactttggtggccacaccccagcatcccagattcacaggaatcctttgttccttccttgtcaagcagcactaatcgcctattactactctactaggatgctctgtttgccagattctggactttgatgatcgactcttttcttcattctgtttcagggaacccaactagtagacattcttccaccggctgccataagtgagtgcgttgtaattgaatagtctagatagatcgtttgctagctggcttatccgtaactagaatttaaattttaaaacttaattttaaagttgattttgagaatttatcatatatatatttcaatattgtcttttaaatttactcctacaacagactcttggactaacactcccactctcagaaccgaactcgcaaagggggtctatcgattccccattgcagaagctccgttctccgatacacgtaaacattacgtcattcaaaactggtcattatactattttgggactatttagggcctgttcactttgatgccaaaaaaaaccttaccaaattttggtatagttgccaaaattttggcaaattttgacatgatttcttatatagttacctaaatttggtagcaaactaaatgtagccactttttttggcaacgttaccaaaatttggtaaggttgaaaatgacatcaaagtgaacaggctcttacaccgatttaaaaagctgagaatgtgttgtacttagttttaccgtagaaaaaaaatccaaaacgaagaaggaattttttttcctatcttgcttgttttgctgggccgatattatcttcttctatcaatcatagacggaataagttcatctgaggtctcttaacttgtcaacgtcgtgtaaaatgtggggcccaccatttttaaattaattttttggtgtaaactgatatgtgggcccacaatttttaatattttccaattacattgccacataagcgccacgtcatgtgaagaccgagtcaaaatagccacgtaggcgttacgtcagtgaaaaccgctatccaaaccaccatgggacctatattgcaccggttttaaaagttgagggacccattgtatctgtttttcggttgaaggacgaaaatcggatttgttgacaagttaagggacctcaaacgaacttattccatcacagactccgtaccccgggagtcagagttggcccataactgacactggcccgtaggccgtagtagcttatcggttaacaatctcatgggctcagttttcaacagatcctaacatccccgtactatacgagtctacgacgatgactatgctgcaaagcaaaggaaaaggccagtaaaccatatctttcgctttcgtccgtataagcacgaagaaaatgccaccaaacacgcccctcgcgtttgacgagatttctgaagcaatgaaaccgtcacgcttcctagaaatcttcccgaaacgcacggcacgtcgaatccgtgatgaatcgctcgcaccctacccaacccaaccctccccgactcgccgctccacgccgcaggcccccgcgcgcgcagaggcgtaggcgagcgagcaaacgacacggcacgacagtacggcaccaaaccccaaccccaacaccggtcgcgctcgcgtcgcaccgccccggcagccaagagagagaagcccaggaaaggccaaggtgatcgacgagcgcacgcacgcacgcacgcggcgccgtcagaaggccagagcggggggagaggggaggaggggctaaatcggggagaggtctccgtcatctccgactcgcggcgcggccccctcgccgagaccgacgggccgacgcaaccgaggcgagccagcgatcgagcgggcggggggcaacgcgtacaaaaaaaccccctccccttcccttcccttccctctcggtcgcgtcgtcgcgtggtcggcgaatattcgagcggcaacggcataacaccattgtcgcccgggacgcgcgctctttctctctctctctctcttcctggcgatggcggcggcggcgggggaggaggtggaggcggcgcggtgggcggaggcggaggacgagaggaaggaggggctgcggcggcggcggaggtacgggcttgtggagtaccgggcgctgccgggctacatgcgggacaacgagtacatcctgcgccactaccgctgcgagtggccgctcccgcaggtgctcctctccgccttctccatccacaacgagaccctcaacgtctggacgtacgttccctcgttcctttctccgtctctcctccccccctctcgattgattgtgcggttgaatttcctgtcatgtgagaaggaggttaagttgttcattgcacgggtaatgcggtggaaaggagatgtgacatcgatttctttcatggatggatctgttatacggagcaaagaaattggtctatagatcgggcgttcgaaacatctcttgtctgcttgtggatgctatagctttatgtttcaggctggataaatcccatacaacatatttcttctggcattgggtatttgaagtctgaatcttgaaatattaggctgccctcaaaatatctagccattctgtagatttttgctcttgtgcttatttactaatttatttatttattttatttgaatattctcaatagtgcatagttttgtagttgtgtaaattagggaggccaaggcttacagtttctaaacagtctggtattcaatttacctacctttctctctactttaaagactaaactcaatttgctcatatggattctcatgttgcaagctgacattaatttgaaagaaacgggcaaggaacttcaacaactagaatgcaatagagggacgactcccagctggaaaagccttcgttttgtacttgactgttcatatcatgcaacaggtcacaggaccacctaacttattgaaagaagtcccctgtggatgatttaatgcgtttaattgtagtagttaatggaggacagtggtctagcagtatttcttttatcgggattgctatatgtcattcgaatgaaatttggggatgaaatcttacagattttggaccattggatccatgccaagattcgtgcaccaccttttttcttcaacttcggggggctccccttttttctccggcgccggcgacaccccaacttccggcagggagcatacgggttagggtctggggttggggtgagggtaggaggggggttggggagggggaagaggggggtttcctctgagcttagagggatggccgtgggcggtgtacttcggcgaggcggtggcggcgccgccgaagccgcagggatggaggagggtggtgggccggcatcggcggcgggggcaaagcaagcgtgtggttaggaggcggcgggcggtggttgcggatccggcggtagggagccgccggagacggggaagacggcggggcgggggcacctcgtcgtcgccgcctcgaggagaaagagaggagggaagggggagggggcctcgccggcgccgttgaccccttccggccagccggcgaggcggccagcggcgcggtggggcgatggcggtggcagtggtgggggatcgcgcgaggacgaggagtggcggcagcgtgcgatctgaattgggggaagaggagaggagttagggttagagtggtctacacaaatcttgaagcatatccaatggtccaaaattcgaataataggaggtggcattttttgtcacatgatatatagacagccccttcttttattgtattcgttgcatatatatatcgagctcgaatggagatcaagcaatttgattggcatcatacaacgtttatttggttactgttatttaaaagttatgtgctcgtatggagatgtatgcattctggaaaattatgactgtggcaagtgcaactcctaggcgacatttttttatgtaaaaaagttatcaatgtgattaatgcaggaatacgtctgctaagttacttttcctgatatactaaagctgttttttaatttgtgaactcaggcacttgataggatttttcatctttcttgttcttaccatatacaccgcaacacaagttccaaatgtagtagatcttcaaagtctgcagcatttacctgatgtgctgagaaacgctgatcttcataagattcagacagaacttgtggcatgccttccttcgttacctcacctttctgacttgcaaaagctgaaggatgaattgaaaagctcatggaattcaattgaggtgcttccatcattgtcccgttggcacctcttggagttactatcaagttgcttgccgcacagatttactcattccaatgaaaccagtctgtctgttcttgtaagtagtcaacaacttccctagtttattactcacttattatgctactagtatgttatttcagatatcgcaaaattaatgataatatgctggcacaattttcaaccggaaattattactagggatggaatatcaattcgcaatcgtttggtttcttagtttatgctagttcgtactgatctgatttcatctgacttatgacaaagtttaggccatgaccatgaacaaaagttgagtttatgctagtttaagctgatgctgacgaaagatttggtttctataccatgaccagtaaaaaatataaaaaccaacagattcctaggcaggtcactgctttactggaaaatcaggatcattaagaagttgcaactttatgattttgagaaccctttgtttagtcagcactcattttattgaaggtgtctagttttacaaacactggcacacaattacacatacagagaacaattgtatggtatgactagattttatctagacatttttgtcttcagagatagcaaataacattttctcacatgtgattatttgattgaaattttggagtgaaggtcattaattcagtccccgtcatcttatatacccccgttttttttttgttttatgcagcaaagcatgaaggaagatatagcaaacatgattgcgccacagttgattaggccaattccgagatggccattttatgccttcttgggaggagcaatgttttgccttcttgccagcagcacatgccatcttctctcctgccactcccgtcgccttgcatacattatgcttcgccttgattatgcaggcattgctgctcttatcgcaacatcattctaccctccagtatactattctttcatgtgctatccattcttttgcaacctgtatctcagctgcataactattttaggagtggcaactattgctttctctttactccctgttttccagaaccctgagtttcggaccatacgagcatgcctcttctttggcatgggtgcatccggcgtgatccctgtcattcacaaattgatcctcttttggcaccaaccagaggcattgcacactaccgcatatgaggttctgatgggccttttctatggcattggggcactggtgtatgcaactcgggtgcccgagcgctggatgcctggaaaatttgacattgctggtcatagccaccagctttttcatgtgttagttgttgctggagcatacacacactatcattctggactggtatacctcaagtggagagacgtgcaaggctgctagaaattatctgtgtgctcgtaggatgtggatagattgtaggtgccctgcttgtgtcccgaaaaagaggaccgctgattctctctcgtcttcagaaacaaaagatgactgttgttgttggccaaaagactagacctggtctgttgtaaaatgtaacggaggacttgctagtactgtgagatacaaattgataatgagtgatgatcggtacctgtaaactgtggtgtggtattggctgatttttcagggtgcaactcacttgataaatcaggccctattattcccagaaaataactattcagtgataccacagcccctgctgtgcatcttgtgccgctatttatcagcttgctcaagttcaatgcatacataaattgtgtttacaataggagcttgggaagtgaaatgaatgttcaggtaatgtccctatcgaacgaccaccgaaaccatcatcattcatcaccaatcatgagatccactccccgatttgctacggttgtgggcagcaaaacgaaggaaaccaacggcctcaccggctcgcctcgcctgtgcggtcaccatcaccggctcaatctgccattctgccgcctccaattctccaagaacttaaggcctttggggctccacgttgaagtcggatgtgtttccttgcagctagtacgatgtattgctgctagtatctactcctagttcacaggccgtgctgctgattttctgatggactcacgaagtcgcacacgtacgagtgcacgttagagacgcccgtccaagggctatattgcttgatggactcatagctgtgggctgttcagatgagtaacccatttccacccatcgtgccaagatcatgtgccggcccgactgcgatggcgacacacaattgtcgattgcctaccacaaacagctagatcttgaagaagaagaaaacgacgagatttttttttggcatctcgactgcgcccgctaagccgtgacgttgatcgtgatgaaaacttgacatgtcgagacccagagacagctaaccactataattgctgtaggtggcccgtattctcgcctcgcaacaaacgcacccacacatggatctcctccggcgagtcgccgtggtagccgtgctcctgtcgctgccgtcgcgtggccgctccggcggcggcggcagcgatctgcacccggtcgtgctcgtgccggggtacgggtccaaccggctctacgcgcggctgactgcggcgtacgagccggcggcgcctcgctgcggcgcgcgagaggggaaggatgagtggttccagctgtggccgatcgacgcggcggcgagcgaacccgcccaggccccctgcctcgccgagaagatgagcctcgtctacgaccccgtcgccgacgactaccgcaacgtcgccggcgtcgtcaccagggtcccctccttcgcctccacccgcgccttggttgggtgagtatcactgtgtcacgctgtcactgtgtcagagtatgtcttacgtcgtactaacaatcgtacgcacgtgtatcaatgcccgtgcatcaccaggtagatactcctagatagatgggcagccaaaatttatcggaattgctagaaaacttgcgacagttttctccaaagaaaacagtcgaatttgcagcccttagatccgctccgtgattcatgcgggcaagaaggaagaaaacagctaaaaatattgtcatagacaggagtcgaaccaaggccctccccttaaaaaggacagcataacaaccactaagctagctcaagtatacgttgaatgtgaaattacattttggttacattttacttacgctttaattaactacacaattagtcccctgttttcatctaatttttggataatcttgttatatttcactctcttacgggcttgctagcaatgacgtcgctgttggatgcaaaggctaaaaaagtttgaatgtttggtacctagtttctgtcgaacgtcctatacgtattcacgtgttttaatctacttacatagcacttacactctagttacatagtagttacgtagcacttacatcctagttatatagtagttacatagcacttatatcccagttatatagtagttatatgatagttatagggtaattacattatataaaattaggatttacaatttttttaagatcatgcatattacttttgaattatttttcccttatatatgttgaacaaattcttaccgttgaatcaacctaggcataagattagtggtttgtacttgtgtggacccgtttcaacagatcctatggttgaaaaatttgaaagttttgagtctcaaaaactgtcaacaactcactagctacttccaaatttatttactatttatttattcttgtctgactggcaggtgggacccactggtgcggcagctggaggcgatgggccaccgcgacggcgggagccttttcgccgcgccctacgacttccgctacgcggtggcgccgcggggccacccgtcggcggtgggcgagcgctacttcgctcgcctcacgcgcctcatcgagagggcgagccggctcaacggcgggcggcctgccgtcgtggtggcgcacagcttcggctgcgcgctcacgtaccagttcctgcgcgcccgcccgctcgcctggcgccaacgcttcgtcaagcacgccgtcctcctggccgccgcgctcggcggcttcgcggaggggatggacggcctcgcctccggcgccggctccggcctccccaacctcgcgccgccggcgagggccaggcttgcgcggagccagcagagcgcgctctggcgcctgccgacgccgatggtgttcggtgaccggccggtggtggtgaccaagaactcgacctactccgccaacaacatcaccgagttcctcgacgccatcggcttcacggaaggggtccagccgtacgtgacacgggtgctgccgatgtggcgggcgctcccggcgccgatggtgccggtgacaagcatgtacggggtcggtgtcaggacgccggagacgttcgtctacggcgaagctgggttcgaggggacaccggaggtggtgtacggcgacggcgacgggaacatgaacattgtgagcctgatggctgcggaggagtggtctggggtggaaggccaaatcttgaaggtggtcaggttgccaggtgttagtcacgttggcttcttcagcgatcttgctctcaagaaagtagttgctgaaatacagaaggcagttagcagcatagaggtacacaggaaagagaaaatcttctcttttctgaataattttgaatttacaattcctgtgccactaggatggtgatgtccatatgtcattactgatccgtgcaaataaataatagcaataattttggctgctgtaagtaggcaatttatgggtgactagaaatgatatgattttttttagataagttagtttggtacccctctaactatggttgattgtcggggtctttactgtaacagtgaaggatgttgatgaagccgaaagatgcacgctaaggctggggctctttgatctcggtattgcttgaagctgctgagaacttgcactccgaggtgggaatggaatgatgctggcttaccttgcgaaggattctgatcttagtgttacctatagtgtgactgtatttagtttctggtgttgctgcttagttgtctaggtaggctagttgcttaagaacctcctgtcttttgggtgacctatgtgcccatggtgcttaataggtaaagctggttttgcctaggtgggacttatgtttctgtgagaatgactaaagtttagtccctccttcccaaacactaccctagtatccatcttttttgctttctaaaaaaacagggctatgtaagagaactcttttaatcacttgaattaacatccacacgtttattacatattaattagttatgatttttaaaaaatatcaagataaattaatatgtaatatatcacttcacaaatatatacaggttcaaatttccaacttatacaagctataaaaataataaatttaactataaatgtatatatactacctagagtttaatttgttactttttataactagtcgtcagagtacggaactcctttaacaggaagctatgcgctccctaggtgagtttagctagggtgcaagtttcaagctcaagtcatgatcctgcgaagggaataaacacaagcatgtatacatattcggctcgtacggatacgtaataccctattcatgtatggtggacgatggatggtgaagaggattacaagtaagatatgaaagattctaagtgagaaggagaagatctttgctcgcacggtgtttggctagtctagaaatgtgaacccttttcacggtggtatggatcctccttttatacattaagtggagtccacaatactattgcacgcatgcaggagtgggtctcacttctctaaacttaatatacttactcttgttggtgtcacttcaagccagttggccagatgtgacgaccacagctactgattgacaaatggagtagaaaggcaaaagtctttgttccaacttccacgggtccacgtgttagcaacaatagtccacaacggtgcccccgaagggaggatgttgaggacacaccacgtcgtacgtctcgttctcttcgggacgatgtgcatgcaaggcactacatgcacagccacatctcctatatttgtggatgagctgtgcaccgagtttgtaccaccccataatcaatgtaatgtgatgatttaaaagtaaccacggtactaagtcaactctccttaatagggtaacccctctaaggagagcctagggcgtcctcaggaccctaattagcttgcttatttgtgtagtgatgtattatatattaatatatcatgtcattttagaaaaaaaaagatagaaatgtaggatatgtacatatactagttaaaatttaatttattatttttgttacaacttgtagaagtcgaattttaatttgcatatttataaagtgatatgttgcatattagtctattttatcaaaattttattattaatttattatcatttaatcgatatgtgataaacaagtggacatccattcaggtgattagagtccctcttcgggctataaacctttcctcttaaaaaaaggtaggatattttagtttgctaccgtatagaatctttgccaaaattctggcaagacaaggtggtctggtcagatactcagatagcaaaggccacaaagctccattggaagtgtggaaattttggtatggttcaaaacttcaaattgcatcgattcaaaccaaacgtgcctacgactctttgccacccaacgaagcttcaatagagtcaggacagacgggctaaaatagttgggctttctggcccaacatcagtcatagtcggcttcgtcagcctggatgacagccgaacacttctctttatcgaacggctccagttatctcgtcccctgacaaatccttgtttgggctctatagatgataggcactcttctaacatgggctgcccatgtgcacacgcccatgcgctacttggcacaagcctggaaatcatcacttcaacgaagcaacgaacacttgcccaacatgaaactgtcagatgtgcccgctttcgagtcgtctacccaaggaaatgtccctgtagcgcacgaacacgacaggtcgcgattttgcgagtgctcgtcgtatcgttcgtcctgtaacgatttcgcgacgagacggagcagcagctagccatctagcgaggaccaccattatcccgcgggccctttcgatgggcatctttcggccccattaccccgcgcagtgaagttgatggcgctaggccatccgggtccagccaatcggaggaggggagatgggcccggatgcctgtgtggttccaagtcctgtcgttggtttggctcttttccgccacttccacggtttcaaagcaactggatcttctgcagatcagtacagtggagttagctggaggcctggacctttgatttcttgagattttgctcaacataaatggcgcaggttatctgtcgtttctttttctgttatggccatgggtgtgagtatgctttaggtctatcattttcatcaaacctttgtgtccccgtcagtggtataagctatttagaaaagcttgagaaattcatgtgtttacttccggacattgtgtttttgactagtccatttaaagctatcttgatttgtagggaaaacatttgaatcttggaagatttcaatctatagaaaaaaaatcttatgaagtactttcaaatagagaattgaattgtatcctatctttagaaattactatgaaatcgacaacaaaaagttagcaagagcttaaacggattgaaaatttccatgtgagaatattccatttgttagttcttacggtctattcatacgatcattcttatatttttcgaagtttgttttgcaattgaatttctatcaaaattaaatattttttctattcctttatgttttcgatcctgcattttaaagagctttagttgatatttttttccaccgatcgattcggtagcacctgatggacatatattttctttccaaaatggtccagagcgggaatttcttgtagcgtatagccccaagaccgtgggatccataccagccaaacgagtcccctaccggcagggcaagggaagcaatcaaacggatccacgtccactccgtcagttcatctcttcaccaccacccacctctacgaccacgattactcctatcatcttcctctctctccctcttcccatccaatcctgttaacaagtgttagctgagaaaagaaaagaagcgaaagcgttgctgctgctagctacaaaaacccgaccagcactggtccttgagaaagcgaagtgcaacagatcgatcaaacgcttggtgaggtcacggtcaaagcgaggaggaggggagcgaggcacggaagaagcaacttgcaaaggtggttggcagcaccgagaaatgccctcctcgattgctgctgctgctgctgcgtgccgtccccccctcaccctcccctcccctccctctgccttccgctgtgctggcccatccgcccatggcacattggcatggctcgctcgctggctgcatcccccaccccaaaccttggaccacattgaccggtcagacaagaggcctcaaccccaccccgtccccgcgcggcacactgcacaccgccaccccccgtgcatgcgacgccacgcgctacggtttccgtctcctcgtgagccccagcgccgcacaccacacgccctgtcgcggtgtcgcccccgtcctcctccggattagtagcctacgtcgctgcctccggattattttgattactactactagtaatcagaccctgtttacatccctgataaaattttacacgctatcacattaaatatttaaataaatatatgaagtattaaatatagaaaaaaaaacaaattacacagattacgtgtaaattacgagacaaatcttttaaatctaactacgccattatttaaccatgtggtgctacaataaatactccatctgtactcataaagaaaatcatttaggacaatgtttaagtcaaaccttgggaatataaatcataaataactctcaatttattgagtttaaaaatataaaaaatatataaatagatttatcatgaaaaataatttgataaaagtatacatgcatcgcctggagcgtagcgtgatgatgatcgtagcagcagcgcgcggttaagttattgctgtttgggtcgcgcggatgccggtgcgggggctggctatctcggcgagggggaaagcgaccctgtctccctgatgccgcgctgatttgttttatggctgctcagacagctgctgttcttctcctttgtgcttgtggtactagagttgtactatactaccactaccaattggagtattttagccgggggggggggggggttagagcaagtttaatagtagagctcactacttactattagttaatgttaaagctaacatatatagtatgttggctataaggttatctttattttcttcatcctctctctctctcaccatgaatttaatgcatattttttagagtttgtgtgcagttagctcttgcatgagagccaacactctctactttttttatctctctcttccacataagcatatagcttgcttatagcccactattatcctttttatctctctctttcacataagcatatagcttgtttatccttactcttataagatgctcgctttctgcctctcagggacagaccggattaattagcagcgcgcgcatcgcacaggcttttgacagttttattatagtgctgctgcgtcgtcccagtgaccgtcagggcggttttggatgcacgtggacgctgacactaacctgaaagatgggttcaaggtgggtgcgtacccatgctagctcaatgccacttgaattcacaaatgtttcgcccgggtgaggccatgtactgtagtacgatggtttgattcaggtataggaaagctttgaaagaaatgatcgtaaaactaaaaataaaacctcgtaaaaacacatgcataaaaagacagaaaccaaatgccatactaattggattcctatgaaatttcataattcacaaaaaaatcaaaactattgttcgattggcacgcatgaaaatcacaagaaatcaatacacctgaacaagaaaacatgaggtgagatttcacttttattcttagacaaatttgcttctgctattccataggaattttacaagaattgctagaaatcgatcatttgtttcaaaggatttcatagagttatttttctcagaatacaaatcctctataaattatatggagtgaagtgcatgagcggttcttaaacttgtacggatgtatcatctatatccataaactttcaaaatgcatttttgggtctccaaacttgtcatgagtatcatatatgtccaaacaggccccaacctactccgtgaggtgacgtggcatccatggtgacgcttatatgtcagtgagatccacatgccagtcatatagaaaaaataaaatttaaaaagaggggggagagagagagagagaggagaaagcgatgtttttaattttgaaaaaataaattaaaaaagagagaagaaaaaatatgttcttattttttttctatatgtgttgacatatgggtcctactgatacgtaggcgctaacgtggcatgctacgttagcacatggagcaggttgaaatctgtttggacctatatgacacctgagacaagttgagggatccaaaaaattcattttgagagtttagggatctaggtgacacatccagacaaatttaggggccgcccgtggactttacttaattacatgttattcctttatttcaaaacccgaattttttattcataataattaataatgcagaaattaaatatataataaagcaaagtcattttttacgaaaatagaaaggacgctattgcatagggcgtccaggtgtggacgctgttgtagacaacgtccagatggggacgtttcttacaagggcgtccataatgctgcagttgaagaccccaaagagccgtccaattcaccggactagggcctgtttggttggtgccctgagtgatgagcctgagaaaaaagcatgcctgggtggaagaaaatttataaaatgttttccctgatcaggcatataagagggtttgttgtttggttggtaccctggacaagaaacgagcctgagagcatgaaaccatgtgaaagcaaacaagaaaatataaaatattgcattctcaaccggttagtacaagtaaacattctgaaatgacgccatgcaactagaatattccaacctcacctaatctaccttctttaattcggttgcctgagtcaggccacccaattcaagcgcctgagcctgagcaaccacgcctgtgtccagcaccttctcaggacttgaaccaaacagaccaatgaaaatgtcaggcaagcttcagctcaggcgaatttgcttcagggcagcaaccaaacagacccttataagattggactttggaaccaatcacacaatggtcgaactttgcctcgttactcctatgcagactattgtctctcgttgattgcttgcttgccgagcaggcaccgctctctacctgatctgtcagacagggtcgccatcccccggccctccttcaatgcttccgctgttccgcatgacggacactctactcggggtcatatgtgaacagccgccacttttattttgagatatttgattagtttggtttttgttctggtccattgtttactacgcatcgagctctctgctgactgaatcttgagaagcagtcgtcagatgaactgcatgcgaggtcttcgatcgatgcttttttttccttttgcaacaggccagagattggaagtcatcgggcgacagatgatctgatagaaggaggatgtttgcgtcctacccttcgtaattttgcattctttgtaaactttctattgcagaacatatacacttgaataccaagatctatgaactgagcatacttgctcggccagccatctggagtgaggcgatgcctggacttgctgttaggaaccaagaggggcggacagacgacgcaacacaagccggcacgagtgggttattgttccagcatgactcaaccagaacgtggatagcggctgcaacctcccggcgtgaaggcagaaagcggcggcgtcctctccggattcgagagccttcgaggtgagttgaggtaaacggcagattactgacgttgtggagacagaagccggaaggcggctgctgcagtctcccagagtcgaagtgaacggcgggcatggcagcaccttgcccgagccctgcaccaacattgggcccgaggagaggagagttgacgatggcgcctctccgcatggcggcatgggcaccccaaaccgagcctggacgtgcttcggtacagcgtccacctctggacacttcttagaacagcgtccaaatctggacgccctttgaaacaacgtccatcctatttttacaaattcaatttaagatttaccacttatttaattcaagacttattaattactataaataaaaaattcgaaaaccccaaattttttattcataataattaataatgcagaaattaaatataaaaaattcggtttcaaaacgacttctcatttctcaaatcatcaaattccctatgttttgtgtgtttcaagtcacctttgtctccacgccctgtaattccagtactctgctcaccattggttggtccttgcaagttgcaaccgcttcggagaaaaacagctggtttgcttactgaaaaatcaacggtggctggagcaacgtactgcgtaccagtactactactccaccaatatactcggatactttctccataagtcagagatatatttcttttatcaccaagaaatatactccctccatactcgtaaaggaagtcgtttaggacagtgacacggtctccaaaacacaactttgacttttatttctataaaaaaatatttattgaaaagtgatatatatatatacttttataaaagtatttttcaagacaaatctatacatataatttttacattttcaaactcaacaacttgatagttatttatgatttatattcccaaggtttgacttaaacaatgttctaaacgacttcatttataagtatggagggagtactttattcgtctcatattaagttaatttttagctcctttagtttatcccaaaataagtttatttttaagaacaatcattgtattgtagcttgtaaaagtaaggactagttgtaatgggataagataatgcaaggaataattgtattggatttgataaaatataggcattttactattgttggttttatattggtatgtgtggaatgagtgaaaaaaatatttcgggatggatgtagtatattaatatatgcacccaataaatattaaaatgatttcttgggttctttaaccgtttaatttagtacatcaagattacaaataggtattaaacttttaggaaaaaccaaaaaataaaatggatcttagacttttggatgaatgtctgagtactactcatatatattttatttaatgtgagtatgtattaggaaaaatcaagaaaatgcactttaactctccatatgcacaagaaacgagagtttaacaatctctaaatacttgcatgcatgcatacttaatttgtatataaagatgtaataatactacatgtgaaacaagaaacaaaggatatatgatgattagtttcgaatttctaatttttgatatgatgatcagtatggagggagtactaacgttactttgtcacgtcaggaccgtgcatgcatggtgcccatgccagcaggcgaccggttgccctgtttacctgtagtcgggcaaaacggaaggcgctcctccctgcgctcgcacgttgggtcagtcagtccgctcgtcagtccctttcgacttccgtccacccatccgtcagcccacgccacgcgcatgcgctgtcgtgcgtgcttcgtcctccccccctcccgtccccgtacgtcgctgctaccgtcgtccccgccttttccaggcctcgctgcagccaccccggcgccgtttcctagccagcggcgtcgcatgcctacgccactccagggcgcaggcaaagccagcggccggtaggcggctgtgcgaagaggaagacgacgcgtctccatccgtccatcgaccgacccacccccggctcgctccggatagacttgtcgtcgttgttattcctgccccgtgtttaatgcccccgatcgatcgcttcgattcgccctttgacccgggtaatctgcagggtacgtacgcacggggtacgtactttgcatcgcatcgcatcgtgtggcagctgggcgttgagatcgtggcgttttaatttttctgtactagtactagtaggcgtcgtatggagccgctgtgcacagcgtgtggccggtcaaggagctcgctctggacatgtccggttaggctttactgtttcgcgtactgttacagacttttcccctttgtgttttcctctttctccttttgtttttcctcccttcgttatctctttcttttgcttgagagaagaaatctgtcctctcgtggtctttggtcttggtcattaagacgtccttccgcaagaaagaggggctccaacctggcatcaatgcacgtgtgatgttttgccaacctttttctctccccctatccgattgtaacatcttttccttctttcctagcatgtgtgtagatcggcttccccaaagactttaaaattcaaatcaacatcgtttcctataataaccctagtacacctgataactctcgaagagtgtttgataaactagggaattgtaatggaagacactaaaagtatagttaaatttgattaaattatattttcattgacacagttttcttttataccaaatatatttttaaaataaaattggatttcatatataattttgagctactgtttctctatataaaattgcactttttttcagtaaaaaaattgtattgtaggagtatataaatatattcaccaatttacaccattttgatttggacccaacataatctaatggtctaaatatttttctttttctctcattagtgtaggaatttctgacatctagagtaaaaaacatgtgcaattttttagctctattaataatataagtatgagattatcaagtgtgaattgaacggtgctacaataaaaagctagaattatattcaatacacaacacttgttttattttcatagatactattatattgtatttttgaccaatgtattttaaaataaaattttatttaatgtacaaaatttagcttctgttttcatagatacaactactatatcatcgaatcaacgttgttacgttctgaaccacgatcttatcgtctaaattgttttgttacctgtggttttgttttcagggctctaaagcaaacgttgtggtttacttttttttatatattttgaaaaaaagttcttttaacttttttagtaaggtgcagattgatattccctctgtttaaaaatatatatttaattttcacttatcccatacactcaataaaaaaacagaatacccactttaatcaaatctgaatgcatttactcattaattttacaaactccaataaaacaatcaattaaaaataaacagattttgagacaaattaaatactcccagatactcacaaattaaatcaattcctaagggcacccgcaatggttatcgataggctctctacaaaagatctatgtcagcatattttcctacttggaaaatattaaatagagagagaataaagctatctactaactcggagatagtctatagagaaaaatgaaacaatggattagagagctatagatacccatgtaaacatactattgaagtggtttactattaatctagtctattgctgagatgtacatgttctatagatagcaccttactttactattacgggtgctctaggttcccatactcgctgtagaccaaagagaacatgatgagtggagtatactgtgaaaactgataacaactgtgctgccagtctgctactcgtactgaagtttagcatgactgctccagtgattcccatggatttgattaggagcggcgattggctagggtttgaaactttgaaaactgatctgcggcgatcaatgcgcggtcagagctgccctcgggagagcggaacggtcaaacgggggccgggggcaccacctccggtagcgtaacgtgagggtcgcgtgccacgaggagaggctgtttgcttcggtgatggatggtgatctcaccgcacgtgcggtccgcgtgccgagaccaatagtacagtgcacacatcacggcatcacgctcgcttccgtctgcgctccctgcactgctcccattttcccagaggtaatatagatttaaaaataaaagcagtgtagtgtgagtttaataaaagtaaaatatggaggcggcaccatttgtaatgggaatgaaaatcacatcaagcctagctaacgcaccattccctgctatagattctactccatcttttgttgttgttgttgcgctttggcataaaccaatttcctcgtagtggagtagcagcagtgaaaaagaaaaaaaaatcaaaaatcaaaataatataatgccagtctgcatgagcagaaattactccataaaaaactggggagaaaggaccagctatgggcccacctcacaggcagcttgtcagtgagtgtggcaatgtctggtccccactcttctaatccaatcccctcactagtcctccctcctcggtcatcagtcatcccaacccaaaccaccaaaatgaaaagaaaacccaaataattccatcaggatattcttgctcacacatacacacaccctctcacaaggtcacagactcatcgcccttgcagccttcctctctctcctctccacccactctagcttggcttggaccagatctcacattttttgttcagtttctcttcacgccaccactccctcctccctcttcctcttccccttcctcctcacctcccattccctcagatcttcccccatatctctctgtctcgccgcagtccgcctcccaatctgaggagcttttcttcagctcaagcttcttgctcgcttgctctctactatctctccttttgactcgtggccaagctgcagaggaaacccaaaattccaagaaaagcaacaggtcaagaaagagggaaagctaaggtgagaggagatgggaggaaggaaggaaagaaagatggtgatgatggcgataagtcgccccatgattcgcgccatcattccgtctcgcccgaggccagtgcgctggtaaaagggcctcgccgtccgtccgtccggccggccgtgcggcgcgcgtggaggaggtggtggtgggtgcggaggtgcgtgcgtgagaggggcgtcttgccacaatgccgcagtaccaggagcttccctgcggcgggcaggtgctcgacatcgacaccgcgctcaaggacggcatccttgggggtggcccggagctcggggacgcggcggccggggacggagggaagcagccggtggagctgaggaagatgatggacgagctggacgcggcgggggacggcggcggggacgaggcggtgccggcggtgttcatctgcccgatctcgctcgagcccatggtggatccggtgacgctgtgcaccgggcagacgtacgagagcgccaacatctcgcggtggctcgccctcggccaccggacgtgccccaccacgatgcaggagctctgggacgtcacgcccatccccaacaccacgctccggcagctcatcgccgcctggttctcccgccgctacacccgcttcaagaagcgctccgccgacttccacggccgggccgccgagctcgtccacgcgctccgcggcacggccgtcccgaagaggcagcccctcaagggtcaggccagggtagccgcgctccgggagctgcggtccctcgccgccgcccaccagtccgtgaccaaggccatcgccgaggccggcggcgtcgggctgttgacctccctcctcggccccttcacgtcacacgccgtggggtccgaggcggtcgccattcttgtgagcggcgtgccgctcgacgccgacgccaaggccgcattgatgcagccggcgaaggtgtcgctcttggtggacatgctcaatgagggtgcggtggacaccaagatcaactgcgtccgcctcatccgcatactcatggaggagaaaggcttccggccggacacagtagccagcctgagcctgctagttggagtcatgcgcctcgttcgagacaagcggcatccggacggcgtcgctgcggggcttgagctgctcaattcgatatgcgcagtgcacaagcctgcaagaagtttgattgttagcatcggtgcggttccgcaactagtagaattgctgccagagctgccaacggagtgtgtagagccagccttggatatcttggatgcgcttgccgcagtcccggagggtcggatagcgctgaaggattgccccaggacgataaccaatgctgtgagattgttgatgagggtttcagaagcatgcacacggcgagctttgtcaatgctgtgggtggtgtgtaggatggcgcctgaagaatgcgcgccggctgctctagatgccgggcttggggccaagcttctcttggtcatacagagtgggtgcggaccagagctgaaacagcaagcgtccgaactgctcaagctgtgcaccatgaattgcacatcgacggtattcatctccaagtgcaagcttacgaagacaatccagtgagtggagtttggaattgtgctgttccgcttgtgatttggtcgatggtgaatggttcacctgttgggtctcacataatctgaagaaatggcagcaattagcaattggcagtcgacagcgtctatgtatagataaactttgcagttatgcagaatttgccatgtcatctgatggcataagggtggatgatatgagtagattgtgagacctgtggccatgttatcactgtccagcgagatgatgcgtatcgcagcattcaaaatgcagcatacacacagctaattcagtggcaagcaggtgggatgtacatgcaaattgatgaggattttggtcagctcaataagcactcgaggctgggaggtggtaagtacagccagttttgccattggtagtagaaaaattaagcaagaaacctgctgttttagattttcggcaatgtgggtctttcagggctgtagatgttcttcctttttctcatcttcggtgtaattgatggtataaactgggtagaattgtatacagtactgttgcttcataattgaaatacacattgccataggccatatcttggaaaaaattggaactctttgctgcatctttcattgctttgatcatccagtaaatttttcaaggataacctttgtcctgtagcatatactgaaaagcttcaggcggcgttcctggtgctgaaattgaaacagtagaaagacgaagtccagtgtcagcttgtgctggtgccacaagtactactgtaattaacaagtatagtatcagatggcccagtttgaatctagagagcataatcagtcaagcaattgtagtcttcttgtagatttagccgcacactatccttaaaaagggagaaaacagattatttggtttaagttcttttctgatgattcagcaaatagtcgagaattgccagtcaaggttgacaacaacaccaaacattcattttcctggattgcatctactagtactctcactggaaaagcgggtctttgtatatttcacatcagggggctgtcttatctaatctcagggaaaaaaaaccttggtcatcagcaaggacagataaagccatggcaacgcctagcatagggtcactcatctatgatcaggagtaggctatgctcagtactttttccctttatacgttgccaatcgtaaagcagatgatgggtgctggtgccgcacaattgacctgtggaatggaagcaggatgaggaagtgagcgcaccatgcatgccatgcctcgtcagtctcctgcttttgccatgatccgcgacgtgacgtaccgccctccatgcaccgcgccggcgcgcgcacgcacaaacgccacaaacccacccgtcgtccgtccccatttccacacgccattctccggtctcgcctcgcgagaaaaaggtggactcgcgggccagcccaaaccatgtggcgtgggcacccccacctctcctctcctcgcctccgcgcagtcgaacgcgaggtgaggtgatcgcctgcccaaaggctggatcgggagcgagcaggaccacgggcatgcgcgcctgcctcctcccgttgatggatggacgacgactactcactgattgggtggcgctactgtgccgagcacaactcgtacacgggagcgccaggattgtggtagtgctggtgcctgtgtacgcgtactctactcggacggacactggagtgagtgatcgagtcagctgctgctgctgctgcatgcatatgtgtgcgcgtacattttgcctgggggcagaggtcgccgggaacgaacgctgcaatctattcacaggacgtggcatgcattcgccacgacgcgagaggggggcccatggtcgatcggctgtacagtacgctgcactgcggtgctgcagccccgtcactaacggctgatcgatcgatgctagtagtagctccatgtgcaatgaatgctggtgaggtgttatctgaaggaaaattttctgccggcttggcccggcttgttcgctcgctcgctcactcggagctgaaggaaagaacacatggacgcagagggaagatgttggttttgaaatttccggcatcgtcgtcagttccccctgccccgccatctccgttcgccggtagagatcacatgagctcctacccccgaaccagataacctcgttgtgagcttgtcgattatttttagacagacaggcttcgaactttcaactttcaagcgcaagctgccgctaggatggagggtgcaccgtgcacgtcattgtcagcttgaacctcatcagggattttgtctgatactcttaaaagtagagcgtacgtgcgtatggtcatggtcacgtcaagagaggagtatagaggagacggatccctcgtgccatcgaccagagaccgatcaagccatcgaccgatcgatcagagggaaaacctgataagcgcgtgggcggcagatgcgaaatcattggcgttcccctgtgggcgtggactttggtctgatggatcggctctccccctgcaacgcttcctctttcgcttatacacgccgatgcatgcatatgccgatcgagctgtccctcactcactcactcactgatgggcaattctgggctcttgccgcgcgcatctggtgatcgatccgcgtcgcgtgctgctgctgctgctgctacagccttttcgtgatgtttgtacgcagcggccatttactccgggtctccggccgtccggcgatggcattggttggtgtacactcctaccctggtggtagggctggtagcagcagcgggtcatctttcagtcactgtgcggtgggccctgcacgacagaggggacgaggtgggggcgagtggctggttgcccccaagcggcagcggcagcggcagcggggcatggggtggtttcattgacctccagagtggcaatcgatcgaacgagacgagtgaagcttttgctgccagtttggcgtccggatcacggccagtatgcgtccgtcccaagtggcctcacctgaccggcaaaactgatcacatcacgcgacgtaggcatgcaagcatatcccctcagcttttttcagctctcgtgtccaggactccggacgcccgctgtttcagccaaaacagcaccaacgcgtttaattttaccctgttcatggtttgacacgcagaacggctaactttaaaacttataaagtgctggttagttaagggttaggggagcaacgtgttgcatgcattgtgaaatagatggccttgctagatatgccagtactactagcttgtcacttgtggacgtgtgacccaccggcgtgaggcaggccggcggggttaggggagcggcacgcgcagcaccggtgaaagtgaaacaccttctgtacgtgcatgcatggctgcctttctgttttctctgctcccggcttcaccgtggggcctgtaaactgtgccctctcgtagtctaaggagacagggctggtcaatcaagcaaactacacattatcaaagcgaaagcgatcatcccatgcaaaggacagcaaggccgagacatactatgcacagtgcacagtcacacacagccagtggaatctagatttacatcatcaaaattactagcagtgcttgttactgccatcatgaagtgtaaaaccatccaggccggcagtctgtcggatcgggcgacgaaatgtatgaaatgcacagtactagtagtagaatttttggcaataagtttcgtgccattgaatgcttacagtcctttgaatttcctaggctgccttcaccataactgttgtctagttccagatcgctccccctgccgccgcagaacctacgccgtaatgtttgcattcagaaattatgaaaagacttaattaacctaggtaggagtcaatttaagatagagtgagaatgcaacctgttaaatgtatacacctgagactctgaggaggggaaattacaagaagctccacatcgcaaagcctctcttagtatcccactataaaccaaagggtcatacaacagaatgagaaggaactggactaaaagctcatgtaattcaagatatatcggcaagggtcaaggactcgtggtttgtaattccctcttccctcttctaagcaaatcatggactcatggttgcttcattgtcccagtaattcctcaactgcgacatgtggaggagcagcccatctcggcctaatccagtaacgctactcgtcatgatccatggaggaggctctgggtacagggaactgatcgtctcctggaactctttgatgttctcctctggccggccccctttacctttcttggatttatcacactttgtgaacacataggtcaatccaatctgaaatagtacccaaacaacagaagtcagactgcaacaatatagttggagaacatgaaagatatgttattagatatcagtacatggcatagactgtcttatgttgccttacattgttacggccaagccaattggcacagtctatgtcaattttctgaggcggaatactggcatcaacaaggagcagtacgccaaccaaggtatctctgttcaagaagtaacccttggtaaatgaagaccaatctgttcgagcagattgagatgcagccgcaaacctacatttgtgaacagatttgattatcaccaggcgccaaatgagttccaacagtatgctggggttgtgtcccaatgggaatggaaaagcaacagtagttgacttataaagtttatttcgtacagaatgtgctcactgttacaatgtcagatactggcatgcagaaacagaaactacagccgaatagaagggaataattgaatctatgccatctaaagatcaccacttcagaaatatataaaactgaactgactaggttcactaatatgatcaaaagatcacagttcaagtttctaacactccgcctagtttcataagccttttcctcctcattaagtggtaatgaagtgaacaacatcgattcaatggtataccctggtggcatatacacaattgcctacttctaacatagtattttcaagtgaaaatttgctaccggacactcaaagtttgcgctctttgctactggacacccaaagaacgtgtatttgctgcaggacaccgtgggaatatggtgacactggccgtattattttattatatctgatccaaatggagagagaaattttcaaaaaaaaaacaagtttacccatacgacatatttctttttaactcgaccaggtctagtttgaatcagacctacaccatcagagtgagaatggactgtatcgagggagtgaaaatggactgggtctggttctaaccagaccgagttgtcttacaagccgatgaacacaagggcaaaattgtacttctcgctctgtttctctccatttgcaatgccatctatgattttgtcattgtgatacatcctagaaagtagcacatgcaaatcaagttacatatgaattgagggtagaaaaggtcaacatacccgtaaccaggcaaatccacaaggtaccaacttttgttaaccaagaaatgattaatcgtctgggtcttccctatgaaagcataagatattccatgtaacaacagaagtacacatttcaacaaaatgcagaagataacaacatgttggttttgtaatgccaaactacattatctgaattcgtgtgcaattacgcagctaaatgcattatatacatcattatatacaattacatttcttatacacctaaaataaccctaatatctctcactagtctacaattctacagtttcaaccatccaaaaccaattgtgtgcatataccttttctccagcaatttacatggtattttttaaccaacttttgttaaccaagagccaatatattcatgaagtttgatatgaaaataacatagagttagatggagcaaatcataaaacaaaggaatcagttcagttctgaaggttggcattttgttaagagttaagcaacgaataggatagaaagataaacaagttgaaaaaaccatgtattcggttctgaagggtgcacaaataccaaactcgtcctccataaaactgcataatcaatagatttataaggtttgcagcaatatcaaagttccccatcaaaaccggagcagtagcgtagcaccgtaagctaaattaatttcttctgttgctttaagcactgagctaacttcagctcccgaattgcgagcaaacgaatgtgtttgcagtctaggacatcgcactgacggttgacgctaccacagtcctaaactcacttgggagttgggagtctacctcagagctaaactagaaattgcatcatcaaacagatatgcagaaacagataaaagcttaaccctcaccaggctttttggaggtgagcgaggcttcctaaaggcggataagggcgttgatgagcgaggacttgccgacgttggagcgccccagcacggcgaactcggggcggtcgtccttggggcagtcccgcgcgcgcgcgctgctcttgacgaactccgcctccttcacccgcgagtcccccgcgtagggccctaccacgatgttcgacgccggtatcaccatctccgccgccaccgccgcgtcccgatccacccccggcgggaagaacagcgcggggttcacggacgaacccctgggagccggcggcggtggcgcgctcttcctcccgcccttgagcccggttcgctgcgccggcggcggcgcatcgccggcggacgcggtcctcgccgctccggccggcgaggagagcgtgcgacggacggggagcaaggcgcggggtggtggtgggacggggcccggcgcgacggctcgaaggagggagaggcgtggccggagtagcatagcaaccgcagccgcgcgcgcggcgaaaaggtgccgaatgcccgaatggggcgcggcgcgggtggctcacgcggccgtcgagtcctcgtcgtccctgtgtcgcgacctgcgcgaggccgtccgccaacatatgggcctattaggcccagagcatttattcggtaaaaccagagcccgttataatcacagactaggcccaatagactgcaaaagtggcccaaaacaactgtgcaaaagtgggttttgtacactactgaaaactgataaaaaaaacgcgaatatcaggaaggtatgggaggagactaccgcccggacgtccgatgcaacgcaaaatatcggacactacccgagtcctacgtcagcaagctgatcacataactgctacatgatgatactacatgcatgcattgattaacacatactagtagcgtttgagatgatttattttccaaaccatttatcttattgtcattctgattatatggttgtattcattgtaattaaatctttacaacaatatctcacaaggttatattttaattgaaaaattatatatgtttcaatcgttaagatttaatgtttcacgtgttaaaaataaaaatgtttcatctagaatttgattatgttgtacattttaagttttttatccattagatgttgttttactgttgcacacgggatcaataaatatattatgatgtttcattatttatttgtgaatgttgcacatcatattatttgaatgtttcatcaagtatattgtgtgcaacagttacaaagaattagtgaaacataagaaaatatctattaaaacatctaaataatactaaataatactatgagcaacattttgttgcaacagtaaacttaaaatttattacaaagtaaaattccatttgaaacgtttatttctcatacatgaaaaatctaattgcaccggctaaaaaacacacacatatatataattttttcatcagaaatataatcatatgagatcttattatagtgatcttgctagaacatagaaaacaccacatgcaacattacaaataactatgtgaaacatcaaccaatatttattgaaacattctaataacaccgtgtacaacactaaaaagagtcagaaaaaagtcatcagaatacaatgatgtgagatattgttccgaagatttaattataacaaatccaactacataatttattcatagtttggataaatagttggagaaaaaaatttgaattctcaaccattatgagctgttttcctaaatttgattgcatgcacgaatgcacttacaccaactgatgtgaatgttcgatttcttccttccttctgcccggacggctgatgtgaagcattttccgaaggtatgaggtttcgaacttaattcgtctagcccaccaccttatggagctagccggaagacccaataatatttctctactaaaaactgctgattgcaatcagattattactgaggaattatgttagttttagtctctacctaaaaagaaaaggttacggagtagttttactctttgacgagattaaatgtcgttgatattttgtggagatggcacaaggctccgttggtggcatcgtcgtttctgttgctggtcattgacaatctcgcatcgtcaatactgtacctgcgaatgtcctgaaggattccatatttccattagaatcagtcacttggaagttgggaagttcacttctatggggcgtgctaccgcgtcattattgatactcgatgagaaaacaagcagcagctttatttcccggcgcttaatgacaataaccgaccaaataaacgatccaacagatcgaactgcgattatagtaaatagtttgtactccctccgttcaaaaaaaaaataaataaataatataatatattctagcataacgaatttggatacatctaggatgtgtcatggagcggagggagtatactagatgtaaaaggtagatcgctgacaatgcaaattaaatattagcaagcatactacgacgaccaggcgtacataatagaagaaccagttgtatatttgccccccaaaaaaacgaacatgaggaaaatgaaatgtgtgaaaggttttattgacccaagacctaataactggtatggactcagcaaattctagttctttgcagcgaaccttctattggtttatagttgtggcatacaatttaaaatgttaattgcgtataacagcagattcttgagaatctaagaataccttaagcagcatgtactagtgtttgaactgttctaaagtactccagttaggtcacattttgttaaaccaatgagttataaaaaggagttgaacgcatactctataaaaaaaacacgaatattaggaaggatctaatattaaataattagaaagggtgaggcttggaattcagatcgtctagcccaccacttgtatagctagccggaagatccctgggcgtttctcacacgcatactctataacaaaattgactctatgcaaagccctctgcagctctactagctgcaagttgcgacttgacagataggagtgggagaagaattgaagaaagtagcaacaaccttacaaccccagtgaggatgcgactatgtaactaatggagtataatcatgagctagtttcagcgttgactatgtacgttggcaactatcccgtcagattcaacagctccgatcgttttatttgctgtttggtctagtacagttattaggcagaatacaatacgccgatttttttttcagaaaaatgatgatactaacaacaaagataagtgaagtcaactgcttataataattggctggtagaccgggtgcctaaattaatttgactgcatggctgacgattccatctaggagcccaatacgtcaagttggtcaaccggcctaactgtccgcgcgcaatgctaactgtgcgttcagatgtattgagaagcaatagtatgtctggtggtgtgcgctgcgagcaataggacgactgcatgaatgcttgccaatgaatgaaacatccttccattttttgttctacaacagctgaaataaagtttccaagcatcatctttggggattcgacaccatcgtaacgctagtaatctgaacaatttggagggagcgaaataatagggttttcaatctcgaagaaaaggtagctgggtcaaggtagcaaaagggatggtctaggaggtagcgtcatggtgtgcggctaatatggtgatatggactatcaataattagtttgcagggagttctttttatcgtggtagacagtcaatatcgtgataataggcttatgttcatttgccggttccagtttccgtctccttctgttttttgatttggggctcttggtctgtaaataatctttatttctctttatgaaaaaagtgtgctccttgcgtattccctaaaaaggcaagcaatggtatgcagaaaattatccactttgctgaaatctttaaatgcatgccactacatctaaaactgttagtttgtcaaattattcttctggttccaccggccggcatgccaaatcaaaaatcatacacataactcgtccactttggcccaagaaagattcgatagatattagaaactgtaattttattatagctgaggcaagatggatacataagttcagtatctacagtgcttacatcccaaagttccatgtactatctgaaggtgatggccggaagtcgagaatggatatacgggctgaagaacaaggagcgagaaatgtacagatagtccactacaaagttggtacaatccactccccgcaaaaaaaaaaagggggggggggggggggtggtacaatccacagaaatgaactgcagaagatcgatatccgtttgcctcatcaagccttttttttttgcttgtttgaacgcaggaattcacagaagatcttgtagaaactgtgcgtcagagctagttcattcctccaagaatcgtggaaaattcccgtgttccaaactaccctgggcagaaacttgtgccaaagagcactggtgcatatatttgcacagctactgtgctacactagttgtgattcccttgggtgtagatgtagtcggtgtgagcaactagtgtcctcctcatcaggcactcttcctctgcttcccctcccttgcactccactgcctgatcaggttctccctgatgcatttccacaccgattccagaactaccaacactcttctgatgggcaatactggaggcaacaacaccctagaaacaccaagaagaacgcggttagatagccagcaccgatagccaaactgctcagattggaagcaaaatgcaaatactgtgtagagttcgaccaggttatgcattacatggtgactgtacctgtgatttgtggccactggatcccggttcaggccttgctgcttggctcctcgtgcagatgaggcagagcagaattgccgtcaagaagagagcagacagtttggagctggatgccatgcctcgccctttttctctgagctctccctctctgggaagttcagggatgagggatcacaggctaattattgggtgatctacaagcttaaccaagtgctttatatagggtgaagaagaagagcgaggctgatatgccaagacaccacatgaaggacagcaatgtgccgtcgccgctaggtctactccgctgttcgcgttcacatgtggagtgtttatctgacgcggacgcgcgtgtggacgtgccagacgctcatggctctgcatgcaccgtgtcaccccctgtgcgtggatgcatatgctgccagattcaggggcatacggttgctcgtgttactgtgtcgatccatgttttctagtagtgtacagtatgtgcctagactatacggtgcccggtgtcctcccagtcacatgctccttcggttttcacgcctccccgcttccaaggaatccaacggatggttgaatcgcaatgtcaatggattacatgtacattaatcgataattatttttaaataatttaacagatttaatacagtataattctgataatttttacataactttcaaaaatcctcagtaatataaacctaaacgataattatatacgatttttaaaatatcatataccaatgacaataaagagaagagacagtggacggctgtagaagagtataatgataacatttgacggaacttatagaaattataaaaacaaaacccaacgggacaataaattataaaaactatgagatccaatttttaagagagaatctcttatatgccactgaaaattggcccgatctcttatatgccactgaaaatttgctcttcccctatatgccattggaccaaatttgcacactggatttttcacattttggtccttttgaaaaacttatttcgcaaatagacccctagaaaaacttatccaaaaatggtccttttggg

SEQ ID NO: 30126 - DNA, 1025 bp, Oryza sativa
tctggcgccgtccccctgccgacgtggcggggcgatgctgaggtggctagggggagtgcgccagagtggctgccccctcccccgaatttttttatttttgttttatttgtttgatatttttttcacgcttagagacacacaagaaccaaccatagaaaaattgaactcaaatggacgtaatatgtgacctgtaaaatttttcctctcctctcctctcctctcctctctctccgaactagtgcagaggagagatgtgcaacttttttatttttattttatttttttgatatttttttcacacttaggaactcacagaaaccaaccatgtaaaaaataaactcaaacggacgaaatatgtggcatgtggaattttccaaagctccaccgaaaaacttctctcctcgaaaacacaatcttgcaagcggaatttggaggttttaatatcgccgaacccggcgaagcgaggagaatcggatgtaactttttctgtagatgtccgtgcatatattatttgcctgattccgagtccgtaagataaagttacgcctgttttaatagatgacatattttgtccgtttcgatagagttttggaaaattctacatgtcacatattttgtccgtttgagtttattttttatacggttagtttctatgttctcctaagtgtgaaaaaaatatcaaaaaatgaaataaaaataaaaaaaaatgcatctctatatactgtttaacttatatatgtcatttcatgtggttatattttgaattagattaagtaatttcatatagtggtagagtgcattatgtttaacatgctgatcaaagggttttacttaaggagttatggtctaattttagtgaaggtgcaaagtaaactaagtggtatgctagctattttcagatttagctaagtgatagttcgagtttaaattttttttgtggttggttgtatcgtgatcctgagtgtgaaaaaacatccgacaaaataaaataaaaatgacgccgttgcaactccatacagaaaaat

SEQ ID NO: 30127 - DNA, 586 bp, Oryza sativa
catgtctactttgactttggattcgctttacactaaactaaaaactcatgagatgaatattctttctcttaaaggtgattctaagtctagtgctttggtttcgtctacaacttctttggatgttggtgcttcttcatcgaagtcttctgttcttgctttatttaatgccatgtccgatgatcaactcgaacagttcgaggaggaggacttggttttggttgctaacaaagtttttcgagctatgaatagtgtcaggaacaggaaaagaggcggtcctaaacgttgcttttagtgtggtgcacttgatcatcttcgttcacattgtcctaagcttgggagaggcaagaaggaataaaatagtagagtcaaagaggttgaagtggacaagaagaagaacacgaatgagaagaagaagaattgcatgcagtggttaatctaagaactcatagcagcttttgatgaatcggaaaatgaagacgagagcaaaggtaagcaaggtggtgatctagcttttattgctcgaatgcaagttctgatgtgatgaatctgataggatagtgaagaaaagtttagttatgatcaatta

SEQ ID NO: 30128 - DNA, 27113 bp, Oryza sativa
tttagacttgcccacaaacaaaaaaagaaaagagaaattgcttttgcaaaacgacggtggtgaaaatcgagttttaattcgaggagcacggttagaccgacattgtccagtcggttagaccggttgcctggcccggtcagaccgcaagtacagcggcggtcagaccggcctcggggcaattttgcgcgaaattcaaatcagacttttatgaagcgaaaaggtaatttttcagataagtctgattctgattttgtttgtgcatatgtacctcatggttttatcaagcaaaaatatgacaatgagaaaaaattaagaaaaaaagagctttcttctatacatatggtgttttcttgtgcatgctagcaatactttgaagggttatttgtctctagcatagtttgtatgtattctagtcttttcatgatatttagattttgcttttaagggagatgatacatgatacttaaattctatacttgaattaagcaaatatgcaatgttgatgctagcatatagtttgatctctctctctctatatatatatatattctttattgaattgttattcctcatatagctttaattgctcattgtgaaaagagaagaaaaatatgaaaaaaaaaagaataccgaatccttgaaacaatcttgacgacaaggacgtattcgatgtgagcaaaataatgggtgccgaatctctggaaacaatcttgatgacagggacgtgcccggaataaaagagaaaaatatgagcaaaaaggctcaagaaaaagaaaaagtaaaaattctcttgtttgttttgtgctgaaagctaatttgagaaagagtgataaatgcaataggtatatgtgtttagtgtttatttttcaacctatgtgcttgttaagatgttgcattttaaattgtatgaaatcatgaattttgattattgattcaagtttaattgtaaaatctttggttcatgattatactttaatgcatgcttgctatattatagattagttcatcttctttttattgcaacacatgacatgatatgatatatgtatactaagctcttatacattaatgaacataatttctatgcttgatgaaatcattgtcaaaggggggaaaagtaaggtgaaaattttttggagtagcaaatgagttgagaagaggcatgttgtttttggttcgattggaaatttctttcttttcaaaagtgagagaagttttcttttggattttttagcacgatgtgtacatttgtacaaagtgtgctttttaccacttttgtttttattttttcaaacaccaaaacatttttaatgggtttgccaatatgttcatcaagggggagattgtaaatcaaaggtgtttttgattgttattctgtgatgaacaattggcattagcgtttattggcttcgatatttggaatttatttacgaagttgttttggagacgattgcatttcacaggtgatctgctatgctttgggtccggtcagaccgggcagtgtgtgccggtcggaccggtgatgattgagcggtcagaccggccagcccgcggtctgaccggccgacgctgtgtcagtttcggttttgggttgtttgtttggatatccgtgattgtttcatggttatggcttctagatggataatatgcgtatctaatactgttgtttgctactaatgagttgtcacatcctgattttcgtttcaggatttataaattatctaataaattattaatagaatttatattaaatgttctttaatttacaagtgaagttaaatgtgggaaataaaatttcctaaatttaaagcatggatggatttaattctcattaaattctccatagttaattatactctctgaaattttctcggatttttcggagctcaattcctaaatgatacaaagaacaggtcagtaattatttaatcattaatgatctaattataattatgttaagtgcttttcttgtttaaaaatccttaatttataaattgttgtcgaaaagggaattattagaaatgatcttaaaagcctagaagagaagatctaattttaattaataaatcccaatataaaatggggccagataaaatttcgttaaatactttgcttgattctatagttcctagattttttctgggatttatttgagccaaggaagtatttttaataaatgaaattgcatttcatgaataattataattgaaaaaggttttaaaatcctcttttggctttgggccgaaagtcggcccaaaaccctctctctctcctcctcggcccaagccggcccagtcaagccgagcagccgctctcctctctctctctcccgctgacaggtgggccccacctgtcggactcgtcgtcctcctcgcgccgtcgcccagccgtgccctagccgagtcgcgccgccgtctccttccaaatccggccgcccctttccgtttccgatgaaattaattgaggggaaatgtttcccgggatcccctctatcttttctcttatggaatcgtcggctaatttcgtttggaaatccatagattcgagttcgattcggatcgatctctcttctccgaaccctaatctttccttctcgtcgccggtcgccgtgggccttcgccgccgcctccttgcccctttaaaaggacccccaagtccgccgctacctgccgccaccctcgccttcgtctctcgccgtcgatagcgccctagcaccgtgtagcctcgcgccgccgtcgtcgccgccgctccagccgtgcgtcgccgtcgctccagtcgtcgtcgtcgctcgggaaggccgccgtcgtggtcgccgtcgcgtcgccgtcctcgtccgcccctccgccgtcgctgtcgaccgccggaacaccgccgtcgtcgtcaagccgatcatcgccgccgctcttcctcgacgccgtcgccgtccgttgatcttccgccgttgttttggtcaccggtgagttcgccgcgtcgccctctacgtgttggtgtcctccgttcgcgctgtcgtgccgtcgttcaccggcgagcacgcgaggccgagccgtcgccggtgatgacgtcatcgccgacgtcgtcgtcgtcgtctctcgtggtccggccgtggaccgatcgatctcggcccgttcgtttggatggaaagatctcggccgttagtttccgtgagccgccgccgtgcacccggtccaccgtgaacccgagccgctgacgcaataaacccccttttccttttcaaaaataattcattattgcgtcataattcaattaaaacccatataattgatttaatctgatttatctttgaaaattcataaataattcatcttagctcggatttagttggttcaagtctctaaatttttctaaaattgagatctacatgttaaaaatatccacatgtactgttcatgcttgtttatgtgttgttttggtgttttgctcctttctgtttagattccgacgtttccggagagttcgttttcgcaggaaaagaatttgaagagttccaaggccagcaaggcaagtcacacagatcctaaacacaatcctttgagcatgttgatcctatatttaaattctctatttatttcaattgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcatagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgattttcggttgtgaaacattaaccgtgccaaccacaagccagcgtgggcaacggctttaccttttgtatagcatggttcattgcggagcaccagactgagaagtggcggagataagcccacgggggtcgctgttgatagctttgtatagcatcgttaccagactgtttggatagctttagatttgtttttggtaatagctgtcgtaattaggcatatttatggttttccttttcattttaagagataaatctctagccgatcaagtcgtgttcgaatgggacttagttaggtcgagggtatcagtataagtgcctgcaaagtcaacatgaaaattaaagtttttggttggctgtttctcatggacagagtgaatactagagacttgttggatagaaaacattgtgctctcttgagcgcatcgatttcttgttcgttgtgccaggagaatgcaagagaaaccagggagcatctgttctttgattgcgccttcagtaaagggtgttggaataggctgggatggtgttggaacacgtcattggagtttaatcaaatgctacactcccagcgctcctctttctcccatcatggtttcatggaattgttccttctggctgcttggaacatctgaaaggagagaaacggtctgatctttcaagggattcagccctctattacaagttgtttggccaatctcaagtcggatctgagcctacatttaattaggttcagggaaagtgatcgccccttagtgcaatcatggattggtcatttgtaatcttctttcttcttttctttccctcttgttcctttgttttcttctctctgtaaatttttttggttattaatttaaatcataccgtgggggcctccctcactgtttttttttttgttcaaaaaaaatataagtgcctacaatcattatgacgatatcaacagtttaatatacaactctcagtgcatcgttaccttttacttttgatgagttcttattttcaagcggggttgcattggttcgatctccagtgagaaagtaagttctatcaacttcgtttgtataggcttagttaggacttaattggttgagtacgatattctaattaaattactacaaacgttccttatctgttatatcggctctttccttcattgcattgctttttgggtagatttgatatatctattactttgcatagaatctatcagtttgattaagtctacttattttatcaatcccatgttgtgtcagcttggtccgacatattagattgtagataattaagtaaatttcattaagatttataggttctaaccaaggtttcattggagttctagccgataagttatcttatttcaatttctgagtattacatcggcttatacttaatctaatacattcattatctactctacttatctatctacttacacctaagttgttctgtaatttttagtatcattaaaattttttatttctatgcgaaataactgaagagagtagaagagaaaattgtggttgggaagattatactagtagcaaaaagccagtcctaactaaatcaacacacaattacctcaaccttctaccatccatcatatcaggcaagtcgaggagattcagccttatctatagataaggctaatcccttttttcttccttcaatattttagttttaatcagttcatgaaaaaaattatactattaatttattcttatccataatggatttatttgggccaatacaagaaattcttgtgctattcggggatttattcttcgccaatcagtatcatgtcaagattcatcaaaataattttgaagaagaggaacaaacattgtcttcaacaacactcatccacttattgacattaatacatatgaatcttcattaaaagggccccaaaaaaatctttttgctaatgattaatttcttctgaaacctagaacgaatccacttctataggaagatggaacattttggggtaatgtaccctgcttttcaaaaaaaaacatataggtcttgttcgtttccactgcaaggagtggatgaaattttggatttttgtggcatgtttttcaaactgccaaacggtgtgtttcgtgcaaaaaaaaactttatatatgaaaattgttctaaaatatcatattaatccatttttcaagtttgtgataattaaaacttaattgatcatacgttattaccacttcattttatatgaaacacttaatcttcatcttcatcttcaggagattcaaacaccaccatagttcgctatctgagcctgcccacttgctagttaggaaaaataattgtttcgttccgtgggcttctttcactgctatcttaacgctcgctttacgagtgcaaccaacgaaaaattccaggattgctttagtattgactcaccatacacatcttctacctcatcactgtcaatggtgtagctgatgtgtcatgctaggtatctcttattggccattttttatttctagctggtagaggtatttccaaagttcatcctttatttagctcaacatgccctttatgctagttaattgttcacattgttactatcaaagagcctaatagagaagaaagagtagcttttgtagagctgggaaaatgtgccgaagagagtggtttatgcttccgggcttacagaccttgctaacttcatttggtagtatagttgtgaatttttgaactttttttgctttgcccaatagaggatcagtaactgtgtccaagtccatattcaacatccaataccatttcaagtattggagccacttctgcatttgattccaagcctatcaatggataaatggaatgagtcgtgtcaaggcaacggagtggttcacggctactgtttccgtggcgaatttgattttttagctttaaccaagtatgtagaaaaatgcaataacatttctaatatcaaaatatattcaatgctaaattttatgaaactaatttagtgttatatatgtgattaatttgaactttgacttaaaaaagtcaaacaactcccaccattttttaatttatgttgtcgttggctttttttaaaatacgtttaaccattcgttttattcagaaaatttatgtaactatcatttatcttattatgacttgatttatcaacaaatgattttgaccatgacttaatatttttatatattcacgaaaattttgaataagacgactagtcaaatatttgccaaaaagttcacagcgtcatatattaaaaaggatgtagcataagtcttgtagtaattactatgtaattatattttaattatattatagttctattttaaaatttttaaataaaatactatcaaattttgtatagttactcattaatttgttacatactggatttccaggattagctcacaactaagcctcctatcgatttgaggaactttacggaaaatattacgaaatttgagctaattcctgtaaaaaaaaaacgtgttgttggtcatccagagttggacagacagcgccttccttatcctaagcacacaccatccaaaacctcctccacgctctatctctccatggctgccgccgccgcttcgctgctccacctcgccacctccgcctgctccccgccgcgcgtcaggctcgtcggccccaccaccggccggagatcgccgctgcgcgcggctccggcgccgccgccgccgcgggcgtacaaggtgacgatcgagcacggcggcgagtcgcgggtggtggaggtggaggagggcgagaccatcctgtcgcgggcgctcgacgagggcatcgacgtgccgcacgactgcaagctcggcgtgtgcatgacgtgcccggcgcgcctcgtcgccggcgaggtggaccagagcgacggcatgctcagcgacgacgtcgtggcgcagggctacgcgctgctctgcgcctcctacccgcgctccgactgcaccatccgcgtcatccccgaggacgagctgctcaaggtccagctcgccaccgccgacgactgaggcacatcgcgcgcccgccgccgccgccgtcgccggcgtgtgtgtcatctccggctagcttgtacaacttttttcccctcaagtggtatttcccgagatatttgtgacaattgctcctttgcctagctagttgtttcagttgtgataatgtagtatctactatttttgttttaagcattatgtaggatacatagtattatttctatctttttcatattctaagagacgaactacaaaagggtaatgtacaaaaatttggggagctcagcatgtctggaagcacgggagaacgttcttttgctgatattattaccagtattcgatactgggttattcatagcattactataccttccctattcattgcgggttggttatttgtcagtacgggtttagcttatgacgtgtttggaagtcctcggccaaacgagtatttcacagaaagccgacaaggaattccgttaataaccgaccgttttgattctttagaacaactcgatgaatttagtagatccttttaggaggccctcaatgaccatagatcgaacctatcctatttttacagtgcgatggctggctgttcacggactagctgtacctactgtttttttcttgggatcaatatcagcaatgcagttcatccaacgataaaccaaattccccaattaagaagcaaaacattttaacttggagatatattttagtgcaatccagtaacatatagagctatattacagcatggagcagttcattcagtataaagctccgaatttattcatggggatatcatggacatgttcctaacaacatgcagtttgcgtctccatgtttgctagcccacgcccaatgcctgaaaccaaacatcatgtcatccatactgattttggtacattagataatcttgtaatgcgtatcatttttaagaactaaagaagaaagagttgaacagaataatgaaatgtgatgtgtgctatagaagctctcagctggaaagagttgaacgggataacgaaatgtgatgtgctatagaagctctcagctggatttctaacatcagatatgatatgtaactactaccagaacatgaaaatggtgttgcagagcactgatgttacttacacgactgttacagcaagcaaatcatgctccgcaattacatatcgcctgtgcctgagcttgtaacttctaggccattgcctgtaacaggacaaaactgtataagcaatcgtagagttatgtttgtcacacgaaagcattacataaagatgttatcaattttaattcaagttttgtttcacagctcagaactcagaattgctatcttgagtcacagtcaggaaggtgactacttttttgatacaataggaaggtgagtgggtgactatttgcagtccataaacttctgcattcagtcatgcagaaatgactagtgaaaacacgcatgacaagagctattgagctaataccggtaaagcctttggataagacatgagtcacacaccactaaaccagtcgcatttttgcaagttgaaggagaacaaataggagcaaacatttggacgattggtgtcacatgcacaagctattggcttgctagtatgccactctgtttcaagcttacagtatcagctagttgtactggagatcagcacatcgccagacagagcaagcacttctatcattagaatatacttgctacattcacatggagaaaatggcaccaggaaactttctacagaagtagtcagggttatgaaatacttttagcaaatcgtagatttccacagaattcttgtaagaaatacatgatatgatagcattctttgaaattacagaaaataatctaacactagttagaaggcaatgccaaccagatactgactaaaacaagtgaatttctgtcttgagcttatcttaaatcattagacagattgctatctattggtggtttttaagcaaactctggtacattgtgggaactaataccagtgaattttcagaatctattccaaagagtgtgtactactttaatgactaatgacaacagatatctagtgacattgtccttgattactacaagctgcttaaaaagagagacagaaaagcaattacagaatatcttactacactatgatcaatttgattacaaccaacaagcatcaacaatgaatagataggcatatgccgcagagaacaaatgtgtaatttaacaaatcctaaaaatcatggcataataagatagtatagctaatatcactgaacttctctattagaagcagcccgtaaaacataccaaatcgcaataaaattctgcattttgactgcacatcatcatagggatgttatctgtaatggactagtaaaccctacacggtcctccatcagaattcagaactatgctgcatattaagcaacaatagaatttcaatatatattacgatttttacccccagaaacaccacatatcagccttttgtagcttctattgctgtaatgccaagaataacttcttatcaagttttattttctgacacgttgtttaatttcgatacacctggaaaacgctagtgaatttatactagaaactatatgatcgaaatgataaattgcatacagacttacgagatggtagctgccagaactagaactctggcattatgcaggcaaacaagcgacactcaaatgcaacagacacgtgattggaggcaacattctaggaccttcattgacagaatagtatcggatttctataccagaaaagcctaaacatggcactgtgattccactgatactcacaataattctgtttcggaacatctaggagagccacataattgtattcccaatttccatcaagaaccccaagtctaatcatagcacaaacaaacaaacgcaaggttgaaaattgtgaggatcccaagttgcttactccaactaagatacgcaacagagctacctaccacagagctgcaacaggtaaccagaatgtcccaatttctcatcattgcaagcacaaatgccaatcaatcgcccaggagcagaatcaataaatacccggagcctctgggatccaaaggggcgctcaccatcggggtcgaagaagaagacctggcgcgtgcgcccgtcgggctgcgtcttctcgaacacgtacgtgccccgggccttcagcccggtgaggaacccgtcgtagtcggcgacggagaaggcgaggtggtggcgcctgggcagctgcgcgggcggggcgcccgcggcgcccggggcgacggccgcgggcgccgccgcggggtcgcgctcgatgatgtggagcgcgacgccgggcgtccccgggaggcggagccaggcgacctggaaggccgggtagttcggggagcgacccgctcgaagccgagcacctcctcgtagaaggcggcgaggcggcgcacgtcgtctgtctcccgcgcgacgtggttgagctgcagcgtggccatcgcggcgagagagcagagaggagagagagcggagcgcggcgtaggcggaagaagagtgagaggagaggacggcaatgtgtagtgccgcgcaccgcacacgtgtgcgctactcgaagagaggagggggttcgagcgcagtgtcacatatttacagagtattaacatctatatgaaagagagagtataaacgaaaaaataattaattacacggattgcgtgtaaattatgagacgaatcttttaagcctaaatacgccatgatttgatgatgttgtgctacagtaaacatttgctaatgacggattaattaggcttaataaattcgtctcgcggtttacatacggattttgtaatttgttttgttattagactacgtttaatattcaaatgtgtgcccgtatatccgatgtgacacgccaaaactttacacccctaatctaaacacaacctcagttttgtttatctacttcgtgtttgtgttggtgtttatccctatgaacgcttactagacacttccaaaagattgaatcggcataccttaagattaatgaagtcagcgttcacaatacgtgcaatcacctatatgaacacaaccttacccctaccctataaacagttttcgaaagaatgcattggtatatcttaaaattaacgaagtacgaacatcccgttgtcgataaatacataattaaccataaatacaaatacccgtgttaaattaggacttaaacctaagtaagctaatttcaccaaaaaaaacctaattagttgagccatgtccactccgttattgattgatgagtttttaaggtcttgccaaattaatcgtgtagaatcgtagttgaatataacaagtcgtggaatcgtagttgaatcctggcagaatttgtggaaaacagaagttctagtcataaaaaagacagtaaaatgtagtaaacgactattaaaggtcaaggattgttccactcatctttggaggacattgtcattacatagaggggatgagaattgctctcattcattttacattaatagtagctcataattacaattccgttaagaggaaaatcgctttcggagatttctcctcagcttacaattaacacatacatccatcaacaagcatttgatatggaatgatgcaagatgttcatcagcttcattcattcaggtatcacggccttgtgttgcgtccacggtgacctatctatcttttgcctccccatctcctcttgaagttgcgctcatcatcgcttgaatcctcgtaagtaaggctcctggaactgtgactggacctcgctctgctgtgcctgtcaccaccggttggagatgaatcctcgtaagtaagcttcctggaactgtacctggacctcgctctgctgtgcctgtcaccaccggttggagatggagaagacgcgcgcattctcttgctgctgcggtgatcctcggcgtaatcactagagcggtgatcctcgacgtaatcaatggagcgcctatggtccctcctgtcagagcttgacctgctggtcttgtaactgggatcggtgccatgagaagagctcagacgctggttacgctctgatgatcgagactgattggcaggttcaggttctttgggcttcgccgccagccttggacgtgcagcgtcttcgtttgcccagtgaatcatagattgagtttcccagctgaagatgacgaataaacgaactgttaagtgttgaaatggaaagaggggttctacatgactgacagccaagtgtaatatagggaaattaaaatgcaacctttctaagaatctcttgaccaaattgttctattagttaattttgtcgtcattttactattagtactggtgagataacaagtctgataacatacataccagtgagtatttgccaaattgccttgcattgctgatggaaattgcagtggcatgttgccgatggaattgacaccataagggcccatcggatagccaccataaggcatgcccgctgggccgtacatgtaaggatcggttaaccaaggatacccactgacgtaagggttgcaatacgcagggtcaaatggaatgctgtaaccatagttagcattgttaggatgaacaattttagttgaatctgccttcttgcgcttcttcttcaattgatcagtcttggaagctttgggttccatggttcctgaaatagtggccggctttgaagtggagtcagttacatcttttaatctggcatcagcagttggtacaatcttctctaccaatatccctgcagaattgccttcatctttcacttcgagatcaacacctgttgtcaatttatgctcaagatggctaacatgttctgtagcaacttggaggccagcatcaggagcagctgatgatatgtggtgatccttagattgcttttccaaggcagctgaaggagtttggcttgctgaattaggatccacgttgctgcctgaagagctcctgtgcttccctgtaccactagtgatgctgctagcccttgttgccagcatattgctgattgtgctccgaagtgtttggttgggaatcaggtcatctgcaagaaccttgactccacaaatgcacttggattgtgtaatgatgtaatcacgaatgcctgagagaagaacaacacagttattagctatgcagttgaggacaggcaggaaatgctatcacagagaccgctgttattaaactattaccgttgaaaacatgtttaagcatgtatttagacaaagttttgagtattggtaaattactaaatgtttatatttgtcttggaaagtacttaacagtgctataattttatcgagttttacaaatatagtactccctctgttcttttatgtatgatgttgtttagttcaattttgaactaaccaacatcatatattgaaggatggaggtcgtacaacaataactattcgtaatttttcctgtcaaataccacgtcaatgtccaaaacaacatgcttctgtgactaatttgaagcatgactagccacatttcgaatatcaaagtaatgacattgttcatatccacagcaaagagttaaggagaaatacagaatttactcacatttatcacagaaactgtcgaagcagcacttgcttgtcaacaccgcatctgccatcactttattacatagccggcaatggagctcagctggcaagtcgtcaacaacactcacagatgcagctggggcaagagctgatggaatgccatcaataggacatgcagatacttctggcacaagagtatggggcttcttgtaatcgtcaaatttgggatcaccaatggtcgggcaatggtgaataaaatgccctggaattcggcatctgtagcagacatagccagatggaggtgtctttctctcctgttggcaatgttgaatgaaatggcctggaactccacagctgcggcacacatagcctggtggaggtgtctccccttcgaccggtccatgaccttcagttataatagatagatatgtcaaaacaaatgcagcgcaatcatataatttacataacaacaatacaaagcaaatcattagagttctggcatcagaaaatggtgaggaactgtctagcttaaccaatgataagttcaagtgaaaaatgccattacaatgtgcatgaccatttgtctcataacaaatcaacaaccatgattttttccattttttaaccaacttagtgtccatatcataatcataactgggacaacagaacataaatctgaaccaaagaggattccagcattaccataacgtcctgacgtaaaccttccaccagtctgtcctcttttagatggcttgtcttccctgcatgcaccaagatacaaggctgtcattaggaaggtgccagaaaaaattgatacctgtgaggaaagaaaataagatgcactaaccatttgagttcagctgcatcaattatagatgcgattgcagcatcctcatcctgtacttctgtagaggaacaagattttgaggttgattcagtaatctctgacttgtttgaagctatagcaccatcttctataacttcccgcctgcaattaagcccacaatgccaagtattagtatatacaaacaaacctctcctcagctgattcagattcaatccaagcacttgaagtaaaatctcaaataaaagattgtggagaagacatacgaggagaacaagacgattttctctgattgttgcccagaagttcggcggaccaacacagtcgagttctgcggtatcatggcattttcatctagaaattctgttttgagaaacaaacacagaaaacagaaatgtcaaaagcattgcactcaaacaatactccttttattggtgaaacgaagtcttctcatgtacaagatgcgcttaaacaacaaaactgaactgtccagatgaaattaaagaatattttagtaatagatcacaaaactgggaattttgtgggaacaactgaggtgtaatccttgtgaaatctgggttcacgtacaggatggcaaaagaagacgggatggtggaagtacaatttgcaagtacaaaccttccacaaggattactggacaagatgtacaaaaaaaaaaaagaaaggaaagtgatatggcaaaacttctcatccaggaacaagctcactgaaaaaaaaaacttatatggacatatctcgtcaactggcgaaaagatgaggccatcttccactgcaataataatgtgctaacacctgtgtccgagtacagtatcttaagcacgtaaaatggacctccattacaatcacaaaacaggatttcatcctctctaaaatacaaattaggatgtcacagggatacagaaacattgaccatcagatgggaatcagtgacacgcaaaactgatagccaatgccattactggaacatttcaacaacaacataggaagaaacataataaaaccatctaataagaattcatgaaatgggggaaaataataatcagggttgtaataacatatttaggcatgtcgaacatgcgcagactgaaatgagcttacacttaatatcattatattgacaaagcataaagatcattaaaaacatctgaatagcattggtatgagtcccaatattgcattcagatcaaccgaacaacagaatatgatcaacacataggagtgcctaatagaactaacacatatctagattcctaattcatatcttgcaagaacgttcaattcctaattctgatcaccttacaataattactagttactaataatcggattgacactttgcccaacacttgacctagttaaacttagatagttacattgagtaggatatataaaataagtttgtttcacatcagcaaaatattgggaacttggatgcacgcagaataatagctaatgggcaaaattgttattacttatgatgtatcttaagctttcctaaaggttacagcaagaattaataatcgacagaggcgctaatatgccagcattcttcattgagaagaaatgctgggtacaatgccctgactcagtcctaattggtaaaatcatgaaccaatattatcctacaggctaaaaagataatccatatggacaaaagaaaaaaaatactattccaagtattatccaattcccagctttgtgatcatacaatgatttgtttcagtgattcaagccaattaacaggaaactgatgcggttacggataaacgaatgcgttgtacagatagttaactaccttcgccggtctgggcgttggagaggacaatatcttctctggggccgcggccacgggtgcggccacggccatgtttgtcgctcgtcaagatgagctgcttgagttcagaaacagagacaaaagaatggggcacgggcacagaaatagtttcctttgaactcttatatttgtaatacacaacacccatggtgttgatatcaagttttttttccccttctcgcctcttctgcacaattatttttttttctttcggcgagagaggctgagactttttccctcagatatcaaaatacacaaataatacacagagatagagagttacagatcgaatcgatctacggggggaatcgcgtcgatcggcggccggcgtgtcccttcgccgccgaggaggaagaagacgaaccccgcgcgagtgagtcccgagtcccgacgaaggaggcctgcccggagtcggaacgcgagaggcgggcggagtagaggaaggcgccgagtcgaggcgatggcggggaggggggggggcgagcgcgcgcgggcgggcggtcgacttccgccggcgtcgctggcccggatgcggatgcggatgcggaggcggagtcctcgccggaggcggccggagagctagggtttccgtcgcgttcgccgaatagaaggggattttggggggggtggaatttgggggagaaatccgcgagcggcgtgcagttggagtcggtggcggtttataggcggctctggcgcgataacgcgtgacgggaaggaatccgacgcggtcacgtctcttggcctctgcttccgtttccgtggccacgaaggttctagctttcggtgtgctggaaaaagtgatctatcgtgtgtgcgcaatactcgccgacggcaccccagtgttgcggatgtttgtgcggtcgcgaccggctcgttactgggccatggtgggctcgcgcgacgtgtgggccatactgggccatgtttgtgcggatgttgatgtatcgaaatgatcaatttacaagttgttgtacttatttacacccaccacataagtttatgtaccgtgagcgcaaaagaagataaatgtttcacacgtgtatgatcgttttagaatggtcatttcattcataccgctgcatgcaaggataacttggcatgcttacgtggcattttttgtgtgtccaaagactatattaacctaaataattaatttgaaggatttgtttggacgatttgaaacatagaggactgaaatgagcccgaagcgaaacttcagggaccgtattggctattcaccctttttattaatagcctagcaaagtattcctacgttgcaatggatgaagtcaacaataattgcatacatggatgattataagaaatatatcgatactaactcaaaataaaattatattttacatattactaagtttatttgtcttgattaggtcacaaatattagtagttactttattccaaaactttagtgattttattttggaatccatagtgaaatcaaattgcatttttttaaaaaaaataatcaaagctagctttgtttggcatttgcgagcttcatggctgaaattaatttgacaatctttctctgacaagctgcatgagttcattttatttgacattgatgtcctgaaattgatatgaatatcagatggtgtttaaggaaaagtacttaactaaactattttattttagtaagttatatttggatccttaaactcccatgagattagtagttatattgattattgacgtaatttctatgaatctgcatgtccaaattgatagcattagcaaaaaagggctgcatgcgcagaaagtaaaatatgaagctagtgctagtgctggccatatttatatgctgaaaatcatctagagtatctaggcactgtttacatcccatcccataatttttcacactatcatatcaaacgtttaaacatctatgggaagtattaaatataggcttaaaaataactaatcgcacagattgcgactaatttgcgagacgaatcttttaagcctaattgttccatgatttgacaatgtggtgctacagtaaacatttgctaatgatggattaattaggcttaataaattaatcttgtagtttacaggcggaatctgtaatttgttttgttattcgtctattaatacttcaaatatgtgtctgtatatccgatgtgacacgccaaaattttacacgaatctaaatacccccttattagtcaaatctttgaagctgcatgataaatctagaattcagccttacaccggaagtccttcgaatcaagcctgtgtctggcatgatcatatcacacaactgaataattgttttttccattgccttgcaaagagaagccaaacccaggcgagcacctgacagagagacacatgcaggtaaacctgttgttgctatgtctcgaattagggccttcccaaacaaaattttttacgttgtcaaatcgaatattttaacatatacatggagtattaaatgtagaaaaaaaaccaattacacagttcgccaggaaattgcgagacgaatcttttaagcctaattgcgccatgatttgacaatatggtgctacaatatttatttgctaatgatgaattaattaggcttaataaattcatctcgcagtttcctggcggaatctataatttattttgttattagactacatttaatactttaaatgtgtgtccgtatatccgatgtgatataaaggggcaaattttttttttgccaactatacagtcccttattcctgtcctttggtaagagaggattttagcattgcatcaaagcgcagaagcaaatcttcctttccaaggggaaatcaaacgtgaccaacgtgtaggattcacgggaacaaacgaaaacaaaaccaaaagaacgagatgcatcgcgctgtgtcatgatcaagaaagcaagacccttcacatggcactctgctcccgttgcattctgctgatttcatctgtcaccgccgcctgccggtggccaagttcagtccacgaccaacatgttccagatcacagcaagcgtgagcgacgcatatgcgcgagcttttggaaagcaaagcgcgatagttttaaggctacatataccagcgaattaaatgttccgtctcaactatcggagtagtgggaaacgatgggtgcggtgacaaggtatagatggccatatgctctgaggcccatggcctggcccgaagcacgccattttggtccggcccaagcacgatacggtccgactggggggggtcatgtctatgccggcccggcccgacccaacagctgggtcgtgcctgggctgcaccctcggcacggtgggccagcctggcatggctcgatcaaataaaaaatatatatggatgcaaaatctataactaatataaatattcgtatttttccggtcgtcacatctatttttgtcccgcttcgtccacgtacgcaatccgattcggttagcaataccatggaaaaaaattgcaaaaaaaaaatcgcccccctccccccaaaatcccaatcggaatccaatcaaaccccaaaaaaatcccaatcggagttcaatcacacaacaaaatcgaagaaagcatgatgcatgtacacatatatatccaaataaaaacaaaaaattagatcgaagggggtcgccgccaccgccgtcgtcgccgaaccaccgccgtcgccgccgcagggatggctggccgccggcggctcccctcctgctggatctggtggaggggagagtgccgccgccactgggacgccgacaggccgccgccgcctcaccttccgctagatccgccgccgccgccgccggcggagggcgctggcggaggggagagcgccgccgccgcctccccttctgctagatccgccgctggtggtgggggagggctccgccgccgccgctcgcggggcgcctctcctcccgctagatccgtcgccggtgatgggggcccctcccgctagagccgtcgccgccaccgccgtcggtggtgggggagggctccgccgccgccgccgccgctcgcgggaggaggggcgccgtcgccgccgccgctcgggggcgctgaggggagggcggcgaagagagagatgggagggaaggaaatggactagggtttcggcggctgagggagggggttttgtttccccgatatcgacgctcggccgtccgatcaaaaccctagagatcagacggccagcgttggataggccgaaattggcccaagagggatcgagagtgaggccacttttccggcccaagcctaggttgcggcctggggaggaaaagtgcgcccgcgcgtgcgcaaaaggctgtgggccaatcggcaagggccagaaataagtctatattaggtccctcgggccggaaaaaagagaggttcatttttttcagaagcatttacaattatacttattgaatgtgtttatttctaagtaaacctaaaaggaaggatttttatctttttccaattaaataattattaaatgatgtttgcattattaaaattagcaattaagctctgaaaattccaataagattccaaagagcgtaactaatcatggagaattcaataaaattaaatttaaccatgtcattttatttctcacacttgctttacttgtatatttatttaattatacacatacctacttaaaaataccaaatatttcagcgaatttgtattttaattaattgcatatttttctgatctgtacgcttcccggtgcaacgcacgggcacttttgctaaaccaaacaatacttttggtcaatatacacactccgtaatcacccggtgcaacgcacgggcacttttgctagtagacttaaataaccgtacacggcaaggccaaaagagaagagaaatacaaattagactcattttctactttgactcccttaaaagtgacccgaatctaattcatgaccctcaaccgtaaaaccggataggacgactccccaaactattgaaaccagtgcaatttgactcccttagtggttttggagggcggttttgctgatatggcgctgacgtggcgatgttgacctagtctttgtcccacgtggcgcttacatggcagcaataagtccactttgactcccttaaaagtgacccgaatctaattcatgaccctcaaccacaaaaccagataggacgactcccgaactattgaaaccagtgcaatttgactcccttagtggttttggagggcggttttgctgatatggagctgacgtggcaatgttgacctagtcttcgtcccacatggcgtttacgtggcagagcggagcacgtgcgtagaagccaccaccaccaccgccgccttcctcggccccgacttccccatccaggagacctcccagacggcctacgtttcgccgactcctcaagatcctcgtccacggtacgcgcgtgcgacgcgtgttcttcttgtgttattggtcgagtcgtggtttcttcttgccttgcttacctacctccgtgctcttgcctcaccatgttcatcgcttcttgtttcggtggtgagattcttgatctgaggtgttgaaatgttctgaccgtaatatccagaatcgtcgtttgcattttaatttcattaaagaacggagaatcaactggtgaaatgcatcgtatgtagcaatgccgtccaatttcttcagaactttttagtaaaatcgtggaatcatgcgtccgggtaatatttagccatcaggtgttcgaccaattgaccaagagaatacatggcagtgggacccacaatatttttatgtgtgaatcacagatgggtcccacagatatttcttttaattctaatgccacataagcgccacgtgggacgaagactagttcaacatcgccacgtcaataccacatcagcaaaatcgccctccaaaaccgctaagggagttaaattgcactggtttcaatagttcggggattcatcctatccggttttgtggttgagggtcacggattagattcgggtcacttttttaagggactcaaagtggacttattccttggaacacatagcttaagtgcttaggctcaagcttgatataaactcgaaccgagtctatactaacatcgagtttacggttaggtttgggcttggctcgaacgagcctcgagcctaatcgagcttgctcaaaaacaataaaatacaagcttatttataagggaacatagcctatgtacacaagctttctatacacactaattaacaaatgtcacaaaaaaataaaaaaaaattgtagtgcttgtagtactatctatggaacacacactgacacaaaactactgacagcagacacagtggcggaactatgtgtaagttgtgtggtcgattgaccctgcagtttttttcactattacccttactagtcttaaattttccatataaatccatttatatttacataaataaccccactaaaatatcaagtaataataattgactgcagagtaaatttaagccaaaatatagggataggttttgtggggtttgcttcattagagcaggtacaatagcaggctattagctagttataaacatattttaatgagataaacgatgaaagagaagagcagcgggctatagatctgtagccagctgtagcacggtgttaacgaccaaatttggtaatctgagtatcggagatgaagaaggaatcgaaacggagttcgagatggagatcgtcccggaaacagagtaaagatcggctaaagtctgaatcggctgtgatcaggatcggcaaagtctaagttggacagggttagctgattgagctgaatccgacaatatgacacggcatatgttgtcgggttaggttgatgtacttcacaatgattgccaaacatggatagagtcctgagaaggcaactgtatctattaattaggatattttatgtaatttccttagagatttgtttgggcaatagtctgccgcaaagacttatggtatcttagagtttgttagagataagagtcgtgtaacatattttgtaatctcgggtataaatagaccccgagccccatgtaatcaaaacaacacacgttcaatataatctcggcacatcgccaccctttaacttacgttttgtttcgacgagttcttactttcgggttgagctgcatcggtttcgatcttcaacaagaggtaaaacttgttatggcggtttgcgttctcaggattagtgcttccatctttatgatactctaatcttgcttacgtaattcgtcgagttatcatatatcttatataatctttggcaatatcgctatctaaccttcaatcggctaacgtctgttactggaaggcatccaattaggttatataccgacattgatttagattatataagatatctaccactctatgacacattgaacagcttgattgtctagatattgccattcttttcatacttatagctgcatcagttgagtttgatcttatgagtcgtgattagaatctcaatctctagcttgcttttggctgctgattagggtagcatcggggtttcagcctatcttacctgatttaactacttttctcttatgtgcttgattgacacgttaaatctgcctttatattaagatcttgttgcatttaagtatattaggcttttgtttggtatattctacttgctttgatatcttaatatggagtactattagagtattagccgatacatgctagatctatctgatcgactatgctataaacatatatagtctcattgttaatatatatttcgatctaagtgatttatactgtctcggcatggtaaccgatctatcccaatcacttgatttaagcatatatcgacataatgattatatattgttaatatctatagccgatcgagtagatttagctctttcttacttatttatgattgccgatcaatccacatatgacatcggcttagagataaatgatatgtcatcggcaactagccgatcggctatcgtttatggatttaaccgcggtctctttgtctttatttcttgttgattgcaggatcaaatcaactggcacgctcatacacctaaaggcaagcttttggatctgcactggagttaagcagatctcccaggtctcgtgtttttacatcaacatacggactccaagacacaatgtgtttatgacaggtgggactatatattaatagtataataagcaactattgtatgaattggttattagattcgctatagataaattgaaggtagtagtggactgtactattaaacttgctcttaggtaagggtgcatcattcattgttctttttagtttcaatttaaacctacggcttaattttttgtttcatgtcttacggtgctcttttagggtgaagctgaatttttctatgctggccaaggccacaacctctacgaagccctgattggattctgcttaggcttcttcgactgcagcttgcagtgatcgcatttgctgccatcttctacagaatcaacgaagcaaccgtggacagaaggaccgaactgcttcttttatcttttgctttgtccttctcaaaaaaatgctaggacctttatgtaattcatccaatcacatggagttgtcatgtaaaattggctatgtacccggtctttggtctttttttttttaaaaaaaaaagacttacggcttaattagctagggttttcattgataagggttatggttttttctttacaatttggagctcaaattagctcaaaattgtggccaagattttaatatatgaagattcacattagaaagtgtattcatccctcgaggaaatatccccttatttcatgtataccatctaaatagtcataaaaaaatttaaaataaattgataaaatagattaataagaaatatatcactctacaaatatgcaagttaaaattcaacttctacaaattataacaaaataaaaaatataactacgaatttacaataactattttcattttttttgctaaaagttgaatttggcattgcatgtatgtggagtgatatatttcatattaatctatcttgtcatttttttaaaaaaaaattggtaactatttacgacatgtaagcaacgagtggacatcctctcgcgagggataataatccatatctgattcacatggttattccattatatgcgtggcttaaaagatggggattatgtgctactccctctgtttcatattataattcgtttcgactttggtcaaaaagtcaaactactccaagtttgcttaagtttgtagaaaaaatagtaacatttttaacccaagataaatatattcaattatagattttataaaactaatttggtgttgcaaatacaactatatttatctacaaacttatctaacttagagtagtttaacttcgattaaagttaaaacgaattataaagtggaacggagggaatagttcttagtgcgaccccaatctagttgactagttgttctaaaagatttaagtataacccgactactgaaatgaatgctaaggacaaagcctaaacatccaagcctaaccctggcgctgatggagtgatgatgggtggactgttgcgacacctaggcatggtcgcggcaaggcacagaaacaaacattgaaccagactagacgcttgcgaccaattgtctcaaggttttcagtgtcaagtttcatcaacttgtgttgctagctaggtttctattaggggttatgattatgatgataacaaaatgtacaacctgtctgtaaggtctgaaacatcgttttggagtaattcacacttgaagtgagctatactattgtgtacttgctacattcacggtgaattcttgtttatcatgcctgaaaaaacgtcagccatcgatatttctctgctcgtttctgcttataacatacaaatgggcgaaccaatggatgtgcaagtacccggatctc

SEQ ID NO: 30129 - DNA, 16377 bp, Oryza sativa
tgatacaaaatgtccaccgtgtctgtaagtctgaacatcgttttagagttattcacactgaaagtgagctatactattgtgtacttgctacattcacggtgaattcttgtttatcatgcctgaaaaaacgtcagccatcgatatttctctgctcgtttctgcttataacatacaaatgggcgaaccaatggatgtgcaagtaccccgatctcctgaaacggtgcgaacttttaaaaacacttactatactaaatttcttggaatattacattaaatttactttttaaaaacttatactccctcgaaaaaaaagcagcaaaagacaaattaacatagacgagaaaaaatgatatatacgcttctcattaaataacagcttgtttggttggagggagtttgagagtgggaatgggagtttaggagattgagcattttaatctctagtttggtcagagggcttgggaatttcagagggactgggatggggaattaatctatctaactcccactgatcccatccctgggggaccctgttaattcacgagacttgatgggaatcaactgtaatctctaatataaaccaaacaaggcatagggaataaaaatccaactcccatgactaatcccactttaaactccctcctctaactcccattccccttccctgctcttaccaaacaggcagtaaggaatgattaaattgagtaaattctatgtgtatccctaaaaactcactcaatccctttcatacttgataaaacctgagttccactcgacactcaaggctgttgttggcccgatctttcggtgagttgaagataactacgatttgggagaaatgttgacgacccgactacaactatactagacgttgttgtgttgcgccttagcgatcgatacacctctccgttgattgttgatcttgccggtgcagatgaaccttattcctgcaagcaaattgaagaaacaagtaagaacaagataaaagcaatctgatattgcagataggaattgaatacaaatgataagttgggattccgtaacgagtaaaccggcgatctaaccgatcacgggattgcacggcaaagtagtaaagctaaactttaatctaaacaaaacacaagaaaccctgaaggggtaccaagctatttatggagatgggaggatcctaagtcatcctccacctggtttggggcgcaccccacatgggccccacttgggctggggtcccagacgaagttacaagcccataggcccattacaggtgacgtagcaccttgttccatcaattgcgcatgactgagaaggaatttggcagtgaggttggatctgttggaatgacgactccgaatgctttccatcaagtactcacggacccaaaacggagctcgtatgcacatttggcggccatttgaattcatcacagtagcaggtggccgaattggattccagaatttggacggcctgatcttgaagtgttcttcttgatccatgatgtgagcaactgttgtatccatggtagccatggtcacatcatcctcccattcttcacggaaaaccgtcctcggtttttctatatggtgctcttcacatagtccattcaaaataacctgtttcatccaatcaaaactagagaaactcgaaatagtgtgattagcaacaacatgtttctctaaatacgaacaaatgaaaactctatgcaccaaatatattcctctatcattatattcgccaaagatatgaaaaatagcattagctggacatggcaaatcagatttagcaaataatttctcctccaaattatcgagctcacaaaaatcatcaaactgaacatagcccaaagtatttaaagaagttatcaatttgcattcctcaacatcattagcaatgtgaacaacatgcttaaaatcagcacacaatgaaacactagaaatagcattctcattcactagttgtggcatggatataagtgaagtattattacacaactcttctttatcacaaggaacaataattaaatcaacttgtgacaaaggcatctcagcaattggttccactaatggttgctctagtatagcatgaaaagtggaaatgtgtagctcaccttgagtatactcaccttcatttgtctcagcaccatttaatttaccttgcaaactattttcagatatcgcgggtgcttcatgcttctcccttttcttctcaatgacatcattatactccgtttgttgaatgttctgaactccctgcaaaacgttagcaacaggagacacaaaagattgctcctcgtttgtttgcgcatcatcattgtacaaggatataggagattcaaaaacatgagataaatcacattgttcatgctttctcgcatttgacatgatcttactgtcaatgctgcgagcaagcatgaataggtgcccaatataattatatgtcacattagcaagcataacctgaattttagaattaagcccattgaaaaatctacgtattgtgttttcattgcactcttttagaccattgtagatgatacaaactttaaattcatgaatatactccctaacagttctatcatcttatttcagatgttctaatttctcccgaagagtacatttgtaataagaactcacaaagcgttttctcatcatggttttgcattcatcccaagtttcaggtttattactaacaaaactctaccaaaagagagcagaagaggtaaacttattactagcagccttaatcatttgagcatcagaaaaatcatgtatatcaaattcattgtctactgctagctcccaatcaatataagcaacagaatcatacttcccatcatagaatggtaacttagattcaacttgtgcaaaattatagtcatgtacctcatatgcattgcgtggagaagttgtcatatcttgtcgacggtgaagaagccgatgttctcatattcccatgtgcaatcctgcatggttagtagaaaacaagaaacatacacaagaatatgcacgctcctatcaactactaggtagtggaagctctaatatcacacacactcaagctttttaccaagctcttacaagttcttaccgaagcaagcggaatggtgacgtacaccgactcaaccaagcatcccaatggagtttgaatgtatcaatgccttggcaaacacttgctgtacggttgcaatcaaatctgtggagctctgggtaggcttaaatatgtagcaaaggaatagcaaatgctcaaatcagagattacaaagttgaatgatcgttcaaagtcaagtaccgtgctggtcctaaactagaacatattagagacggtgctagtcctaggttagaacgtattagagacacgagcctagacacaaacgatacaataagataacaccagaaacaactcaagcacactctgatatatgaaaccaaactcaaagatacaactgatattttctctctttgccttctttctttcactttcttttttctttctttcctttattttttcttggtacggcttttttctctcttcttttttacgcacctttctgccttttttttcttttctatttttttaacaaaaaccgactcaaggacctcaatgtaagattacatggactcaaatgtaaataaaaaattacagggattgaagtgtaaaagtctgaacccaaaaattgaaattatacaaaaacggaatattgaatttataccggttccgtttttccaaacagatctcgaaaccgacacaaaacaaatttttaccaaggtgttacagaagtgggagcgggacgtgactacaagcagaaatcggactcggccacaaagggcgacaacaggaaggatgcggcaggcgtccggatttggtgagagaaacggccacaaagggcgacaacaggaaggatgcggcaggcgtccggatttggtgagagaaaaaaaaaagaaactgattttcaatcaatctgatctatttctttccagattaaactctcatacttccaaaaacagatttggaaattttttttctcctcactcgcgcacaacaggacaacaagagcacgggaaccatacaaccgaaaccctagatgcaaccccacaactccaaaaatgaccgaccacaactccaaaaatgaccgacagaaacttctgaaaactagaaaaatagaaccgtggcagcgagccaattccatttccgtaggtcccaaagacaacaagaacacgacggcggcgataacagtggtactagacgtgacaagaactcgaaactctaaccgtactacacactaagactagcagcatgactcgacaatgcaacataaaactcaacaacgcaaaaactgaaaagaacaatgtaatagcataatatggctaggtaaatgatacaattttttttgtctagctattttctagttatgggtagaaaaaaaactcaccgagcaacgaaagctctgataccacctgatgaaccctgaattccactcgacactcaaggctgttgttggcccgatctttcggtgagttgaagataactatgatttgggagaaacgttgacgactcgactacaaccgtactagacgttgttgtgttgcgccttagcgatcgatacacctctccgttggttgttgatcttgccggtgtagatcaaccttattcctgcaagcaaattgaagaaacaagcaagaagaagataaaagcaatctgatattgcagataggaattgaatacaaatgataagttggggttccgtaacgagtaaaccggcgatctaaccgatcacgggattacatggcaaagtagtaaagctaaactttaatctaaacaaaacccaagaaaccttgaaggggtaccaagctatttatggagatgggaggatcctaggtcatcctccacctggtttggggtgcaccccacatgggccccacttgggccggtgtcccagacgaagttacaagcccataggcccattacaggtgatgtagcaccttgctccatcaattgcgcatgactgagaaggaatctggcaatgaggttggatccgttggaatgacgacttcgagagctttccatcaagtactcacagacccaaaacagagctcgtatgcacatttggcggccatttgaattcagcacagtagcaggtgcccgaattggatttcagaatttggacggcctgatcttgaagtgttcttcttgattaatgatgtgagcaacggttatatccatggtcgccatggtcacatcaataaccctaaaatttactcgatcctttctatacccctaaaattttaacttgatccctttcatgcccctaccgttacattttccttcattccactattatgtttgtttgcaaatgtatttttttacccttgatgctttaggtttgaatataagcgtgaaaaacgattgaaaattttatttgagtgcacagtacgtgcattttatgaaactaatgagactaaataattagtgcagaaaattttgacataaattttaaaaataacacaaatgtaataaattaaagtttttatttgaaattttaattggacaatggattttttttgtcaggagcattcataaaaaaaatatattgtgagcattggtcgttctatctttataggaatgctcctcttttttatgacttttttaaaaaaataaatacatattttttatttcattatctaaaaataaattttttgataaataatgcatagcacaacaaactcataactataatagtctcatgcgacaaacttttacatttttaataatataattaataatttctatgttcatccaaatggtaaaataatcatttttatagaaattagactgtcaactaacggtcaactgacggcaggggcatggaagggatcaaaatcaaattttggggtatacaatgaaataagcaaaattcaggggccttgataggattagcttaaaattcaggggtatacaagagattttctcaaagaaatttgtatgagaaatgatttgaggggaagtagtactcatatataattttattctgataaactttaaatgctagaagtgttctttttcataactgtttcttcaaaatatatatacatttaaagtttaaagtcctttaaatgatacgaaaactttaaatgaaaggttagttggaaagcaagtattatatgatgcaggtggtctatcgaactcctaaggtcccacctgcatgcacacacatcccaagttcttaatattttgaactctgtcgaatgtttgtctaataactgttgtttaatagagtactaaatttacgatttcagaccatcaacacatttttataaattgtcattaaatttgtattatttccaaaaaaaatccattgttgatggcactctttttttgcagagaccagataagcagtaattgggtggtggtccgagaccatacagcggcggtgctgcctgttttcatggaagttcgtcagacatttcgcaactgcagaggaggtagagttactagctagagcgccgagaggggctggcactaaagcgcggaatggattcataaaccatgtattctggagtcggattgtattttcgcggtgactcaattgcaagatataaaagaggataatgatggccttcaggcgaccgggcgggggaggaaaaatcggtcgctccccccgcccccgcccccgcacacacgctggtgtcgctggccctatcacattacctacaatacatgcccccacctgcaacaaatcaaccacatattttaaaaatcatctattaaggaaatttggtttatttcttgttccaccaagaatgtttcacgaatgtttcacctagtgtactcacaatgtttcactatatatggatctaattaatatgttgcacccttttgtcgtaaaaaaattgcaactttatcttgctttgtttattattttcagcttgttaatccatatatggactattatgcatgtaattatattttcttgctcgtaagaattttcaacaaaacatatttttttagttttatgttagaacattattttctttaaaaaaatagatgtgtgaattgttaatattgatctagtgttgaaaaagtgattcataaatgtaagaaaaaaaacgctcaactaaccaattagatggccccacactatattaaaattcatgtggcgtcgcattcacaaggtaggagtaacaaatatggcgtaaacatattaattagatgataaaacataaaatataactaattttttttaattttttcataaaatttttaaaaaagacggacagtcaaacgttggacatgataacacggatatatttattttgagatggagatagtgatagagatgtgtacacacttcactaggaacctcgtaagtatatctcaaatcaaaccagacacgaatatattggaaacatggccaccagatttaattaccagagatattaaaatatactccctccgtcccataatataaaggattttgagtttttgcttgcaacgtttgaccactagtcttattcaaatttttttgaaattattatttattttatttgtgacttcctttattatctatagtattttaagcataacttttcgttttttatatataaaaaaattgaataagacgagtggtcaaacgttgcaatcaaaaactcaaaatctcttatatctcttatattgtgtaacagagggaatagtaaattacatcaaaaccaaagtacgatcgcggtcggtggggtcgtttttttctttttttgtaagactataatcaacggggtcaatttggagtaaacccagcaccgctgacaatgaggcttcaatacagaataagcaacgaggtgcaactgaaacaagaatatctggaaccggatgcatacggcgcatctggtgtacatcgttcacgtggtaaactggtaccggtgtcttgtttatttgatcggtatctttatattcgtgttcgtggtgattggtaagtggtaacacctcctatcgtaaataagatttttttttgcaactaaaaagatcatcaaggcactattaattactacccgtatcccataataattgtatttctaagatttaaacttgtcctaaaataattatcatagtagagtactaattgtcccatcaatcacttctcatttaaatttcttccaattctaccctttatcactcttacaatcttacctatacaccatttaataagggggcaccataatctttcttctcaaaccttaatacatgctaaacaatttagaattacaattatattggaactaagctcgtaattattaatcattacatacaaaatgagcggaaaaagatatgtgtattagacacattttctttcccagggatatttattactacaaagttcactaaatgtgaaatgttaaatgattctaatttaaagccaacaaaatgtagaaaattataacatttgtaaaccattttgaagaaaagattaactacattgttttttaaagataaataaaaaaatatttcaagaaaaaataatataaaagtttaaacacattaattaagcattctaactactaaatttctgaccaaagggagtatccgttattacaaagctcacgacttagtaattaacaagtttctaatcaaaaggggatatcaattatggctacatcgaatatgtaggattttcaaaacacaagggtagagaaaaaaaaaagtaggattcgagtgccttgatatctttaatcctatatatatatatatatatatatatatatatatatatatatatatatatatatatatatatatatatatatatatatatatatacataagaaaaaacatagaaaaattacataaaataatatttgggttgaacacacgaaaaatatatgaatcagaagatagatatatataaagagttttttttataagaggttgaaccttatatatattgaaaattctccaaaatttgtatgatttaagataactgaagaaatttcaacgaaatatggtagcagttaaaataaaatattttatatactgtacagtcaattattctatattaaggtcctacaacatattaatattttatatcaaactgtagctctccttagtccgatgctcaagaatctctagaaagttgtttaatacagtcacttggaatcaccaccaaattaattgtgtttagattccttcacgtgcggccttccacttgtggaggttccttctaacaggtttcccaatttggttatgccatatttgtcgatactccctccgttccaaaatataataaattaaaattagatgagatattttctaatacaatatatctggatagattttctatccagatacattatactaggaaacatctcatccaatcctagattcttgtaatttaggacggaggtagtagaaaattagagtgaaaaccccggtcaaaaaaattagagtgaaaacttatgatttttataccgtcagatgcactttgagattcgtgatgggaaacttgtcacgcgaggagacgaggaagcgaactggtgatgacacaaccacatctgtagccaacggaatatttaactatttatcattcttaaatatggccttaagcatttgctatctgaacatattagggacaaatggttaaatgtcatatctaaaattagcaaatagttaaatgttccatagccaatggtaccacgtgttctttttttaatagtatacattactgttgtaattataatataattatattacaatttacgtttaaaagttttctaaaaaaatggaatgttgtactgctagtcccctcccaaatatgccacaattgaaccaaattttcctaactgcttatttcatcaatttaaactcttaattgttggcttcatcgacttttgatgataaacatgttaggctattccaacccaagacactagacatagtatccataaacctcacatcatcaagaaactagtactagacactactcttccaatgcaaacaccactattccatacttaattaaatttaatgctacttatctcacatgatgtcttggatattgtgtagaaaccatgtctcatgcaagatatggtttctttctctttacttatttattcacttgctacatcattttttatcttaggtggcagcttatttaatattatggacgccatcctagtcattgggttggaaatatgttagtgatatgctctagaggcaatcatagagatgattatatcacatactatgtttacatatttatccgacattgttccttaaaatagattactcattattggttaatgaatatgtgattctttcatgagactctttatattatgtgttgctatttctaaaggatccctgatcaaatatcatatgtggaacaaatatgtttagatgatcagcacatgtattaattgatgatcatgtctcatagatcatggtatagagataccaaattaataatgtggacacaagttggtgaatatgttgttggatagacccaacatgagacactgcaagagccatatgtgttgtgtcatcagtgatctcatttagtgttggtgttgaatccttagacctgagattatcatggttctcaacatgtgtagtagcttacttagggactgttaaacgctactctgtaattgggtagttataaaaagtagttttcgggtatgctatgaaacatgtagtgggatatgaataatcaagatgagatctgcccctcctatggagagatatctctgggcctctcgatgttgtagattatggaagtgcatggccatgccaaaggtgattgagcagtcaatcacaagttatataatctattaacaggttcgagtgaatgattgagctattagaggatggcacatatctagccttgagcttaatcgatatcgtgaggcaatggggttcatacaagtatacactagaggttcagccgatatgatctttatatatgcccggtgggtcaatacgttctgctaggggccgctgttgacgcgtggaccgaaaaggagttctcgggttacagccgagtatacatgaacctccagggtcgcacgcttaatgggccggaataaggggattggatggagatccaatatgagcttaattcggatagggatccgaatatgagtcctacgggccttggaggcccgagtgatggattttatatattcgtgaggggtgtgaccggcggatataattgcatcacgtgagaaaccctagccgtcacttccctccccaagcaaaaccctagccgcgcgcgggtgctagcacatctgcacgtggccttcccttccctatacgtgtggataccggtagaggcgccgctggtttgcggtgctgatcggcgtgggagtacggcgaggagaacgtacgaggaggagaaggtcgagccggtgcgatcgactacttcctctacatcgacgcacgctacttcgcgagagttccttcgacttctcagcgtcttcttccgctgcgcagcacgtcaagtggtaacgatctatgatctaatacttgcatggttcctggtttacgcgataaaaaattttgatttattctatcgtagcctacgcgtatcccaacaaaatggtcttaagagattttcaaagatagagcccatcattttagtcccatcatttcaaagatatcgcactggtggtcaccagggagagagggggagaccgagagcaagaggggagatggaaagcactagctggtgatttttattcccatcggctccgctatagcttgatgaatgagctcggcttggctgctattttgtaccggtttacctaaacaaccggctgtggtgatatgacattatgttactgttagttcatttaaaaaattaggtactaattaatgaccttatatcaagtttttatatcctcgtggcatgcaggggtgtaaagtccctgtcattaccagtttttacctaacatacatcattgggacaatactaacaacgtattatgtagtagtcgtgttatttttatattatttgtatataggccacttgctattgagattcactgtgacagcagatttttttttaacgaactgtgtacgtgttatttttctatggaccacttgcgctataggttcagtgtaacagcaaacattagtctttttcttttctccaagcaagctggctacaatgcagccttcaagatctatataattgtcgatcagtaacaacgtccagagtgcagcgcaaatagttactacctattatggtgaagttcactgcacgccggggcaaatctgagctagtggcaccagcgagggccacaccaaatgagcgaaagtatctctccgatattgacaaccaacactctctacggttctatgctaccgccgttgagttcttccagctatgcactttcgatggctacaagccacacgatccggtgaaagcaatcaggtccgcgcttgcagaggccttggtacactactaccccatagccggtcggctgagagaacttccacaaggtaagctggtagtagactgcacggtagaaggggtggttttcgtggaggcgtatgcagacgtgcggctagaggagctcggcaagccgcttttgctgccctacccgtgtgtagaggagttcttatgtgaccccggcgatactaaagtggtggtcggcaaaccattgttgtttctgcaggtactatatatatatatatatatatatcactcattttatttcctttcccttcaaattttcaatgtggtttacaactttcagaattagagacatatataatttttagattttcaagtatttgttaataggcatctctaggttatagttatagtaacccaagatttgaaaacattgggcatgcagtttgttttatatgcctactatatatactatatattttatatggcttttggtttctagtcttgtcatatttttcattgataacattttatagcctgattttattggtagatgtgatagataacatgcataatgctagaatctttatgcaataatttagaaaaatcatttgtgttcctagccgctattgtgttaatggaatttgtttgggtgtgtacgtgccatgtaggtgacacgactaaaatgtggaggatttgtaattggccttcatatgtgccataacataagtgatggctttggaatggctcatttcatcaaagctgtgggtgacatcgcacgtggcgaagcactactgaccatatctcctttatggaacagagagatgctaactatgtgttacccaccccaaatcacgcacacacatttagcatacgagccacttcgtgatggtgatcctaccaatgatataatgcaatccactacgcctgacaccatggtaggccaatactttctctttgggccaagagagatatctgctatgagaaaccatgttcctgtacaccttaggcagtcatatactacgttcgaattaatagctgcggcggtatggaaatgccgcaccgctgcattgggttattctctcgaccaacatgtgcgtctcatgttcaccttaaactctcgtggcaactggaaacgcaacccaccaatcccacaaggttactacggttgttgtctcgtctttcctgttgcagaaacaacggtggctgacttgtgcggaaaccctctagggtatgcacttgaccttgttcgtaaggccaaattggaggtgacagatgaatacgttaaatcaactgtggactttctagcatcacgcaagtggccatctcttgttgttgatcgaacatacattgtatcagacataacatccgttggagatgacaaattagactttgggtgggggaagcgtatgggtggtggcataccaatggctggagacatcatgtccaggctaataagctattttaccaagtgcaagaatgctgatggtgaggactgtattgtagtgccaatgtacttgccaagcataaccatggatagattcgcagcagagatctctgtttggtcaatgaaacaaggaagtaaattcattgtcagcgcactttagatgcataaggcatgcgaggttgccaatggttataaaaaatagcaaataatgtttcatgctatttgaaatcaataataatgtcggtctttaatttatatgtatgggtacatcttgcatgatgtatgtaacacatgggtatgaatgtggagtcatgaataaaagaaattatccatcttctatcacacatgcagacctcatgttttcatattgcaaatgtggttgcccttatttgttgttcatgtatctataggagcaatataggtcaaaatacggccataccaaggcatcagcaatgtgaaaatataaggtgatattaaggcttactatggtcagtctcaaacatagagcatttaagggcacatatagtgtatataaaatctactccatccgttttatattataatatgttttgatttttttcctagttaaacttatttatgtttgattaagtttattgaaaaatctagcaacatctataacaccaaattagtttcgttaaatctagcattgaatatattttgatagtatgcttgttttgtgttagaaacatttctatattttctattaacttgatcaaacttaaagaagtttgacttaataaaaagtcaaaatgtcttacaatacgaaatagatagagtaggtctttaagcaataaaatattctttgtagattggacacaaacattatgagaatgggttaactcacaaacatatatctctaaaaaccagtaaattggtaggagaccgatctttaagccaaaaaaaaatacaatacttttcagcatactaggagtagtacgtacattatccaatagtaagtttcattttttcctaattgccgaacctaccttagtaccaatggaaggtattacggtatcaacaatgcatataaaaacagtccttatgatatcataaagtcatccatatatatcgtgagggtagtctatgtagaatacaattaggctagaactgcattctttatgggactgctatttagaaacaaaaaatttgctcaaagttcacatgtagtaacccatttagttaactcatttatttgtacccttggataattaacacgaaccattcatatattcagccattcaatcattcaacagaaaacaacacatgctaagagataaaatagatttttaaggctccttttggtatcatggtggattataataatcttgtttggtgcaatatgatatattaattatcaaactccgtacttcgacctatttgtaagcttccatttacatggaatttaaaaataagcacatcatagaatagcacaaccaaaaacttagccttaaaagaccttagttaacgaaacttctatgcctagtttacgattgaaattgttagaaaccttaatatctccaaataatggaaggaaacctcgacaaactatcacatgtttacccacattattctagttaaggtacaacatggaccgctctaagaaggggttaaggtacaacatgtaaccttgggatgaaatcatgtgcataaccaagtgtcactcaaatctttgtaacattgaaaggttgtgttgcttgcatggcctggccaatattgtggaaagatagactcctattgtcttttccaaagatcaacagaagaaatttagaaatctccaatgaataggaggacaagagcaataggctgctttgttggtttgttggggaagaagataaggccttagagaggacaaataggtaaagttggagtggactagactaccacttggtggtatggtgctctagatttcttattgttgcttttgcatcaaaagagtggttggaagtcctgtcaactcactactacaaaacaatttttcatagcacttcccttttattttttccaggcggactaaaaataatgccaccagtgaaaatcacatttattattaccgccagtgaaaaataatgccacatgtgcccattctctggtcctttggtggtatgtggtcatctatgtgaatttgattttgttacatacaagctatttcttgtaatgtgtcagttgatctatagttctgtactctcttcatcctaaaatttatctacctttatctgtaagctatactatggaaaggagggagtattgatttatggttgaattatcttctttagaaatagcatgcattggtgcggtagccaacagagcttaatgatgccagccatttagaggagacaacaatagcaagaggtcggtgaagggtgcccgacatatgtgtctatatatatatgtatatatgtatatatatgtatatatatatatatgtatatatatatatatatatgtatatatatatgtatatatatatatatatatatatatatatatatatatatatatatatatatatata

SEQ ID NO: 30130 - DNA, 24599 bp, Oryza sativa
ttagtattcatgccactaaatagttagccaaatggctccttcgaatgcaacctgaggatgtgttattttctcccctttaattcccaacttatactccctgttttctatgggcacgcttcccgaactgttaaatgatgtgtatttttgtgaaacttttctataggaaagttgatttaaaaattatattgatctattgttcaatttttttaaactaatacttaattaattgtgactagttttatacagttcaaaagaaaccatgaataaacattcatagtagagataaaaggtgataaaaggtggtgagcaagtgatcattgttggtcgtaggagcgagagagcggataagtggtcaataattaggtgggagcatgctgggaacgaattaaagcttacaggagttgaagtaatttgatacaatagcaatgacggccaagaattaggcctcaaataccctcgagttggcccttgcccttttaactagagaacttttacggtaccgtaagtatatactatcagtatcagtatatgatagggtagatttggtatttgttaaaaatctgaaaaggttgtttagtcatttaaaatagagatttatttccataggatgaattttaaatcctttggttgttttttactggatctcgtcatccgcataatttgagcaatttttgctttgtaatttgagcttgtaacagctgtttatttcagcccaactctatgctgcattgctccaaaaaattgtgctgttaaattggattctctaatatatcgtctaaagttcgaaacgatgttaatggttttggagtctgaacattcttctttcaaggccttctctggaagactggaacttgggagttgacttagatagtagtcacagaattgttcatacattagttatattggcatgtaaccatgctaattacgtacattagttatgctaattatgctgctctgccgctgccacctgccaccgctagtctgccgctgccctggtcctcgaacgcgccgatgatgccgatgacgaaggccgtggagaaggactgcatcgccgtgctgttggacaccctgtggaactggagcggcgtcaggaagaggcgttcgaatcgatttttcagcgccttgaagatttggggatttttggaagaactaggttttgggtgaagaaaaggtgagggaaatcgaatcgattcccgatggcggcggcgccgattgtggttgttgacggccgcgcagcgcggcgtgctcgcagaggcagtaagcgacggcggtcgcccatgcgcgcggcttcgagaaaaattcgctttgactaggcgcaaaaggccggatctgactaggtgagaaacgcgaatttacaaaattactcctcacgcaaatagataaaaagacaaaaatgccctattcaatttatactgcagaataattgggaggaagatcagatgaatttacatcgttagatcaaatatactggtagtatatacttcaaatagaatgtaccgtaaaagtcctaaactatttgtacacgaatcttagacaaccatagcccactgattggtggtcccctgctgttcaacatatgtagatatatatctttggatatatcatgctccaagcacatgccatacataattatatctgtaatgattcacgtttagaccaactggccctctccagtctccacatacaagttcatgatctcattccctacacaaagatcagaaagagagggagagatcagaagccatttgttggcagtactaaggcccaagcagacagtgtcccccacccttgagtaaataaaaagaagattcttggggtacaactcaagttaacacatacatgaatgaacatcataatacctgaccggttaaatcaccaacagtgatgagtgagatggatgatattaacatcaccagtgtctacaccctttctactttccagtgttggatataaatctttgtttctaccattcacacacaagggtgggtaaaaatcgcggcgaaatacaaagtgcaaatgtgcactttgcaggggcttcataatgggcgcgtgcgcgctagctgcctaaccagcgcagccgcgcacgcccccttcttaggcctctcctcctaaacgctaataatgccaattagcattgatgatgttaattattgctaataataattgttagttttagttttttaaaaaaatcataattagaacttttcactcaaatttgaaaactttcaactcggatttgaaactttcaacccagatttgaaaactttcgactcacatttgaaaacttttaacttgctatttgaaactttcaagtcaagatttgaaaactttcaactcagatttaaaaaaacttttaactaaagatttaaaaactttcaactcatattcaaaaaaaattaactcaaatcttaaaaactttcaactaaaattgaaaatgaaatattcaacatctaaataaaaaaatcacgaaaaaagggcaaaagaaaacttaaaaaaacgcgtggacatcgcttttccagtaaaaaaaataacttacaacgtggatgccgttcgcttcatgcatgcgccaagttatgtggggcgtgggcctcgtgggcctaaaacacgcgccgccaacgcgcgcgcaaattagctctcgcgcactttgcatacttggcatgatatatttagggccctttgactcgcaggattgagaaaacgtaggaatagaaaaaatgtaggattttgataggaatgtaagtgtaaaacaaaggaatgtaaaacgcataaaaaacacaggaatgaccgtttgactgaaccgttaggaaaacacgggaattggatgagagagatagactcaaggaaagttaccaagaggttgaagctcttgctaaatttcctccaaaatctctataggattgtccattccatagaaatttcattcaatcctttgtttcaaatggctttataggaaatttttccataggactgaaatcctctaaaattcctatgtttttcctccaaatcgaaggggcccagtttgtcgtcgtttttaaccacacataatgtaccaactctactaaaatttgatagttccaaaagttctcccacaaaaaaactattgaaatttggtactgttaaaaaccaaacatattaaatgctaccaaaattttgtaatgtcaaaatctagacagattttagtaagattgctcgacaaactgaacaattccttagttacaccacagaaggtatgggccaagaagtagacttttttttaagaaggggagtagctgtttatccgagtggcaaaacttcaggataaaaatccaaaggcttgtttacaatttacagatgagttgaacagatatcagtcaaagccactcaaataagctgggcctactagcccaacatttcctctctttcagttacacttgggagtactactctataggcctaaatgtcatttagagcaagtttaatagtatagcccactactagttttaattcatctatagccaatctaatagccaattcatataatagttacttattatactatgaatatatggtcccacctgtcataaacacattgcgtcttggagtccgtgttgcagctggctacagatctgtagccctctgcttttctctctaatcatttatctcattaaaatatatttatagctggctaatagtttactatcgtacctgagacagcgtatccagaaccattttggctgggctccagaaagataatctctcggttctattggcaagcagtgcaggattgtagctcattaatgcccttgtctcctattcagcggccagctactccacccctacgaggtagccactccctgacaacaatttcatcaactagtagtaaccctagtagagagaaaaagcaccaacccatgtcttccttttctgccttccatagacacaagaatgctcggacgtgatgattgggctccattatttggtcagcactgtgtgggctctcatgtttgtactgccctaccttggcttcactgatggctgcttgtaaaagaaaaatgtccctttgtttccttctgaacaagaggattcttttaaccttttctagtgagtaagaaaagtaaaaggagaggatgaagagaagctgctctgaattaatcagatgctagctagaaagaagaaaagtctgcacaaaagcattcaaactaagttattacttctactcctttctctatcccaaaagaagaaaagtatagtatagtttttaatgtgaaagagatagataatgatctaatcaacttgagttcttattccatccgtcccaaaataaatattactcccccgttatcacatatatagttataagattcaaattttatacactatataagtatatatcaaagacaactattccaatgcattggaatccaagcattttcaaccaattaggttcttctaaggagaatacaaataattcagaatttaaaaattgagcactgagatgactgaaagtggatctttttctttggtaaataacttagaaatgtttatatttaagattggatggagtagcttaatactttaatctacatggtttcttaccatattaaggcacgtaccaaggacccatcaattggctgattataatctataacggcttatgtgcgatatatctttagtgacttaaaaatctaatgctgaaaaagaaactaagtaaaggaaatactgtaaaatcagcacaaaattaattttcataggcttattctcggtaagcaaacgataatgctgcaaaacaaaaaacatgtgacagtactctctctggacatgtcatatgcaggaaatctgcgtctgattcatgtataccccggtaaggagcgcgctcacacaagtggcagttgcgcgcgtacactgcagagagcgcgcggctgcggactgtgcgtgcgtgcggttggctgccgcgccgcgccgccggtttctgacggacggcgccgtgtcctcctcgtcgctgcggcagcaactactactgcctctcacagatcgcctgcttctgtctcacacatcacatggccctctcgacacggcgacgtgtaggcctggagctccacctgatccccttgtgctggttgctgccacacggatatgatctgctcctcctcctctgctaccctgcccttttttcttctccatgccttgcactgttgcttccccaactgctccaaccattctcgggattggaggtagtagtactggaatctccttttgtgtggggtttacagccttacggttttccttcttttttgagacacaccctttgacagtaacagttaaaagagcaattggatgcagcactgcactgtagttgtcctggttatccattttatttttaagctactatttacatttacaagtatgtaaattttaataaatcagactcatataattagaaatagactgagagcccatacttaacgagtcataccatataattagggagaaatggtggttacttttcacgtatggacgcgctgtgtgtgttgggatgacaggatgaaaggagaatgattctgtttttaggacagtagagatatcctgcaatagtgaaagatgcacaaacttttatctggaggtcctcaactatggaaggatccacatgagcttagctgtttagccaaatctctgctgattcatatgcaccatttctgtacacacgcagcacagtagcaaaggtgccgtgcaaagtgtccaaaatataatcaccacctgatatgtgtgcccgccgactcgcattgatcacttgccgacccagctttctttagaaccaagcaagcaacacaaggggtcgcgagaacgaacaaaaagtgaaaaaaaaaaaagaaaagaagctcatcactactcgcagagagaagcaacaatgggattactgagtactgacatggattagccgtgtctccccaaagagaaaaaaagttagacgaggttaatcaagtggccatcgatcaccacggtctctctctttctctcgctcagcgatgatgctcttggtccggaccaaaatacagcagcagcagcagcagtacaaagctctgacgctcgggtcccacatccgtcagaccatccgtccgtccgtccaagattcaggagacgaagcccatccgttggatggaccaaaagatgccgcggtcgatgcatatgtaaggatgcagatgcaggcagcatgctgtcgtcgaccgacccgatcgatcgatcgatctgtctctactgcagcacgacatcgccgtctcacagggcactggaaatgatgggtcgcctgcctgacctctctacacaaatcttaagcctagagacagacactgatataataataaatagagattgaccgggattttggtgctgtttgttaatggtgaccatccgacaaaatgctctatcaccgtcctctgcgtcctcgctctgcaccgactgattcaccacacttcacgttccacctcaccggagggtaaatacagcaatcaccgttccacacatttcgtacaattttgcttgtacaaaagctgatcaatttcgtgctcaaattaatagtacaaacccagccgaaaagcgctcacaaagccaaacaaacactcaatgtagcagcagcagcagcagcaatcagcatgagtgcccaccattgcttttttttttttttggtgccgtcttctccgtgttgttcgtggcacaacaggacatgatcgatcggtcaaagggtgaggggagaacgagacgacggtgcataaaaatcaaatggaatggaagcgagaagggagagaggagaggagcatgcatgcatcgttactccagtacgctgcgtacagcggccggccgcgccacgatctcgctgtctgctgctgctgcttccaactgctctctgctctgctctgcttctgctcctctcttcctctctaaaaagcgtcgccccaaccaacctgccccgtcctagctaaagccatagcagtaggcgggctacgcatcatctcccgatttggcaacacccatattgctgcagtgcagttgcagttgttgcggttgcagtgcaagagggagaagaggagtttcttggtgagggagagggagagatgagggacgtggtggtggcggttggcggcgggacgaaggcggcgagcaggcagcaggggcagggcggggtgacgttggcggcggcggcggcggggtcggggtcggggtcggcggcgtcgccatgcgcggcgtgcaagctgctgcggcggcggtgcgcggcggggtgcgtgttcgcgccctacttcccgccgggcgagccgcacaagttcgccaacgtccacaaggtcttcggcgccagcaatgtcagcaagctcctccaggtataccgcacgatcgctgcttcttctctcaatctatcgtcttctctccctagctgccatgccatgacatgccttgccttgcctcctcgtgtcgtgtgtacgcacgtctcacgagccctcaattccctctgtttccgtctacaatctctgtaccgccttctttctctgtatcatcgcgctcatgcacacacagacacagtcgagttactaccagttcttggatctttttttccttttcagttccgtgccaattcattagaaagatgtgatgtttcttgccattgtttagcccacagtttgtcaaatgtgtagtagtgcacaaaattgatatcttgtttcgccagaaatggattgcttatttttaacatatatggttaagaaagtttccccgggccataacgacgatgctagtactagggataatattggtttagtggtttcgtttgattacggtgttttcccaacatgtagcctgcaattctcaggaaaaaaaaattgaacgaaggcctgataatctcagaatgatatactgtattagatggtgtaatagtagattctgaatacaccgagattttgacaaattcggcaactatattttctgtttactagcagccagcctaaattcatttcctgggtatgccaagttcagaattgaactttcagaattttgcacttgttcttcagttttcaccgtgagtggcacatgtactgggcatgtgcatcaaaataaacatggcaaagatcctactttcactgcccactgggtcctcatccatgcagcaacccaaagcatttcttatgtgctaaagatcacctagccaaagaaaagaaaaagaaaagattgcttttttttttgtgagcaagttcgagtactgcagtgtgttgtagtactaattaaatcgacagagacctcagcatagtgatctccaaactgaaccctcccccatgtgtcgagccgcctgaaacagtagcccatcagtggtggtatacggcctcgtcctcacagtctcagcagccttgggcagtcaccttcacacaaggctcgcacatgctgcgtaaaaagaaaaagaaaaaaagctttcggctgcaccaaacatgcaaaaatgtccctaaaaatccttccttccattcccttttcttggaaccagagagacacccccaaatcgccaccatcttttctcaatttcttctccttggccctagcctcctagtagccttgtcacaatgtcactggctcactgtgtgtgtgcttgcacgattgtcaggtgggaatggacgtttcttctaccttgtcatgtactggtgcctgcacaaaaccagatcattcagatgtgacttgactgaaactctgctgctatgacaatcatatgtctgaaactttgggattgtggtggaatgcaggagataccggtgcagcacaggggggacgccgtgagcagcctggtgtacgaggcgaacgcgcgggtgagggacccgatctacggctgcgtcggcgccatctcgtcgctgcagcagcaggtggaggcgctgcaggcgcagctggcgctggcgcaggcggagatggtcaggctgaggatgagcaacgactacatcggccgccgcctccgggcgcgcggctgcgacggcggcggcggaggcgaaggcgggagcaccaccaccaccaccggctcgccgtcgtccatgtcgtcgccggccaagacggcggagccggagccgctctgcaagcccacgccggagctggacatggtggtggaccagccggacttcggcttctggtcctactagggctttgatcaaggtagtactactagctgattgtagctgtgatgatgatcaggtgatgtttttggagttaagtgacagatggtatggtatggtatggtatagtagtagttcatagtagagtcaagcgagtaaagtatatggcaatgtgtgcgcagtagcagcgtgacactgggagggaggtgaacataggcagagaggcctcctcctaaaccttcttctactgggatatatcaggggctttttttttggctgtccttctatgagaaggtagaacactgttacagacattgggtgtgcattcactgagttgtgttatccattgcaagaaactttgttgctcgtgacaatttacttggttgaaatagctgaactatgctgtgggaaatgcagatggtgctatctatgtttgtacaaatgttctttgattctgggcttgttttatgacatgtgacccattagcagagatgtaaaatgctttagtttgattaagtagatatcagactaatattgcaacttaaggttgccatgaggcttaaatactttcacgattgtatctgcaattttacaaggctggctcccatggatactatgggcaatgaattgctacccattttttacaaatacataaataaaacagacaccctgatgtcggacagaccccatcacttcataacctaatgcaggttcatatgacccaaaaattgcagctgcatattggacgccacacctttagatgcaataagttaatccaatcgaataacttcacattatctgcagttcttacaagaagttagcataatttgtcatgataaaaatttctcagcatatgaatcatggatggtgaaacactttatttttgtaagaaaccttaccagaagcgggaccaatgtgaagcatatgctctatggtaagcttcggttcagcaagccttggaaagagaggtaaagatctttgttgtctggaccaaagatctcttcagccttcttgagagtatcctggttcagatgtaaatatgctattgtaatcatgtaatgacataatgtaatcatgtctcataaactagccaacagatgcaagtgtggtacctctcttgattgcttatgagcattgagttccttgatgttggctaagaatgctccaaattgttcgtatgataggcggctcctggaattataatagagttctatcaatgataatacatctatcttggtttcgatttaaaatttgaagcgcaagatatcaacagacctggcctgacggaaaaattcttttccatcaatacgaggagtgcgacctgaaaacccaagcattatattacattccatacaatagcttcagaaaacatataccttcagggttcaggataaatgaaacctgggttgggacgtccccttggaggtgagttagctgctgacgattgcttgcttgaggggtaccatggtgtcatggacatgtatccttcaattcgagtttttgatggtgaagtagttccagacatcaattttggtgttgctgttgtagacattcttctcggagaagcagaagttgacataatttttggtgtagcttctggagtaaggcggggggtgatgtgtgatgagagggcatacttctgtattggaggctttgacactgtacctaagagaattagagaaaattcagtgcatggaaacttatgttgccagaataattcaacaaaatcaaaacaaacaatgagcgaaaagctaataataccttcttggactgtgcttccaacatccagagaggtgctcagtagatttgttgtagtgtgggtgatagaatctccatctgcaatgttcaatgaaaatattagtgagagattggtgccggacattttctatgacaaatatatgaagggcattcgaatagggcaaaacctccacaagatgatgcttttgatgatattgactgatcacatgtggtaatgtcaaccgtttcttgtggctgcttgggaggattcagcagagaatcaagcgcaaagaacaaacattactacaagctagagaagaaataataaaaatggaccaataattgctcatagtccattatgggatccattggatgagtagatgaactcaccgatggactatcatcacgtagtgactgcatcagatgcctcttgaaggactccagctgatagaagcaaagcaaaggaaagaaaaaaacagaattcagagtgttgtagaggttagatattagaaaagacagactgataagctgaacaaacatcttactcattgcttaaacagctcaaaagaaagtgaaaagaagaacagcgcctcatttttttcagtcctaaaggagttcttgcatcccacagtgggattaccactatttttgtgatcaactatccagggatcaacatggatgtgggattggacgggcagtattcatttcagaagaaaaataaccagctgatggacaatctttacttgcctttacattggctgcaatcagcaaaatgacccttcttcgctatcgttataaatggcattaaacatctaacgaactccatacttactccctaactcactccaatttgcagcataaaagcgcactttcccctgcttctcctaaaattaggcagcattcgtttggaggacattgagggagaaagcatctcgttttctgcacgcacgcttcccaagctattaaacggtgtgttttttgcaaaaaatttctataggaaagttgctttaaaaaatcatattaatccattttttaaatttaaaatagttaatactcaattaatcacgagctaatggctcacctcgttttgcgtatctacccaatctcctcaatccccttctcctcaaacacacccttaatcttcatagatagttcaattagaggcgtctagtcaaaggtggaccatctaataatacaccgacagacatctacaagcaagcattcgaacaatgaagaagatcaaataaatcaccttctgcaggtcccgcgccagcttcttggacgtctgcgccaacgagtcccgctccttgctcagcttaatctgcatccacaaaagcagacaccgaaatcaaatcaacaaatcgaggggaaataaaaaacattaacacaagagagccgcggggcgccaccgacgttatcctcgagcgcggcgcggagcctggagttggtctcctgcagggcgcggtcgagcagcgcgacgcgctcccgcagctccccgttctcgcggtccttgtccgcggcggactccctcagccgcgccgcctcccgctccagcccggtcacccgccctgccacggccagcgccgtgatgcgccgcgcaagatccagctgctcgtacgggtcccgcggcatcaccgccaggacctcgtccgccagcgcgaactccccctccgccagtggcattgccgccgccgccgccgccgccgcgcccgcgcgagatctcgcccgctctctgcttgggtttcgccgccttcggaagaaggggaggggagaggagaggagagcgcggagaagggaccacgcgacgccgcggagcgcttggagattttcggatttgaaatggggggagagggagaggcggatggggttgggggggacagtgcagagcggctcggcggccgaagcgaggtttgaaattgtttttgggggagagggcggccgcgttggcctcgtttctgttgttgagtgggcgcgcgcccaaagtagcaattgtttgaaacgacccgccttgtttccaagcaaaccccctctaaaatagtagtacttgggtgtgtttagttcacaccaaaattagaagtttggataaaattagaatgatgtgatggaaaagttgaaaattcatgtgtgtaggaaagttttaatacgatggaaaagttgaaagtttgaagaaaaacttggccttgcttggagcaaaattggaaacgttttttcttcgctcctaaggagtacttaggctgagtttagttccaaactttttttcaaacttccaactttttcatcacatcaaaactttcctacacacataggggctgtttggttgatggtcataagttgccacacttgaggttaggcaagtttgaccatgttaggtgagtgtttggttggctcccataagtgtggcaagattcctcttttgtaatctaggtctcacatgtaactgactctgaaaagtgtagcatggttttattttgttggctagagtgtggcttagattttgaaggcctcacctttggcaagtttagctaagagaagtatggtgaacctaggcaacgttagtatgtgaaccaaacagccccataaacttccaacttttccatcacatcgttccaatttcaaccaaactttcaattttgacatgaactaaacacacccttactacgtacactatggatgtgtttagttcctgaaaaaagttggaagtttatatgtgtagaaaaatttttatgtgatggaaagttaggaacgggggaaacggcctataacagatactacacatataattagaaatagatcaaattaacttcaatggaccaggcccatatatttaagaagtgacggtgattatgtactaatgcactgagcatgttagcataaggggatggaaaaaaaacaactccgcttttaagatagtataggaaaaaaccataaatgtataggatttttaagaatttctcttctcccaacatataaaaacctaatttaactccctccatccttaaaaaaaatataaaaaccaggttcagggatggagggagtacacaggaacgttctgattttgattcagattcacctgctattttcaagtgaaaggatgcaaatccctcctgttgcatgcttccaaaacgtacatgggatttatgggccattcggttcagttcggtaccaaatgcagccaaagcacgccttacacatcgaaacaatttcccgtgacaacattcgacgaaagagaacaaaatcacagagccatcggtaaattgtcttgtaacaaatccaaatcgaatataatttgtcagcacaaaattgcattgacaagctacacaattcttttgtagaacacacaggagcgcagcgcaagcctgcaatactgcatgttgcagttccaacctatatagggtacaaaagatttcaacagaaaaagcaaaatgagatgagctgaagaacatttctgtacaagaataggccgggcttgcccattcagacggtagggaatgtacacatgtcatgagtaggtacaattcagcaaccttactcaacaacgaaaaagaaaagaaattaacagattctgcagcttaacgcggtatgttcagccgacacaagtctgcaatgcatattcgtcattatcctttgatggtggagcgggcaacatatcagcttgcttaataacataggcaactttcgcccaaccgccctccaccagtgttcttcgtctgcaattcccttctgttttccttcctatattttctatgttacctgaccattttcatttcgaggtggatcagtgtaatcttgaccatgatcacggacatctctaaacatagagaagaaagatactatgccatcagaagctccgcctcctagcaaccacaataaaagggaaccaaatggattcaaggagccagagcctgccggagcattgccaggttgctgagggttttgatcttgatagtgcagaggattgttggccactaactctgcattttcaattggttgaccctcttgttggttcctgttaggctcatccggaaccagcagggcatctgcttcacgagcagcaccaaggccctcattcattgcgccagggtccctcatatttacccttgctatatgtaatgttgatgtatagatggttgaggatgtgatctgaacacccgtttgttggtgaaggtgagctcggcttctaatgaatctctgaagggctggcacctaaagcaacacaagccaagtaaatacaatggggacatggactttttttttgttttgctgttaaacatgcattaaatatacaatttgtcccctacttgcgtgaaccctaatctatttcctcagtgaattgaccaagttcaggtgatcattccagtttaataaatgaagatgaaagcaaggctagcactaaatcctaagcagtgttcagaaattagaaatggcctaatatcaaaggggaaaatataaaaaaaaattgcaggccaaagcaataaacaagcagtaatgactgataagtccaaaataaagaacaggaaatacacaggtaaaaatgcatattagcatacctcgaagcggttccaaaaatataaaattagatgttgcatgaacgccgcggtggcagaaaaggccaggtaggagaagcctgataaatacagaaatatgcaagtcatatatcgataggatattccagtagtttcttgccaatataggtcaccaaaaagacatatgtagtcataccatatgtgtacgagaagaagtaaatgtggaaaaccaagaaatacagcaagaaaaagcgcgggaagaactgcattgatatagatgtcctcacactgcaaaggacacaaaattcagtaaattcagacagaccgaatttgctatgcatgacaacaattctgataatgcatgcttgaaagttgcaaatgttaaatgcacctatattatgctcaagtgcctactattctaatctaattgctctctcatatgactaaaccctgtttgtttcctcataatttcacatgaataagttagtaggacagacgcttcacagcacagaaatctcacatgattaaaatagtatttcctcgaaatagtaaagcattccagcaatatgtatatggaaacagtacctgatcatcgtaaatagctcacacaaccatacaagagtcaaaactagaaatgcaagcaactgatcatcatagaactcaaatagaaaaaagaggatcccaatcattatctgcaatgatcacaacaaagaaattagtaagatatgagaaatctgttgagtagatacatctaaacagccacaaaattttcagctcattaaggaaaaaaaatatcataccggaacaaaaaccaatgattcgataacatggacaaatatcagttgaaatgtggggagttggtggcgtgcatgatgttgaagctgcactgaaattttcaatgaagaaaacaaaatattatttattaccataagataatatcataataacaagttgagcatctagcaggccaagaaacaacgtaaagcaataagcacaaacctgtgaacctaagcatgcgggattgcgtctctctcagggtaaatgaaacagacatggtggttgtgaaaaaaacaaagagtgacattaaaagtacaccacatttcgtcacaaaataatctgcaccacaaaagttgcaatagataagatttaaatacgcagaaatgaaaataagatatgaaaggcaacaaaatagaattatcaggtggcatgtaagctggtggaatcatctggtacaaatttataaagcattaaaaccactaatagctgaacacattataaaagtgcagtcattcaggtgaacatatttgggatggcaaattttgtaaaatcagcactatacaaacctccaaatcttgttggacctgctggtggttcatgtccgtaactgagatcataaagctcctttgtttgaaagttgtataaatagcctgcatatcaaaccaaagtacaaaatatgtgagctaactaagtttgcgacagttgcatagaacatcctgatagttaaaagtaccaaaagcaaaatcacatcagaagcataccatgaccaggggagttcactaagctgtttgtaagtatagtgtcatagccaacaatgctgttgattaaaagctgttgccacctgaaaggttaaaaaagagagattggatagcataagaaaatagcggtgggcatgaaagaacagtggagcattatcacattctgcagatacccactacagaagcaaaatgaaagaagacagaacgaatgcaaaatcttgtttaagttctcaatataaatgacagatttttaagtagcaattagatattccatatttgtaacgctagaatttttatgcagctctttgaaactcagtaaatgttccaactatttgggtacaagagcaatataaaacaaagatcaataaacaaaatgagaaaattccttgcatgccatccaaagtccttacacgccatccaaagtttatgagtttgtttcctaatatgccatgtcgaaattattgttccattcaccaatgcctaaacttctcttgccttttttttttttgccattctcatcatcctaatgttagcaaactgttacatgggcggtaagatgaccattgggccctccatatcttcttcaacttgtctccttcctcttccattctttcacgccacttcactgcgcctacctcccatgcaactgctcccccggttgcacatgctttctcgatctcattgccccacagcacacaaccaggcatggaaggcgaggacagcaccaccataccatctgtcatggcatcacagcagatgcaagcatgtgtggtatgcagcaatctgaatccattttttttcttcatgggcacggaaatgaaccccagtctgcagcaggcgtacatacggtgcccgtgctcctcctggcaacccccctcccccccccccaacaaactctctctctctctctcctctctttagacataacaaaacaaagcaagcactggtatctagccataccacacatagaatggccttgctaagctgccagttcaacagaggtgggaagtgagctgccaatccaccatgcggttcacgccatcataacctagcctcactaggtgaagggagcagtgatgttgaggccccagctttcgcatccaatttgggaggaactctctgaatctatgcgcaaagagtaatttcaccattatcacaagaaaatgataatgttcctagctgtgattgttgctagctaacggaagagcgacgtggatggcaaaagagggcaaaaaaatttggttcgatggcatatggtggaatgacagcttccaatgcatttaaaggaactcatgaactttgaatggcatcaaacaagtagacttgccagagcaatgaattacacaaacatgaacttttgggcagaatcaggacataaaagttagaatctaatctaagtagcatgaagtagaaagatgtcaagtggaaacttttggagacacatctagtgtgatatgcccattatgaggagcaagtactcgataatgacctatttccaaagcaaggatttcgagcagaaattgtgatatttatagtccgaacaccatgacgaactttggccccttctgaaagcaagaaatatccctgcaggaaagaaggcaacatataagagagttcttgaagtgagtgatagttgaattctccagtcatttctggcaaaagttgattcttactttgctagggagttcataaagaagtaatcaagcaacttaacaacatactagaacaaacataattaagttgaataggtgataacaatatgccaaaatgaaccttaccttctccacaccatataaataggtaggttcaaatgctttgcttcgtctctcaaaccactgtactgtaataaacaacataccacgagaagttagagaaaatgagacccttgtgagttgacagcaaagggcaaagataagaaaagtcatataggcaccactagatcatatgaccagtttactgccagacaacatacctattgttgaaacaagatgatccacgcttggtaattgaatacccttgatggtatggaggaagtcattccagtttgatctgaactgttgttaaaataatcaagaaaaaataaccctcggtaaatgagtgcatgttactttgtttaactaattaagtgatacagataataaaaagcacaaaaatcagcatcacacgaatcatgaaagagtaacttgatcaaaataaatgttatttcactgcatggcattcaaacattccttaatccaaaacttgatgaatatcatttatatgagtaagacatatgttgacaaatcaatactactagtccacaattctccaagtgttcctcacacagcaagttagatatcaaggtgacatgcgccaagcaaccacatggactaactactactccattacccgcataaatgattctcccaggtccaactatacaagaatcttttgtaataccagagtaacataaagggaacatgaatgctgaaatgataacaatcaacttcttaccattaattgaaaagtattatctgaaagttgttttatattcctccagaacgagacaacacgaaagtaccactttctgaataaatacataactgctgctttaaatgattcttttgcggataatggatggtatgcagaaccctccacagttgtcttcgaatccgatactcctgaagtggttgcggtaatagctgtgtcagctgcattctctggttgtggttcaaattccttgtctcccttccaagttctgaacataattttgctccttctagctccaggaccaacccaagttgaccaaaacttagatgccaaaatattgaacctatcaccattaacctctagaattttctcagctgaacgccccaggttctgaagatccataatgtaggatgcacctttgctgacccatagtccaccactgattatctacaaatttaaaggcagggaacaaacaagtcataccaataggaaacatgagctagtattgcaagcaagggaaaaaacataaggaatattatcacacttgagtcccaagtgcaaaaaggagaaaatgctcgacacacttcacagaatagcaaagagtctaacagcaagaaatgcaaaatagtgacaagcagcaatgtgtaccttgatttggacaagttgcgcttcaccaaattcaatcccagaaaactcgcttgaacagccaggcttcacatgaaaaaggtaactcaaagttgtgaggctacatatgcacactagactattatggaacaaggtaaaggaaaaagaaacaaccagataaaaaggtttggcatttttctttatttcaaatccaggatattgtgtttctaagttgaacaggagatagctttcagcatgtaaatatatatgaatgatactttttaggagatttaagggttgtagttgcatgcacttacaagtaagttatgatgtgtgcacaacgcagtatacttaagacatggaacggaatggtttatcaaacttctattttgttctagtttccacgtggtactaaatcaattgcataaggatcaacaaacacgtcaaactggatgcaatctacgttaacactaacacattcctagagagtatataatctcgttcatttgaagtgcagtagtatttaccagaataggaggggatcactactacaaagttagcttacgtagcaataccctcatgctttttcatctcgatatgttcacactataacagaaaccataagcatattcatacacattcgaagaaaaaaaaatcatcttaaagatttcatattaggcaaaccaaatgcaaatttggcatgctgtttctgggggagcaatgaatagaggaatagctggcatatcatagttttacagtagcgtgggactattccagaacaagcagttgcagagaagaacaaaaaactagcatacaccaaatctgaaacaatgcggtattgtaagtacctctgcaggactaagccagaagccaggatggtcaggggatcactaatcgaaattactgttacattacaacttaaaaagttgctaaaattataagtgtttcctattcagtagccaaactagagaaatccagcaactactgcgcagtgcgcacacaggtaactttgatactagcctcaggcttgctcaattttttaccagggcgtcgaattgacaacattggcgaacccaggccagggcagttcgcacaaaattcgcaacacccaggctagcacgaacgcgcgcagtacaagcacgggcagaagacgaagaagggcgaggaggggcgggatgctcacctgctgcacgaagttggtgtgcatgacgacgagcaggcagaagagcgcgacggcgccggcgaggtagaggtactcgagcgcgaggcggatccgcggcgtgagcagctgcgacagcatcccggacagccgcgcgtgcacccgcaggaacgtctgctccggatccatcccccccccctccgccctcgccgacgccgacgagccccaaaccctaaccaccgccgcgccgcgccgcgggcactccacctcccccgcccgcccgcctagggatcggaaaattcgaggcgttcccgatgaaactggctttaggcgacggtggaattattcgggggaaattggggagtgattttgaatttgtacgtttcgctttcccccctctctctgttcctcgcctctctgtcgtcgcacgagcactgcgagcctgcgattatctctgcgaggattctttcttggggaatgggccaagaggtgggtggggcccgcgcccgcaggaattttttttttcctttttttcctctggcgccggcacgttggttggccctggctctgcgagcggttggccgctgggattaggccgccacacgagcgagattttcttcttttttgtgtgatcggatggtctcgcgttattttcggaggagatcggacggtccagacgtccactttttttgctggcttggccaccaatttttaccgccgtggacaaattgattttcgcgtaggaagcacatagggtgatcgcgtcgaactatcggagcaaaaaataactatcgttttatgttgtgtgatgcttatattttaaaatttaccattaaaataaacggttggtttgttttacagataagagatgtggttagtgcaaatacccttatacattgtatattgtcaatttcaattatgtacaacataagtttaaaaaaggagcagttttacatcctcaaggagctatggtatcttttttttattgtaaatttagtatctcttaatacctagatactattaggtactaaattttacattaaatttttgatgtatcataatacctcatcaagaatcgtaaaatttctcttaaaaaagttaagtttagcaaccacttaaatgttcaagcataattataccaaacgagatcatcataatttgggataacgctagccggacctgaaaagctggtggtgaacagctcggcatgaattttagaagtgttttttgctggtggatgcaacctgataattggtgataagattaattaatcttctttcttaagttcagtagcaatgcttgaagcgctatcaggaaaagagaattgcaacatttaggaaaagaaaacaaaagagagctttttatctcgaaggatacgaggtggtgggctggtttccttccggaaacagatcaaagtgggcctctttccccgtgttggatataggctgtgttcggtgggagtttccagcactttcttattttcggcgcgcatgctttttaaactgctaaaatatacagtttttttaaaaaatttctatagaaaagttgcttaaaaattatattaatctattttttaaaaaaatagctaaaacttaattaatcacgcgctaaacactacttcattttacgtgcggtgagtgagccatagacgtgttagacccaaacattaaacggtattaggcactactatttgcattggaaataagttatttttcaatttgacgtgaagttttaaattcatttctcaaaaaaaaaagatataacgtgtctttcaactccacaatgtaaacttgattccaagatggtttgaatgacgatttctgctaaggtgatatctatgtggctagtttgattggggttatcatctcacatgttgttgatgtggcacttgcaatcataaaaagtcggtaggatccacatgtcagtgattatatggttaaaaaaataaaaaaaaatacaatgggtcccaccttttttttcctttctcttctcttctttctttcttgcttcttctcctcgttcccttctattcttcttggattattttttagtgtacctttttctcgctcacgtgcccaggacagacgccggcgcggtggcgggaagcgacagaggagaggcagcacagaaaggggtcgccgtgggctggcgtggccgagcgccgcaacgccctggtttggccagggcgctggtggcaagtaggcccgttgggcggcggcacagcagtgggtggatccgtggatgggcagagcgaggaggttgctcgcccttattggtagctcgggaggaataaacggccacacgacgatagccctgaatcaaggcgaagacggtggcatgctccggtagcatccctgagcagtcgaaggcggcgtgagctccatgcaatagcatcgacctcgatgccaactagctccattgtgaatttgtgacatccagattggtgtctagagtgagctggccttcgacagtgcacctcgcatgtcgtcatccaagtcgtttgtcacgtgtcgaacctagcaacaaggcaaccatgtcgatgctgccgccaaactcctcctccctcccgctagtggctgcgatgtacaacccgccgcgtccctcctcttcgccactgctccccaaccgtctggacccacgcgtctggaaaatgaatatttttatatgcgggcagcccaaccgtacaggataaacatttttccatacggtcggattaagtggaccgcactggataatcgattatcccgtacggtcaatttatatctcccgcacgcaaaaaaaaaacccaaaaataaaaaaaacgcgaacatcgtcgactgcccgcatccggccgccgctgcgagccgttgagcctgcccgcctcccccgagctctacggcgaaactcgtgaaactactacagaaactcgtcaacgagcggaggagaaacttatcgccgttgccgtcgcgagcccgcccaccgccgccagttgcgtaggctgccgcctcgcctggccgtcgcctcgcgcgccgctcgctgcttgccgctccttcgccgagcaacgcgctgccgcggccgccgcgctgtccgccgcccgtcccgcgcccgccgcagccactgcgtcgcctccgccagcagccgccacaccccttcgccagcagccgccgcgcctcgccgacggagccgccgccgcagccttctcccgccgagccgctactccctcacggggaggaggggagggggagcagccgccaccgccggggccgccgccgctgttgacggaggaggggaggggaaggaggagctaggggaatggttgagaagataaggtagagagagagaggagtggttgagggagaataaaaaggaaaaaagaagagagataatgtgaaaattttgaagtgagtggaaaggaaatgagttaagtttttttctgtgcgatccacttgaaaagcacgcacgtgaaaat

SEQ ID NO: 30131 - DNA, 3313 bp, Oryza sativa
acggtacttagatctactcatttccacgcgaggtatgcatttttttaagcttttagaccttaatttgtgatgcatttatgcatccaaaattttgaaggaagagagcaccatgtttttaaattttatttcgtgccatatgagaaagaacccgccgccggcccccctattttttcgtacggttccacttacggaccgcatggaaacaaaaggaggcggtgtccaaaaaaaatctatcgtgtagtagtgcctccttcttcctccacccaaccatctctcctaccccacgtcctgctcggcctcaccccgccctcgctgttgtgtcggtggtgccttaggggccgcagggcgtattcgcctccaccttaaagtgaggcccactatatttttttaattttttaacttagtactcattgatatgtgggtcccttttttatatgtcgcgtaaacgtcacgtcagctaaaacagttatcgatgcagtcttagaacaaattttacactagtttagaagttgaaagacacattatatctactatttcgatttagggactaacttataacttattattccattaatttgcatataaaattcggcttcgtccctcccggtcccggcccacaagagcacgtttaatacctgccccacctctcctccggcgaccgatcggtctgttttccttccccggatttgttcgacgcgcagccgtggcacgcacgtgtacatacgctcgcttcccacggacgtcgcggacccaatcggtcggcggtgcactggtgcagccgtgcaggcaaagataacgcgctgctgagcgcacacactcgacacaccgtcgtttcatcggtgacagtgctgcatacgagtacgacgctcccctgcctcgtaccgtcgagaacacgaaaatgatacgatggcgcgcttgtcgatctccgacccgtcttgcgcgctgggcacgttgatagatctcgcctgggtgacttctcagttgtcaacaacagctagttagcctaccactgcattcttcaggtgtactactggcaactacttcctccgttgttcatctgaggcctctcatattgcaagctatggggcccatacccctagctcaaaaagttggcctaaagacacccaccccacagtacaagcattcatatatgtgtggcttaattggatggagacacttatgaaggaaacgaagttcacagttggcgtgaccccaggcttttggacacggtagcggagcaaaatttattcctcacataccccactctccaacccagcacgcaacggacgcctcgaccgcttcgctctctccaacccctcatggcggcgggaccgtccccggcggcggtggctggcgtggcggcgggaggcgtcctcggcgggagtggctggcgcggcgacggcgggaggcgtcccaggcggcacgacctcgcccctcgcatcttcatggctgatgccgctcacccgccgcgtcaccggagtccgccgcttgcccgccgtgctgatgccgcttcaccgcgtcgcagctgcagcggctcggcgtcggcggagccacaggcgcctgtggaggagccgcacggcaccggccgccgcggcgagcgcggctgtcgccgccaccgccgctaggaggaggagcgggtgggccgggccggcagcgccggcggcgcggaggaggtgcgcgtgcagatgcaagtgcaggtgcaggtgcgaaatttcttggacaaggagaaatttccgcttcttttctcaactttcatctttgtgtgcatatactagttcggattgtttctcggagaaggagaaatttcttgtctaggtgagttgggatttgatctttgggactgaatgaaattggtatcttgtttgggattttgttttgttttgattgagtcgtggccaatgacgacgacgacgatgccggcagcagcaagaacgtcggcgccgggtggatttttggagggcgaatccgggatttctccgagcgtctacggcgcgaggacacgctgcgtcgaagaaccgaagcccacagcgcaggcgacgccggttttcctggccgcgcatggactcgtcaaagcgtggtaccgcgtcactatgtttgggggcgaggggccaagcttggtcgccattcctggctccacctaagcgaaatcctccgtggcgcaggtaaggcacgagccagctcaccgcactgtaagaggcctaacaaatttatctctaggccctgtttagatctcaccctaaaacttttcacctcgtcacatcgaacgtttgaacacatgtatgaagtattaaatataggctaaaaaataactaattacacagattgcgattaatttgcgagacgaatcttttaagcctaattgctccatgatttgacaatgtagtgctacactaaacatttgctaatgatggattaattaggtttaataaattcgtctcgcggtttactgacagattctgtaattagtttttttattaatgcctgaacaccctataaaacaccctatataatattcgaagtaacccgccaaaactttacacttctcgatctagacacccctagctcattttatttgtcccaaataaattattcttagagcaactattgtatcggactttgtgaaagtaaaaaataattatattgagagtggataaaataaagaataattgtattagagatttaataaaatagaggtatgctattggtatgtatgggatggtgaaagaaaaaacttatttttggacgggatagtagcctactagctttgccctgctttctgcattgcacatttgcgcattctatgtaacgctaactactagcttgtggagggtattgtggctttgtgggatatagtagcaacatgccaagttgccaacatgcgagagccaaggacgacagtaagtcaaccatgaattaacaacttattactgtagatgttgtgtgctgatgaggatgaggggtctccgtcttatatatatgatcatgtttcagggcttcaggtttaggtagggattgcccgttttcacggcggaagtttcacatgatatctgtatttctgcataatctaattcgatgggatatgccatctttgggtcaggagacgtttttaccatctgtaatatattttatcagagatatcttggcactataatctattttgagtaaagtgtattggtggtccttaaacttatagggttatgtcatataggtccataaactcttaaaatggatatctaggctccataacttgtcaaagtgtatcatctaggtcctaaatcgacacatcccctctaggatcctacgtggcgctgat

SEQ ID NO: 30132 - DNA, 30541 bp, Oryza sativa
cattcttatttttgtcttttctttgctgctcgggtcacagagaaaggagaagaaagggaaaaaaagagaagaaaaaaataaaaagaaattttattttaaatgggacccatttgtcagtcaaaatgatgccatgtcattttatgtggcatgccacatcaacgccacgtaggatccagaaggggttgtggcgatttgggacctatatgacacattatgacaaattctgtgacttcgatatgattttgagagtttatggacctagatgacacacccctacaagtttaaggaccgtccacgtacaatttactcatctatttttatcagagacttttaggatttagaggttagggtcaaacaagcggttgcacgtacccatgagacaataatgctcgacgatggtgctatgtcatctttctccagaaaagaatggagcacacattggatccatgatccgacactgcggagtaataatttaacacacattattagccaacaagatcagaaaaggcaaaacctgataaaaaatagttcggttgaaagctacggaccaaaagttacccacaaattaattaaatccacaattacactcatatatatagcctagctagctagctatagctaacaacccgtggctattacttgatctctgcttgcactaacgacggtcacaagcagtgaatgaaagcaaagtggcgagagccacgctaacgaacggcagcgcgcgtacgacgtccaggccgaagacgaattggctctctccttcgtttggatgcaagccttgtttacctttcaccactcgatgagtcacttttggaaactactgccgctactgtaactagtgcctgaatgcaaattatccaccaggaaaaagtaaagaaaccaagtaccaatcgaattaagcacgcaagtgtagatcaagtttttcagatcattttgagagatatttttttgacattatatttaaaaaaaccaccgcaagtttgtttaagtaaaaaacttttagatgtgactatagtataattgaagtgtaatattgtaactgtattataattatgttgtgtctgcattgtaactacactataattacaatataacttatataaaacttacattcaactatagtttggtcagctaatactaggatcttacatgtaacatgtatgtgaaaatttctttctagcgaacatacataaatctcgaggtgttccgatattcacaaatctgaaagttttaggagaaaaaaaaacctacagaagttttttagcaaatccgtagatttatgtgaattggactgctcatgatcaattgatgattgaaaaatgtgtcgttgggaaactgaaactaccggtgcctagccaagagcatactaaacaaagtagaaatacacagtaatactcttccaacatactatatggtggtataatacagccatctatagctagctagggcctagcaaccagctgattcagctacattacagagagaaaaagaaaactactagtactagtattaataatcttcgtctcttccaacttccaagcggtatgcacacacagagaaggcagcggctcatgcagtgtcatttgctagcttgtctaatgctgagctcagaagcctctctctcgcacgtagtagtaaatcaacccaacaccgtttttttgctttgtcttaatgtctagccgtcgtcgtcgtggtctccatccccggcgccggcgagcgcgcggcggaaggcggcgggggagcaggggatgcggagcgggccgcggtggtcgtagccgtactcctgcgcggcgcggcccagcagctcggccagcgccggccgccccagcagctcggcccgcacgaggaaccgctccgtcgcctcctccccttcctccccgacgtccaccggcacgtgcccctccggcggcacccccgccgccgccgccttcttcttcgtccctgcgccccgccgcttccccggcgacgacgacgaggcggcggcggcggaggagtcgccgacgcgggagagccgccggatgagctgcctcatcgatcccggagacgcacacctggctctgtggcgagatcgagagctcagctgctgcgtggaatttctccaggagagatcgatcgagtggttgggtcgcctatttatattgtgccggttggtttgatgaggtggcaggtgggtcccacctggcagtgggtggtcggtgccaaaaggagtgggtgtgcccgtgtgggtggaagggtacatgtggggactggtggtacgtggaccggtacgatccgccactgcttttttttttccctcttcctttctttcttttttttttctcctcgatttcgtttccttttctttgtatcgcctcagtcgcgagaaatttccgtgccttcttctctttacgatattttttagtgattcgtgcacgaccgcatgccacaaaatgagcaataatgacagcgtgccgctccactactagctaggagcccaagtttgtcaagaccaggtgtggtagtaataaaccaccgtctaattaaccacgagtacttagttgtttccttaaaaaaagccacaactgaatgaacctttattgtgtcgttctcacgacgtactgtccacaccaacaaatactcccccgtcaaaaaaaacaacctgttattaagatatgatttatcctaatacaatgaatttgaatatactctctatatctaaatccattgtaatagaatgtatcacgtcataatattttttgatttttttggatggagaaagtaggtcatgaagtacgctgtactgttgttactgtagtggtaagctaagtttgctgtgacacctgactgacgcggaaggctagtacaacggccagtcgagtcaccatgacagtttgcccgatcaggaacaggcgagccctacccgacgtgtcgatcggccaccggcgccggcgatgcaatgcatgcgtactggataactgtagctcgtcatcggtagtgtaccgctactaggaaaagcattatcgcaagcggccgaaaagggtcttcgcaggcggacgttggctagtccggtccgcctgcgaaaataggaatcgtccgcttgcaaaaaagaaaactttcacctgcgaagataggtagaaaatattgaaatctaaatataatttggccgtaaattacttttaaattatttattagaaattcttgcaggtacatatattggaatattatcaagcatttggtactgagaaatctacttatattgcataaatcaaaagtgttgccaaaatatatatattacaatattgttttacattgtcacttcaaataacgtcatctagttacattatggcatagcagtgttccactcccgaagatccttgaattcgtcacttgccgcaagggcaccctctaggtcgaagaaatctcctttgacatgacagcactcatggtggatgaagtggcacagatcacgctgcacatttgtgatacctgtatcgtcaaagcttgttcgacattctaatcttggcaactgcatacattgaaattaatcaatatattagtatcataaatatcaagagctgtctagtacatagtatagagacttacatcctccgcgttagtcctgtaccgtccattaaccctaaggaattcgcacgcataatacccgcaaaggaccgttcctcgcggttgcttgtgacactgaaggacatatcatagaaaaaagtagttataatttgcaattagtgaaactattggaatacataaagtgagtggagtattaccggccaataggtacgtactagcagcttctcccgtgttcgggtctgttctccacccttgaacttgtagtattggtatgtactgtatggatgtcataccgtttcagagtaaggaggatatttatttgtaatacatccatatacaaatgcaagagtcataataacttactactgtaagattgttagaaattctttgtattgcttgtgtttgtaatcgagaggatccaagactaccatggttccgtctttagggtggatgagtaaacagatataatgatcgctacatattaacaacattataattagttagtaacagctaaaataagacatatgtgtacaagataaatgtaccggacttacttaaaattataagcggccatgaagactcttattttgaaagtgcaagaaggctcgtccaatgtactgtgcgacagtaatcaatttctccttgtgcaagcccttcttgtattctgctatctctttcggattcttgcccttcagctggtctgaccctggatctagcgtaacggtatgctgtgtttggcatatccgagttggatccaagaagccgatgggttcttttttcttcttagcatccatgtattgcatcctacagaagaagtttgttagtaacaatcacatggagttgtattgtacatatttttcatctaattaattaaaactcgtactcacatgcaccaaacaccgacataattgacgttcatcttatcccgacgatatatggcgtggagatatgagaaatctagccatacgtaaccttcttcgccgaaacaatctgccggtgatcgagctgttatattgcccaagcctttcttgctggcctccatgtagaagttatgtaaccttctcatctcccatggtgcctctttcagtgcccattccggcaagagtgctttcccatgttcgtacttttccgggcaatcatcggttgcgaagtatgttggcccggctagcacagaagccttctgggggtcgtcatctctgagcttggcacgttccttaccccctctaaagacggttagcatgaacttctccttgttcgcatctttggacttggattcgtggctcctaatcactcgtggcacctcgggttctttcgcaggagaagggtcttcaaatatctctggctctgtaccatcccattccaatcctggtacttcatctttgtctgacccgactgatgccacaaattccacctctggttctgccactgtaatctctatgggcacatccggcacttgaatctccatggctgtctccggcggtgcaatctccatggctgtctccggcggtgcaatctccttggctgtctccggcaatgcaatctccggtggcacttccggcactggattttccttaccaagttctggatcatccgccttatcagtcaccttcctcttaggaggcctcggaggttttcccaaacccagtttaggcaacacaggtttttccccggcgtcggtgcccaatccaaagaatatgtcattcttgtgccagagaattacaagatcgaccgcatccccaagtacggatataccatctgcagtcaggtagtcaatgtcgtaggactcaaacccttcgtggaccacttgtggctgcaccttggcatacgcatcgggtatgaattgttcattgtatgttctaccagggatagcaatggctgtagcggcctcaagaattttaccggagcgtccaatgggaacgtgcaatctgcagggtgtattctccttgaggtcatcgaaggggtaatctggctcagtttctttggtttcggggcgaggcaaaatcatgtgcttgatgcagaaatccatcatttgcctttcaaactccgcagccccttcgtctctaagtttatccttgtacgcttcacgtttcttgtgggggtcatttttgaacccttccttccaacttatcttgctcgacacacctcgaacccttcccccatgctcaggagtacccagcgccgtacttagcacatctttctcccttttaggcttaaaatatactttcttttgtgaactggataaattttctattttatcggcaacgctctgcagctccggattttcaaacgacacttttccctcatccgtgatcttcggagttctagctcttacccagttccttgatctctatgtccactcctccattggtaccggttgccccttcttcctcatttcctccttctcttttgtccactgttccacctttggtgcgtatcccgcggagcctaagcgatgagaaaatttgttcttcttggccaactctgaatacttttggctccttttaatttcttccggggagttcttcaaggtcagaaagtcgtcccactgattgggggttatgttggcatacgtcgaaaacggtgtgcgtcccgtcttcacaaatttcttgttcaaggtggttttccaaccacgccaagacttggccattgtttgcagtgcacaatttctcaccgctgcctctgatccttccgggaactggaatattttcttcaactctttccataggacttccttatccccatccgttacatgatcctagtccttgaccgtgatggagatcttctcccttactattatgccacactgtgaactgaatttcgcacgtgtcgtcttaggggcgagcggctctcctttaggcaaaacatgggtaacaacatggaacccttcatcctttctatttacgcttctctcacccttccttctcttcgcctttgctgaccgttcgcttttctgtgtgccggttgtgtttgccggtacgtcctcgtctttcgaagtaacttttttcttcggctgccattttgatcgtcgtggcgccgtttcctacgagaaggtatgcatgaaagtttcgaattagctcgggctaatagctatcactgtgaacattttacatattaagtttacttaccccttctttagggggaatgtagtccttgtcgccttcttcaccgtcgccctttttccttctcttcgggcttgggcttggacaaggatcgcttggtgacgagtactcctcgtcttcgtcacctacgtcgctgtcggaactaccatccggtgggaccgttggttccggagcaaccacaacagcaagggactgctcctgctcccctaaacccttctcttcagtccctttagtactatcggccatcgtttcaaacctctaatataaaaaaaaagtgttatcgtcaacattttaaattactcaaattagtacaaactaattagtacaaaaataaactgtgtattaacaatatgtcgtatgaacaaatataaatgcgaagagatttccaaatttaactagcacttactattatgctaaattaattagtacaaacaaatttaaatagcgaaaataatgactacttactattatgctaaattaattactacaaacaaatttgtacaaaatttgatatgttattatcaagtagtgcactaattcacttccttatttcatcgacatgttgactaaaaaaatggaaaaggcaaacatatcctccacatttttttaaaaaaattgttaacataccctccaacatgttatttaaaaaatttgacaaattcacatatcctgcaaaattgaacataccctcccaatttcattaacatgtcacccacattcccaaattcacattcacaatcaacatataacccctcattcacatatcacccacccctcacacccacatgcacacacatatataccccctcacacccacatgcacacacatataaaaggaaacacccacatgcacgcacgtccgtgttggacgaacggccgacgacgagcttcagtcgtggacgacgaaggaagggccggcgacgaggttcggccgtggacgacgaacggcctacgacgaggttcggccgtggacgacgactggccgaagacgtcgttcacggccgaggacgtattcgctcgtggacgacgatcggccgatgaagccgttcggccgcgagcggaggggtgggcgacggtggtggaggggccgacggccgtcgccgatggaagggccggcgacagcggtggaggggccggcggcggccgtgcgcgcggtggaggggtgccggcggtggccgtgcgcgcggtggaggggccagcggcggtggaggagccggtggcggaggagagcgcgctcgacggcggcggtggatgagccggcggtggtggatgagctcgacggtggcggtggtggtggatgagccggcggcggaggagagatcgacggggctgcctcggtggagcgtggtggacgacgacggtcggctgcggcggaggacgacggtcggagagcgaaggtcgtaggcggggcggcggcggaggacggcggaggcgtgcggcggtgaaaaatttcggcagcctgacggcgccaaattttctagggttcccgcctggacttagaaattttggcgccgcgggcttgcccttatatagggcaaagatcttcgcaggcgagcggtccgcctgcgaagataatcttcgcaagcgggccatccgcctgcgaagatagtaaaagagatcttcgcaggcgggccgtccgcctgcgaagatcttttcaacaaactggtaattgcacataaaaatatttacacttttcaaatattactaactttaaattttttttaactaaattttcacaattcaaatggtaattgcacataaaaattagtacttagaaattaatatgcaaaatgttgagtacaattgttcgtcaatttgcgatacgatcacacatcaccttacatacaatcattaccctttaacatttttgcccacaccgtccgtgcgcatgtaaggcttcacggtcttctgagtagatgtcttgacattcttaatcttctgtacaaactgactataaagtggcatactatcgtattggttgtaatcttcgacatcttcaaccccatccactcccaatatcttttgtttccctggtagcactatatctttcttcaaatttgaagggtctttcacataaaacacttgtgccacgcgattggagagtacccaaggatcatccttgtgacccactctcgcaaggtcaacaacagtaagaccgaacttatcaacatttaccccgttcgggtattttacccactggcacttaaatatggggaattgcattgtgtgcccatagtcaatttcccatatttcttcaataaacccgaagtatgattgtttttccccggcttcatcaattgcctccacacggacaccgctgttttgcgtacaggtcttattatctcgggctcttgtgctaaacgaaaatccattaatgtcatatccctgccaagaatttactgtagttgatggaccacaagccaaccgcttcatagttatttaatcggtagtttctccctcaggtaagtctaggtctcgcaaccaatctatgaagagacgcttgtgttctttcattatccactcggtggagcgacccttattgttagctcggattagttcgatatgttgatcgatgtatggctcgacgatagcaaactgatgaagcacgctgaagtgagcttcttggaatgatttgtgatcatgggtgacgaatctcttctttcctatcgttcccctgccactcaatctgccctcatgtcggggcacaggtacttgcatatccatccttgagataatcaatacagcactcgacaacctcttcagtactataaccctcaaccattgatccctctggatgtgcacgatttcggacgtaacccttcagaacagccatgtaacgctcgtatgaccacatttgatggaggtacaatgggccaaacgcaaccatctgcggcacaatgtgaacaatgaggtgctccatcatatcaaaaaatgatggagggaaacacatctcaagttggcactgggtctcatgtgcgaatgtacggagatttcctaactcttcgagactaatgaccttctgtgacactgcgttgaaaaagtagcacaaccttgtgatagcaacctttaaatgctccggttttatggctcttattgcaattgcaagaaacaaagtgagcaagacatggcattcgtgtgaattataaccagataccgacaaatctttcattgaaactagtcgactgatgtttgatgagaaacctatgggcactctgacattacggagtgagttacaaaatgacttcttctcctcaggtgtcagtgtgaaacagtctggtggaagatatactttgccattcttttctccttcttgagggtgtaactcttccctgattcccatctcgactaggtccatccttgattgcagaccatctttagtcttcttcggcatgtccaataatgttccaactatgttgtcaaacacattcttctctagatgcatgacgtctatggcatgccgaacctccagatctttccagtacgggaggtacttaaaaaatatggaatgcttcttgaatgggggagggagtttatcatctggcttcgaactgtcatcttgcttcttactatcccctccctttgtattcttctcgggtttcttgcgctttgtcccctttgatggtttcttagtcatttttccaaactcgcaaacaattttctctgtcattgcacacacattttctcccgatgtaggttttggtgcaggatcagtctcttcagtaccatcgaactccgccttcatcttacggtacttgtgatttgtgcgtaggaactgccggtgccgcatgtacacaagcttgttggaacccgggagatacctatagtacgttccattcaagcagatcacacatcctgttttacctttaatttgacctgaaactgaaaacattgctggataatcgttaatggtcacgaagatgattgccttcactgtgaagtattcccttaagtactcgtcccacactttcaatccctctttccataaatcggccatatcttccaacaatggttcaagaaatacgtctatatcaataccaggttgacggggtccctgtatgaggatacagagtagtacatattttcgcttttgacaaagccaggtaggaagattatacatggcgagaagcactggccaagtactatgtgaactgctcatgtctccaaaaggattaactccatcagtactcagggcaaatctaatgtttcgtgggtctttagcaaattctctatactgcgcatcaaagtttatccattgacgagcatctgccgggtgtcgaatcatcccatccttcttgcgtccttctttatgccagcgcattagtttcgcatctcgcgggtttgagtatattcgtgtaatgcggtctttcacaggaaggtaccacatcacaagctgcgggatttttctctgtcgtccctcagttgcttcagagggttctaggctagtattgctattcgacttgtaccggcttgcaccgcatgttggacattcatccaaagaaacgtactctttcttgtacagtatgcagtgatttacgcacgcatcaatcttttccacaccaagtgaaagggggcatatgagtttctttgcttgatatgtgttggatggtagtgagttaggcctcggtagcattttctgcaggagttctaaaagactgtcgaaactggtatcagaccatccatgtctcgtctttaacctcataagttcaagaactgaccggagtgttgtgaaatcactgtcacagcccttcgactcatcgtacaaaacttcctttgctgccttctgtaaagcttgaaagttatttagccctctggccgaccccatcagcacctcgggttctgcatgacgtaacatttcctctaggtcgattttgtcctcaacagaaccatcgtcatgcaccatgtcttcaacttgtgtcggaactacattttcaggctcgtccacttgttcttcgccattatgtgtccatatttcatacttgtccataaatccacgagttactaagtgctccttcactttaaaagcatcgtcaaagtcccaggctatttcattcttacagtcagcacacggacaaatcatcttcctcatattgttcttctcagcgtgaaccttggcaataccaataaatttagccacttcgtttctatatggagacaaaaacctcggccaatgatatatccattcccaactttccatatctctaaaaaattacacgtaaaatatttgcacaattaataccaaatttgtagggtttattgaaaaaacttataactattcaaaactaattaactaaaggttaagtgtaaagtaataaaaaatcatagtttatttcatttttcttacacagacatgccaaattagcacattaggaaaatctaacaaaatcaatccatcggcatattacaaaatactataactattttttgattgcactgaataaatagacatttaaaatttttttctctctctatacatgacaagagctagatctgatctagaactaggtggtggatatgatagcaaaaaattaaaaaaacgagaatttatgttaccacattaaaccactacaacaagaggcatcaagtattacacatacatctaacataaacatatggcaagaaataaaattaaaaaacatggagctctcttccttcaaaattttggatgcataaatccatcacaaattaaggtctaaaagcttaaaaaaatgcatacctagtgtggaaatgagtagatctaagtaccgtagaaaaatcccccgaagatttgaagttcaaaacctccccccctatatttaagtcactttaggagagagaaacgtcggggagaatgaacagggctggtgaaatgaaccgcctgtaaagatcaatcttcgcaggcggaccgccccctccaccccgggtaccatttttgccggtggggttttggctccgaattacatgcccgcctgcgaaaatttatcccctattacgcagaaaatgagatttctagcagtgtacgtggctgtgtcgtccaacgcatatatgcacctgcatatgccataccgtggccgtgcagtgcagtggcgtctactaccttttgatttggcactttggtacgtatacaaagcgtggtaacgcacaggcacgccagaagaggagtgggggacagggccggatcgtgtgttaaggatcaagctatcactttgctagtacttctacgtactgatgactactccgtcgcgcgagtacgctggcaaatctcatggcgcgcgtacgtggatcggtcgatcgagcgttgatcgatcaggtggaccgcacgatccggtcagttcgtccatcgatcagtgtacgtacacgtaggtgcgcatatcaatccacgacgatatacgctacccctccgtttcaaaatataacaactttgttctggatgagacacatactagtcacggaatctagacaggatatgcatagattcgttgtactagaatgtgtcccatcaggttgctatattttagaatgaagggagtactacattaatatagtatatttaggctctgttctgctgcccttatttctactgtgttgcagccaacaaccacagtgttttctttatacagctacagtagcacaactgataaacatagcagctgaacagtcccttaggtttttggcacgcaaaacaaagcaatatactaatataaaattaattaaatattagcttaaacaacttgaaaatagattaatataatctttaaaagcaaatcttatatttttttaaaaaaatatattgtttagtagtttaggaaacctattaagttgagaatacttaggaacatactaccttatatggataaattgtacttcctccgtttcatattataattcgtttgatatttttgttagtcaaagttctatagctttgatcaagtttaaagaaaaaaattaacactaactacgacaccaaattagtttcattaaatttaacattaaaaatattttggtacaaagtttattttgtattgcaaatgttttattttgtattgcaaatgttactatattttgctacaaatttgatcaaactttaaaaaatttaactaagaaaaaagtcaaacgatatataatatgaaacagatacagagggagcgaagtacagtagtagtatgtggtactaggccctgtttgggggagattgtcccagctgcagcttttcccaaaagctgcttctgctagaagctgccccaaacagtctacaacttttgagaatctgtagttacagattctgaaaaatgaactaaaaagctagaagctggagaagctgggtttcagagcttttccagattctcagaagctggctaccaaacagctgtttctcagaatctaaagctcctctaacaggtggtacggtatgaagaaaaaaagagaaaataatgaagtatcaattaaacaagggtgtagctatatttatggtgccatattttttatcaaaaaatagtcggcatgtatttacattgtaagtccctaaattacatatgtaattttaatgtatttacaatgtaagtcttaaaattacatatgtaagtactaaaattacatatgtaaattcgaaaattacatactaattatatatgtaagtgggatgtaaatgaggtgtaactactatgtaagtggctaaaaaaaatcaactctaacatatggcgccatatttctagcaactccgttaaacaattgaggtcttcgcaaagtggctcggcgcatacatgcaatgtggccggcacgccgctgctttattgccattattggcccctaaagaaatgcgtgtgccgtgtggtacgtgtgcatatgcttgtgatggccgaccatataagagtgtctctgccttttgatctcgttgagactcgaggctacacgcataaaaaatgacatatactacatgcttattaccctgtaagggtcaacgagattgaccctttgttttaattaaaggagtatatttgtgaacttattaatcaagttgactttttttctctagaacacaatataaatgtaaacgctcacaacgtacatatacttactcctgtgagcaactctgaaagactgagtactcctgccggactgataatacttgttgttttggacaagtgtgagttcaaactttaaaatctttaattataaataatttctaaaatatttatctttgaaatatggtgacaatatgtatagattagtttagaaaatacttcaacaaaatcatatatttgtaacacttttattcatattataataaaaatagtggtcaaatttagttttataagacattgtccttgtccaaaacgacaaatattattaacccggaggaagtacgtattaagaatacagaagtcatcacggatgtatcgttgttaatatatacgccgtttacaatgaataaataattagccataaatgtgaacactcatatcgagtctacgatttaaatttggataggttctggtttccccacaaacctaataaacagtaaatagttaagttataccctcacttcgtaactgagacacgaagtacaataaatacattgtagtaaaatatattttgttccagcttaattagtttagactatgcattacatacgtcggttcaggtgtcattttgcagttggtttagtaattgcaagatacggagtagttggtttggttgtccatgcatatgcatattcacggaggtcaatttgtttagcaggaggaccatgcatataacacacctaattttattttatatgcaaaagtctagaaatagaccctcacgatatatatatatatatatatatatatatattcttctaaaccgagcagttacgttttagcctacatgattgttgattgttggtgtgtacgtacggacgtgacgtcactggcgcatatgcatgcaaccaaatcgtgatcaccggctgccggcccatggttaagtttgctcgatcattcatgccttcatggtactaataatactatatatatatggccctagtctctcgttcctggaagggtcacatgcgtacgtgcgtgtagattgagccggctagcttaaaagctagcgagtgatcgatcttctcgctctctcgttgcctatatatatatcagtgtaatattattgtacccgacccataacgggatgacatcgtgtagcaacttctacagtgctatcagctactttaggttgtgttcatagcacggggatcaaccaaaaaaaggcagtgcggggcccaatcaatctataattaactcacgcccgcctaatatatattccctccgtagtcataaaggaaatcgtttaagacatcgacacggtcttcaaaatacaactttgacttgttgtttctataaaaatatttattgaaaagtgatatatgtatatttttataaaagtatttttcaagacaaatctattcatataatttttacatttttaagctcaacaacttgagagttattcatgatttatattctcaaagtttgacttaaacattgtcctaaacgacttcctttacgagtacggagggagtatacactctctctgtcccagggcgaagacaggagtagaacagctagagctacaacgctactcctgaatctaaatatccattagaattatactttaaaacttcaaaaaatagagaattaatagccaagttacgtactaaattacattagttgagtctaggattagaagaattctgattctgccactgcctatatctcagaatagccatttatagccatcctaagaaaaaaatagtagcgagaaaaaaaataaattatcttattaataagaaagtagtattattaggagatacgtatgtagtcaatgagtaatgaaaggatactatttcttcgagagtataggtaagataaataaaagtgaaatattagaaatcagcttatttttgacgtcaaattaaaggagtagctagtacaatgatacttggtttcattcaacactactactattaaagtataaattagaaagaaagcccgcacaaatgcgcgggcatcttatttattgttttataaaaataataattaaaaaggtcacatctcactatttctacaccctaaaataaaccatagataatgtcttctagattaaaaaagaaatcactttgttccgattacatataaactttcctattgtcactgcaattcattattattgtttaaaagttgagtatctagataaaatttcatacatactaattaaataaatttaatataacactaaaccgcctcatggcaacttgatagcttgatagcgtttgtaagaaatttaatgaacttttagtataatagattctataaaaacttattgtaaaaatttaaaagaagcatgatgaacaagctagttcagcccctgctctctgatttcctggttccggccgccaacgcatcttagcgtactagtcagctaccgagaaatactaccttcgtttttaataaatgacactgttttttatcactcgtcttattcatttttttacataattataatttattttgttgtgagatgttttatcatttaaaatactataaatatgttttatatcttatatatttacatatattttttaaataagatgggtgactaaatatatgttaaatagtcgacaacgtcatctattaaaaaataaagggcaggtacagaaaatacattcctttccatccactttgggtttcacggcaccggtgcttttcgatcacactactcacaacacaagcagtcgcgcttagaacagttcaaaggcaggcccagacatggagacgggccaaccggccagtggagtgggctacggcccaaacgttctccaggagtagtttcctagcccaaaatcatcgtacgaaaacgacgggctggttcttcatcgcctcggactctgtacgtactccatataggatcgcgttgcggtttgactcggcaaccgtatgctcgtttccttcctagttcctactaaaagtctccagcaacttggaagttggtggtggcccaaccgttgggccggtccaaaacatcaaacgggagctcaaaactaacaagatactgacatcttgtcggctgcaggctactgtactacgaaccgaaaagcaaattgcaaacgatgaacgtggcgatgctgtatatatgcggctacttgagaagccggggtgtgaaacaactgaaaagtctagctgaatctgtggtgcgtgcttgcgcgcggtgagacgaaatttatatgcatttcaagcaggccactaggggcgcgagatttgtttctactgtataataaatgaaacccgtgtattgctacgggagttttatgtgatattagtagaaatagcatgtaagatagctatattttgtataattttcatgtctgatcgattattgaaaaaaaaccataaacaattaaagtgatgcggttttcaacaatgtaagtcatatatggattgatcgtttaaagcaaaactaagatgatgtggctcaattagagaaggaaaaaaagattgtaatatagattaatcatctaaagacaaaactaacatggtatgactttataagagcggaaatcaccaacaatgccgtctagccccactatattagcctcattcgacacctggattcttatcgtcccgataccaagtggtggtgaggtacccctgtcccattggttttctctattttcggtggatcacactgctaagatacccccatcatcaacgcaggcttgtcgtccttctccatcctcgcagcttcggcattgcaatagacgtctcacaacccatccgtatcaaccaccctatcgccaatcttcaccatcctggcgatccctctaaaaccaccctcgtctgttcctaccccctcttaccgtctccactctctaacccagaaccctaatccgtaggtcctcagccagagttaaggggtcaccgtcactgagtcttgccatcactatcgttggtcagtctgccatctccatcactctcctctcctcctgcctccctcttgtaaaggtggaggacaacgggcaggtcattggattttgatccaacaaaattcataagtcgacttaaatttagagaagtttcacccgactcatagaaagcaaaggtgtttttcgttgattaaaagttgttgatgcaatatagtatactccctctatttttatgttgtaacttaattttgagttgtcgtaaatattaaggagggcatgaaatcaagagagataagcaaagtttgctacctactcccttcatcctagtttggtcatcctttaaggaaaaggcatcaagaccaaaaacatgaaaacatcttggtgtccaacataaattaattatcatcaatcaaggtactccgtcacttcttgtctaacagaaattaattcatactttaaatgcgcatatactctttgtacaaataaacaaagaaacactttgttatatgatgtcattttaagaaaacctcaacaagcttaggtgatgatcaacttgggatggagaaagtatatataaacacgttggaaacagatacagtagtgaaacatattgtatggtgtatttcaacagagactatgcaataaacaagggcaaataagaaaatgacccaataaagtatacatgcaagccttatgtttcaaacaagatgaagaaaaccttgtgccatacatagtacacaaacggacagatcccatccgatggcgaagtatatattgaggcatctaaggaatatatatatccaagtcgttggacgtctcttaggcatctcagaaattaatccctggcggatgatgcatgcatatggacattcaacggggttcaaagtctagtctctccatcgtcgccatggaagaccaccataaatgtcaatatgcacgtgcgcagtgcgctaatccatgtcagacgcacgtgcgctaatcaccacggaagaaccgtccttgccgatccctataaatttgccgccacaatcctcgctcgtctctcctcaacgcgctccggccaggcaccgctgacagcccggctccaaactccggcacctccgatcgatcctgcaggcaatctaaccaattaacttggccaaaatcgagatcatcatgatgtggaggaggaagagcagcagcagtggcggcgtgtcacccgccggcgcctcgccgcgccacggcggcgacgacaacgacgaatgcaatgtctttccgagagggtacgtaccgatagtcgccggcagcggcgacggggagcgcgtgctggtgccggttagtctactcggggacccgtgcatcgcggagcttctggacatggcggtgcagcagtacgggtacggccagccgggcgtgctgcgggtgccctgcgacggcgagcgtctacggcgagtcgtggagggcgcgctgcggaagggcggtggccagtcagcatgagatcggacatgtctgtgtggtgtattccctccatcccataaaaaccaatctaagataggatatggcattttctagtataataaatttagacatagtcatatctaaatttatttgttgtactagaaaacgtcacagctccagggagtagctagctagggagatgtgcaagtacgtctggagtctgtttattctttgattttattttctagattcttagcaaaattatacatatagcaattctttgattattcttttgtggaaacagcagatttcgctgaaatttgtctacgatgtttggttccaagaagaacatatatatagtccagtctaaccaatgacctagggtggcagcagcggccctagggtctgcgtcggcccggtatggcggcgactcccgtcggcgctggcggccctagtggtagcagcgggcgcaaggccctcggcgaggagcagacggaggtcgacaccggtggcggtggctgccgtagggcagcggcggcctgaaatgacggcgacctgagcatcggtgcaaggccctcggtaaggagcaattggaggtcgaccccttcagtggcggcagccctaggggcagtggcgagctgagagtctagaaggtggaagagcatccatgtcgacgcctgcaacattttaggtgtggaggcctaggattcggcaaagtgaaagtcgatcccgtcggctagttccgacgattgacgatggatgaaagtgggctaactggcggcgcgtggcgtcagctcacctgaaatggatgaagatggcatcattggaagttcgcagcgacgacgtactaggggcggcggcgtctagacgaattccactcatcaaatctggccgtttcaggagagtatgtcaggatgcagagaagcagtggtgtgtcgaggtcgttttgtttttcttttcttttttggttgtgtgttatcctccttattgagatgtgagtctaagtgctcttgtatccctttggctatgtatatccttcatggatatagaggccggatttatgaaaatccattatccaaaaaaagtctaaccaatgaccatgttcttttatgctttggaagcatgtttgaattctgagtaccttttgccgtattaccgagtgtttttgacacgtggtagcttcgcgttcccttgtagtgaaagaatatggcttcacgttttccgagaagagcctgagacaaaaggcatgtttgggccttagcccgggcccggggcccccagatgcttgtgccttgttcctcggtggtcaccgtactcggggcagctgtgcgcccggagcacgccgcgtgccttggctgcccaacccaaggcacccatgatcgctcccattgctgatcataggtttacttattggtttggacaagcttcttgaagaagtcgatgacaaaggatttcctcgtgaacattgcttgaaggatatgctgtatcttcaacacactgaagatatagatcttgttggtctcaactctcctcttgaaaccttgaaaattaatgtagatatgaagatgtagattttgtatgtctcgtgtagcgcccgtttcgtcgtggcgcctagctggaaaatctaaattctaaaaaccctaattgcgaaaattgtttcttcgcttgcagtcagtctccgtgccattccggatctcaaatccccgatctatcgtcaaattcaaatcccgaatccaaatccttcccaattcatttcctccgcaaaagtctattttgcctccctcaggttcgatgggccgaatccctctcggcccatctctctatccctcctcccctctctctctccctccctccctctctctctctctctccctctctcccccgctctgcccgtgcgccgcgcgcgcgtgcgcgtgagccgcgccgagccgagcaccctccgcccgcgccgcccgttgcgtcccgcgcacgcacgtcgtggtggccgaccgcctggtcgccgccgccgtcagcgccttccacgcctgcccgcgcctgccgcccgtgtcgccgctccgctccacaccgccccgccgtcatcgccgtcgtcacaacccggccccgccactctgcgcgctaacctccaagggacggagacagagctcctcctccctttgccgcgtcgccccctctccctcctccttttcccaaagtggcaaggggcaagccccctttccctcctcctttttcccttttctctcccgccagcgccatactccccccctgtcgccgttttggccgcgaccaccgagcgctagccctctcccttgacagccctaggtcggttcccaaaccgacatcgccatcctataaagcccaggcaccctccctcccttctcctctcgtttgtcccatcgtctccactccattgtcgccgcctcccgtgctctgttcgccgccgcctttcgttgccacggaggagccggcgcgttcgtgtacgcggaaggagacttcgggagctcgtcttcttcctcttccccggcccgaggccagagagatcactcccgtgccgtcggcatctcgtcacagcgccccgcctcgtctcggtagtgcatccctccgttctccctcctcgctccatctcttccccttagctttgagtagccgatcgagtagtaccccagtagctagttggcgccgccccagcccgcgccgccgctcgcagtaggctcgccgctgtcgccgcccgagctcggaagcgcctctcgtcgccggcctccctcgttgcgtttcctcctaatccggcgcaacggacggattcccggagtcgcgtagatgctctagctcgcccgaatcgatctcctgtcgcgccgtcgccgtttcccccttccctcgccgccggttgccgccgccgcaatccgccgccatcgagccccctccgccgaatccaagccgttggctcgtctcccctcatctcgtgcaaccacccggtgtgctcgctttcgcctgtatcgccatggttcgccccgtcgttcgcagccaccgtccgccgtccgttccggccggcgcctttttcaacctcccgccggcccgcgtggcagccacgtaggcgccacgtcggcgccagctcggctaagaccgggtcaagccgaccccggtatgccgctcccctctgccctcgccgtgcgcgtggtctacggtgagccgtgaggctgcgcgtgggcccgccgcaccagcgtcctccgcaagccgcgcgcgtgcgcagcgccgcgcccaaaccctagcgccgcgtcgcgtgctccctccgcacggtgaaccatgccgccgacgagcgggtcccacccgggaccacgcaaggtggacccggcccaccggctccctctctcctccctgcccgcgcgcgcgctttgggccgctttctcgggccggccagcccgttaagttcggccgagccgcccgcgaagtctaatttccctccctctttcttttttttttcaaaaaggatttaaataaatccttttcctttggaccaaaaatctaataatattagaaattcaatatcttcccaaccgtaagcccgtttgactccgttcaacttccaaaattccttaaatctcgagatctatctaatggcacgcctagaggtcaataatagggctttatttttgccgtttgttgagttgtcccatttcacgtgtagtttcggagcccgaagacccgcagtgcgaggatttcgaggatcaagctcaagatctcgagcaaggcaagtcacctttgatcatcttgcacctataatttaaatctaagtatttcttttctgcaaatattgcatgaataggttttatacaagtaattcggccgcggcttgcgagatagcctgctggccccccctcccaatcctaattgctgcaattaccccccttgaattattgaacacttagacttcctttgtcaactgttgtgctttgatgcacgggccttcgggtacgcgcatcagaacaccccccctcaaaatataaaatatccaacgatgggtaaaacttgggttttacaaaagacttggaaaacccgacacctgggtcggtgcttgcgaactaaatgaatttccaaaatcgtgaaccggggaacgtaccgggtgtacggtttcctgctcttgcacttaaggaccgtttccttggaatttcatccgaacataagacaagtgcgaccacatgggtgaaatgggacacccctggctgagtaaattgctaatcgggggagccttgatgccaagagacatgtgaattcaacggggtggtgtcggggagaacccccgggcttcctggcacagtatggtctgggacctaatctggtgttggtctgggacccctctcgttggcatatggtgaacctgtgtcggctttcgaaatgccttgtcatgaaagtcccaaggtcaccagacgtggctgttctgcacgggctgggtgaccaaggctagtaacgtcatgtgggtaaagtgtacccccctctgcagaggttattaaactgttcgaacagccgtgcccatggtcatgggcggatgtgaggtgattcctagcgtagttttgtttgactactacttgtgaaattgctgctgtggaatggattcgatgtttggaaaatcggcggctgatgggatcagccaggcccgggtggccgtttgaaagctgttggccgggtgccaaccttgatcaattcaaagactgatacattgcacatactcctaccggacgagacgcactgcctcatccgggtcgtttgagaaacactcacttagtcgtttcaaaaaggagtttaaataaaatcaattgcaaaaacaatagcctttcctttgaagcctgcattaaacacttaattcccgtggcttgctgagtactcctgtactcacccttgctctatataaataatcccgcccagttgctgaagaagatgaagtggatcccgctgacgaggagttcttccaggagtaagtcggctacgatgagttttagggtttcggcctagttcccaagtcgcgcctgtgatgtttggcccaagtcttggcttccgttttccccttttgtaatgcagatgtgagctcgagatctgtccgcagcccaacatgactgtactcctactctataataaatagacctctgttgctgtgatatactgtcttcctgtgataccagcactgtttcctgggactagtatcgattaacatgttaatttggagcgtcacgggctagttccgctcggggctagttcggggcgtgacatcccgtttgtgtttctcgtgggctgaacactcgaggagagaggttccccaagcactcctcacccagggagggggggagggggggagggaggtcgtctgtgccccgagtaccgcccgcggtggacgggcgagggcggatatgcctcgagcagtcgtgttcgggccgatgtgctccgagcacagcctataagggtcatgctcagggattggtgacaaggatgtcctgagtggtcgatgatgggaactcttggttttcattttcctgacacttatcatcacctgaacctctatgtgtatatatgaggccccctacggggaatgtgtggtggcttaatcctatgcagcttatttggatgcatcctccagtggagtcgagctctaggatttcaccgtgggcgttgaaggcagtcaaaggagaacgaaggactcgattgctttattaattcgttttctttttaagtaactttttttatgcaagatgcatgttatgccaaagtgtaatttgtccagttttgaggggctcctttgcaaaactatagttttccagtgatctgtgctctaagcactgtacgtacatgtactcatattatgcttgaattttaatcaataaataaatacatgggttatatattttaagaaaagtagattcaattcggcacgtgcctctgtacgtagtactgtgccgccacagctgactctccgacgccattggactcgatcaactgatgatcaacggcatgcagctcgatatcgatcgatattgttgcgtttatttgaccctcgcgtgctcatgcatgcacttgctgcaggtggatcgatgcgcagaatgcttccggcgtcgtccgccggcgatgtgatcgcacgtacgcgcgtcccgccttcaccaacccaggcgtccatatgtggccatttgggtgctctctaatactccccatcgacttgacagttggtacgtggtggcctagctagccgttaatgggaccagcggtccaaacccaacttccaaacttaacaagatatcgacatctacttactacgggcaaattgcaataaaatatcaagtgaggatgcatggctcagtcctgttttgggactcagggtgtgaaaacagacaagtccagtttttatttatttaagaaacaacagacaagtctagttgaacctttaatttgctgcttggtgtgacacgaaatttatgcgttccaaataccaactccatcggtaacaaaaaaaaactaaggccttcctcaaaatgtattggaatttttttcctatattatactctcattggtcacggataatattttcccgaaacaaaacagatatactacatgatatatttttctggacgccgccccattttgtttccatgcggttcataagtgaaaccgcacgggaaaacagggggaccggcggcgggttgtcgcccgtacaggaaaatgcgtttttccatgagggcgtcttaatccgacgcactggataattatcattatcccgtgcggtcaacttaagaggaccgcatggaaaaatcgattttcgtgtgcgggctttttaagtggaccacacaggaaaatacctccctccttttcctctcacccacttcaaatttttgacatcctctctattcctttttccccttttattctccctcaaccacttcccccctctctctaccttatctctattctctacctcctcctcctcctcccctcctccgacaacagcgggcgtcggcggcggccccttccgtgcgcgtggcgaggcggaggcgtcaaggcagcggtggcaagcgggcgacggcgagcgggcggaacctcctcctggtcgtcgtcctcgtcatgcacgtcgtcgctcagctccctcgacgatgacgccgtcgtcgcgtgcgttgtcaaggcaaagaaggtgagcggggcggcggcaagccggccggatctagcggcggcagccatcccccgcccggatctagcagcggtggcggcccccgcccggatctggcagtggcggccgtcccccgcctggatccggcggcgatggcggccggcgcgactgcggcggcggcgggccggcttgaaggcgatgacgatggcgggctcagcgatggccgagtgcgtgcggtctagcaggcggcggtgattttcgcgtttttttttggttttgttggttccgtgcgggcggtataatttgaccgcacgggatactcgagtatcctgtgcggttcggtcacccgcacatgaaaatatttatttttccaaacgcctgattccagacagggaaaatatccgcacagaaaaatcaatttgaccgcatgaaaaaataggttatgtagattccactacagagaaccttacctgctgagttatgtaagctcaattcgctggtcataaatatttgacgttgagtacaggtttttctcaaagttttaaattttgatgatcgataatttctcaaatgcttagctaattaagaaaatgtatcgaaatttgtcttgaagagtactataatactaataggaaattttgttgtccttgacaggtagtactatgtacctctagcactaagaaactcttcaattttatgttaaaaaatgtggtacaattctatatcatggcattaaatatttttgaccaaaggaagtactaatctctacatacgcatcatttaacatattttcccgaggacctgtttagttccctaaaaacttttcaaaaaacatcacgtcgaatatttggatacatgtataaagcattaaatatagataaaaaaaactaattgtacagtttacatgtaaatcgcgaaccgaatatattgagcctaattagtacatgattagtcataagtgttacagtaacccacgtgtgctaatgacggcttaattaggctcgaaagattcgtctcgcggtttccaagtaagttatgaaattagttttttattcgtgtccgaaaacctctttcaatgttcgattaaacgtccgatgtgacagaaaaaatttcccatttaccgactaaacaggcctgagacgtggagtaacatgacgtcaaaaacgaccgcgcgatgcaacggcccatcctaccgcgaagtatcgggcatctcaagagaaaaatcaagtggatgatgtattaattgcatggactctcatcgcaggtctcgtttcaaaccatagtcgatcccctttccagtcgccatggaagaccatccatgtcaagaacccaagaacacgtgcgctaatcaccatttcctccctataaatttgccgccacaaactcgtgtcctcgtctctcctcagcgccggccagacaatcaaaccaccgccatccccaagctccggcctccaggaatcaatctaacaattaatcaccatggtgtactggaggagcaagagcggcggcggtggcgcctcaccgagccgcgccaacggcggcgaggatgatcaggtcccgagagggcacgtcccgatggtcgccggctgcggcggcggcgacggcgacggcggggagcgcgtgatggtgccggtgaggctgctcggcgacccgtgcatcgcggagctgctggacatggcggcgcagcagtacgggtacggccagccgggcgtgctgcgtgtgccctgcgacgccggacatttccggcgagtcgtcgagcgcgcgctgcggaaggacggtggccggtcagcatgacgcctgatgtgtcgtgcggtgtacatacacgttgtccgtgtattctttgattgatcaaattattgtaaccttggagtttctaaatagccgtcaagaaaatatgtgtatgcttgtcagcgacttgagtttcaaccgccaagacaatgactaaacttcccaaagaaatcaggtggccgccgattcttgcagtaatttgatactgattttttttatggagatggtgaatttagctcaaaagtcaaaaattacccatactgtgcttcaataacgaaattatactccctccatggcactaaatttacccattgccaccgcacgaacaatattctttcttcgtcccatagaaaaaccaatttagtactagatgtaacatattatagtattatgaaactggacatacatctgttcagattcgttgtagtagaatatgtcacatccagttctagattcatttttttaagacggagagagtatgtagggatgctaaataaatattttataactatatgattatactagaaaaaatgtccatgcgttacaactggggaaactatttagccttttaagacaatgatatgtttttttcttggtaaaattggatgatcttaaagttgaatgtacccttagtttctagtttacaatttttatttgtccaaaatatatagaggaaaattcagaagctatacataattgagattttttttgtcggcatggatatattatatgtatcacaacaattaatgttctatcagtatgtccagctacttccggcaatccttgtcataataaaaattatattttcgtgcatgtatagattggcaaataataaaggtaattaatttgcttcatctcgttacctcgttgttgttgctactgtgatggttcgcgattagcagaacgatctaaattcctgaacaggtataggagagagacatctcacaacgagctttgcttgctcgcgtcacggctaatcaaagagcagccatagtcaatatttgcgcgtaatttattgacctgtgtcgcgaatcgtctgatctattccctttccaatcctccctcgacagaatagatgtgacaaatatgcagagacatcttctttcccgaatcagtcccaccaattaaaatcaataaaacacatgatatacatatccatattaaattaatgtttcaccccgccattaattattcagtcctcttgaaaggatatacacgcctaggggctgatctaactgttgttttatctcttgtagaaatttttatgatattttgatgaaatcgttaggggtttgtagagctaagcttggggctaaaaccctaatatgcaccagacttcccactacccttgaggaggaccttgtgttctgatgagctttgacgggaactctttaattcatctgagtggatgtccactcatttattacatgttatggctatataacattttaaaaataataacataaattaatatgtaatatactagtcaagaaatacaagtttaaattaatccaatttgtcaagttgtaaaaatgacaataaattggattatggatgcatatatac

SEQ ID NO: 30133 - DNA, 852 bp, Oryza sativa
gaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacataagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacggaccgcacctcctatttcctcaagggtgaggaaatgaagtccatgtacaccacctacaatccgcagaatgtggtggccaccgccggtttcctgttccacaagaagaatctatactactcct

SEQ ID NO: 30134 - DNA, 2589 bp, Oryza sativa
ttcagggagagctaatgcttatgcttattgggtattttggtttgacactgcttcacgcccaaaaagaaggcagctacatctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggggatatagctcagttggtagagctccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagac

SEQ ID NO: 30135 - DNA, 16282 bp, Oryza sativa
tctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtagaattcgaacctacgaccagtcagttaacagccgaccgctctaccactgagctactgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcgcggaaaaccgaactattatacaatacttaccttatgtaacacgttgggattatttagctactatgtttacagaagcaataacggtaaatgcaccagaattcttggagaatattcaaataccccaaagagccagctatattagggtaattatgttagaattgagccgtatagcttctcacttgttatggcttggaccttttatggcagatctcggtgcgcagactccttttttttatatttttagagagagagaattaatatatgatctatttgaagctgctacaggtatgcgaatgatgcataattactttcgcatcggaggagttgctgccgatctgccttatggatggatcgataaatgtttagatttctgtgattattttttacgaggagttattgaatatcaacaacttattacacagaatcccatttttttggaacgagttgagggagttggttttattagcggagaagaagctgtaaattggggcttatcgggccccatgttacgagcttctggaatacaatgggatcttcgtaaagttgatctttacgagtcttacaatcaattcgattggaaagtccaatggcaaaaagaaggggattcattagcacgctatttagtacgaatcggtgaaatgagggaatccatcaaaattattcaacaggctgtagaaaaaattcctgggggcccttatgagaatttagaagtccgacgctttaagaaagcaaagaattccgaatggaatgattttgaatatcgatttcttggtaaaaaaccttcacccaattttgaattgtcaaaacaagagctttatgcaagagtggaagccccaaaaggtgaattaggaatttatctggtaggagatgatagtcttttcccctggagatggaaaattcgtccacccggttttattaatttgcaaattcttcctcagctagtcaaaaaaatgaaattggctgatatcatgacgatattaggtagtatagatatcattatgggagaagttgatcgttgaaatgataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatatccgcatcgatacaacaacgtattggtcctgaatatgctggccccctgggactgcttcaagctatagcagatggaactaagctactttttaaagaggatatcttgccatcccgaggggatattcccttatttagcattggaccgtctatagcagtcatatcaattttattaagttttttagttattcctttgggatatcgctttgttttagcggatcttagtattggtgtttttttatggattgccatttcaagtattgctcctattggtcttcttatggcaggatatagctcaaataataaatattctttttcaggtggtctacgagctgccgctcaatctattagttatgaaatcccattaactttttgtgtactagcaatatctctacgtgcgattcgttaaaataggatctttttcctctgaaattcattgaatatttatcctccttttcttattctatattcaggttagtaagttaaactagatagctatatgagtgaaacaaaactgcttattaatttgtagtaaaaagaaaaaatctcatttcctatgtacaagaaaaaatggaagtaaacataagcggtgtaaattctttaccccaaggttgagattttttgattagtcatcatatcttgaagcgggcaataataagggattcccgatacagaaagttgtaatcataagggaatccatcaaaagttagtgagggattagaaacactaaagtacataaaggattagtaatgagggaatctaaagcattagatatttttcctcataaaaggaatcataataaggacttgaaattggtggaaatgagcaagtagtactttcttcggattccgatccagagtatgttcccattcacttgttaaggaaatggctatcaagaacgaattaaccctttattccttttttctttttaaatacccctcggggaaagaagaataggacaaaagatatggaatgcaatacaaaaaaaaagatctttatttattctttccgtcgtttatccatattcatacagaattcttcatgaactaatacccaactcttttcgtttattaattgttataacgagtgttttattccaagattaagttattgctgaacaaagaaaaagtaccattatattataaaggatgagatgaattccgaagcgttttttattattctagcagacagaattcctttggtctaatttaggacgttgaaatcgattttatcttagataattctaactacgcccaagaagataataacgaaatgaaacagtactttccttttttctgatcatagaggagccgtatgaaactaaggtttcatgtacggttttggaatagcggtgggaactgtgatgttatcgtcgactatgattatccaacagttcaagtacagttgatatagttgaagcacagtcaaaatatggtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatggtttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatctttattacattaactaaagcttatttatttctcttcatttctatcacaataagatggactttacccaggatgagaatggatcagttattaaatcttggatggaaatttcttttacctatttccctgggcaatctcttattaacaacttcttcccaacttgtttcactataaaataagataatacaataacagtaagaatattttcaacacaaaagtcctctcaaacaagagaaagaaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaattgctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattctatattttattgaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaactcatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggagacattttcgcaatttttgttatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatagtaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaagcccaaaattaaagtctcttggctcttttcatgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagacccaatgtcacattccgtaaaaatttatgatacatgtataggatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctctttaccgaagaagcctgtgctcaaaataatcgagcacgggcttttctggtcaaaacgtatcttgtctttatcactttatcatgagttcttttccttggttaacaatacttgttgttttgccgatatttgcgggttcattaattttctttttacctcataggggaaacaaaatcgttaggtggtatactatgtctatttgtttattagaattccttctaatgacttatgcattctgttatcatttccaattggaggatcccttaatccaattaaaagaggattctaaatggatagatgtcttcaatttccactggagattgggaatcgatggactttcattaggatctattttattgacaggatttatgactactttagctactttagcagcttggccggttacccggaattcccgattattctatttcctgatgctagcaatgtatagcggtcaaataggattattttcttcgcgagaccttttacttttttttatcatgtgggagttagaattaattcctgtttacttacttttatccatgtggggggggaagaggcgtctctattcagctacaaagtttattttgtatactgcaggtggttccatttttttcttaatcggagttctaggtatgggcttatacggttccaacgaaccaagattagatttggaaagattaattaatcaatcataccctgcaacattggaaatactattttattttggcttccttattgcttatgctgtcaaattgccgattatacccctacatacgtggttaccagatacccatggggaagcgcattacagtacatgtatgcttttagcgggaatcctattaaagatgggagcatacggattgattcggatcaatatggaattgttacctcatgctcattatctattttccccttggttagtaataataggagcgatgcaaataatctatgcagcttcaacttctcttggccaacgcaatttcaaaaaaagaatagcctactcctccgtctctcacatgggtttcattattataggaattggttccataaccaacattggactcaatggagctattttacaaatattatcccatggatttattggggctacactttttttcttagcgggaacggcttgtgatagaatgcgccttgtttatctcgaagaactgggaggggtttctatcccaatgccaaaaatttttaccatgtttagtagcttttcaatggcttctcttgccttaccaggaatgagtggttttgttgcggaattagtagtattttttggactaattactagtccaaaatttctgttaatgccaaaaatgctaattacttttgtaatggcaattggaatgatattaactcctatttatttattatctatgttacgacagatgttctatggatacaagctatttcatgttccaaacgaaaattttgaggattccggcccgcgagaactctttcttttaatctgtatctttttaccagtaataggaatcggtatttatccagattttgttctctcgctatccgttgacagggtagaggctctgttatccaattattatcctaaataggattttttttcttctactagtccgctctatattccatagtggaaatactcaaaaattcagaaaaaagtaaaagagtctaattagatctatctcgaatttttgagaaccctttgagaaggcgttcaaggggttctcaaatcaaacacaaaaatggaagttttttccatttcattaaggttttatgttatgtaatcatttagatgggtaatgtaaatgaaccataactatgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctttaggatcccaattccagtaggatccccacgcctcattagcccatactgctccacaaagaatacctatggttaaaagggtaaaccctagactaatgacacgataactccaagaatccaaacgctcaattaattgatatttgtaataatttggaaataaaggaaaaaaggtgctttttaaagcacttctttttgcatagaaatattcaatctcattaaagaaaaatgttttgcttaaaacatttttcttctttttcgaaaagaaatctaaattctttcgaaatctaatcattagaagagcggcggataataaggatccgcacaaaagagtcgcatagcttagtaacatcatactgacatgcatcattaaccactgagattgtagagcaggtactagtattgtggattgatgcatttcagttaaaagacccgacgtggcaaagccttgcgttaaaatagtactcggcgtagttattgtgcttaaatcatttttagagttctgtatcttaggaatcatatgaagaatatacagagcccatgaaaggaagatcaatgactcatataaattacttaatggaaaatgtcccgaagaagcccaacgagaaactaagaatcctgttatacagaaaaaagtggctatcattcctttttctgacgaatcacgcaatcccccaagttcacgaactaataaggttattaaatgaatcgtaatcacaattgaaattgttgagaaagaaatatgagttagtatatgttctaaagttgcaaatagcataaggagaaggtcccattacaaaattggaaatttcgaattgaatccattttattttataatctattgtattctttttcgagactgccgccactcggactcgaaccgagatgcttgagcactgcttcctaagagcagcgtgtctaccaatttcaccatggcggctaagttgaaataacaggtttattaaaagaatattaagttattttctcgcgaatcgtcgagattggaagattccatagaatttaggacattagaatcttcattaaaatagacttcgtttggtagtatcgttgcgaattttttaacaaaaaaattcttgctttgcccaatagaaactttgaaagagttggaacaattttttctcagttgcaatatagaactaatttttttgttaatttaggataagataggtagaagttgtaagtcttattgcaggaatactctacttttcataatagaatcccctttttttatttattatacggattctattacgaaaagttcattgataggaaaagaatatttaggtcacagtataccaaaaaccctttttttatatatcagagaggtttgttctaagaatattgtaccgaggaattcgacacataaaagtaaactcattaattaatcctaattattcctaattattcatattaaataattggaatttttgggggataggtcaattcatattatcccaaaaccctattatttgtttgttgccgagaaaaaccctttggttttggatgctcgctgacgccagaaaatgatcttgattttgctaaagaataagattgtactatggaaaaataagtctttttcttccaaagatttttacgaatacgcttttttgacatcgaagtacgtttttttggaactgccattcaaaaaggaaattacttttttctagttgtatgtgaaagacatctattgccgcaaatcaatccatctttcttctttttcttagtatttatacttagatactaaaagatattgaaattctgaattcttttttacttcattttgtctaatgcggataagacaagagttttttaacatattatatattttttttagactttgttttaataatatagaatatatacaaaggttttctatttaaatcaatttatatttcaagtatactctccatatacagatataaggtatgggggcctatcccccatataagacgggaggataaaaggaagggaaaattcaatcaaatagttaattaaagtattccagaattgaattccaatcaatttgagttacgaaacaagggagctgcttcattttaatacaaaaaaatattaaagtaaaatgattcaatcttttttttgtattttaataaaagtccttctttaggtaataactaggtaacgaagttatttcattaactttttgactttaaccaacaaaacctattcttattttttgattgtttcaatgagaaaatttttgaaaaattaagaattctagtatttttttattccttcagaaatagataagaattagtttggtgaatcggaaacttttttcaattttatagaaaaattgaagtaaaattttcaagtaaaaattgcaatttcttttcttatggaacatacatatcaatatgcatgggtaatccctcttctcccacttccagttattatgtcaatggggtttggactttttcttgttccaacagcaacaaaaaatcttcgtcgcatatgggcttttcctagtgttttacttttaagtatagctatggtattctcagttcacctgtctattcaacaaataaatggaagttctatctatcaatatctatggtcttggaccgtcaataatgatttttccttagaatttggatacttaatcgacccgcttacttctattatgttaatactaattactactgtaggaatcctggttcttatttatagtgatgattatatgtctcacgatgagggatatttgagattttttgtttatataagttttttcaatacttccatgttgggattggttactagttccaatttgatacaaatttattttttttgggagcttgtgggaatgtgttcctatttattgataggcttttggtttacacggccaattgcagcgagtgcttgtcaaaaagcttttgtaactaatcgtgtaggggattttggtctgttattaggaattctaggttttttttggataacaggtagtttagagtttcgggatttgtttaaaatagctaataactggattcctaataatgagattaactccttgcttactattttgtgtgcttttttattattccttggtgcggttgcgaaatcggcacaattccctcttcacgtatggttacccgatgctatggaaggacccacccccatttcagctcttatacacgcagcaactatggttgctgcggggatttttcttatagctcgacttcttcctcttttcatatccctacctttgataatgagtttcatttctttaataggtacactaacacttttcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattattcttgggatccggatctgttattcattcaatggaacctcttgttggatattcaccagataaaagtcagaatatggttcttatgggtggtttaagaaaatacattccaattacaagaacttgttttttatggggtaccctttctctttgtggtattccacctcttgcttgcttctggtccaaagatgaaatccttagtaatagttggttatattcacccttttttggaataatagcttcttttactgcaggattaactgcgttttatatgtttcggatatatttacttacttttgatgggtatttgcgtgttcattttcaaaattacagtagtactaaagaggattcgttgtattcaatatcgttatggggaaaaaggatatctaaaggagtcaatagagatttcgttttatcaacagcgaagagtggagtttcttttttttcacaaaatctatccaaaattcatgttaatacaggaaataggatagggtcctttagtacttcattggggactaaaaacacttttgtctatcctcatgaaccgggaaatactatgctatttcctcttcttatattactgctttgtactttgtttattggatctataggaatccattttgataatgaaataggggaattaaccatattatcaaagtggctaactccctcaatcaactttttccaagaaagttctaattcttccataaattcatatgaatttatcactaatgcaatttcttctgtaagtctagctatttttggtctattcatagcatatatgttttatggatctgcttactctttttttcagaatttggatttaataaattcctttgtaaaagggggtccgaaaaagtattttttccatcaactaaaaaaaaagatatatagttggtcatataatcgcggttatatagatattttctatactaggacctttaccttgggtataagaggattaaccgaactaacgcagtttttcgacaagggtgtcattgatggaattaccaatggagtaggtcttgctagtttttgtataggagaagaaattaaatatgtagggggaggtcgaatttcgtcttatttattcttttttttatgttatgtatctgtgttcttattcttttttctttcttaaggaattcccctatctcctgcctaagtagctttcctatttgccgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaaacgttgacgttttcccaaaagtcttcggagacctctttccgatgaaaaatcttttttgtgtaattccaaatgtgaagcaagtctccgtatcttattggtgaaactgaatacttgaaattcaacagaaccccagttttcttctttttcttctttaaccataaatccaaaaatttttctacctcctttctttttcatgtatttttctgatcaggaaaaataaaaaattatgtcagttattttgaagttattctaatctcg

SEQ ID NO: 30136 - DNA, 610 bp, Oryza sativa
ggtcgtaggttcgaatcctacttggggagatttgattcattctttaatgtaagaataaagaattgaattaaagggcttgctttgacccttaggagtaggtaacccgttcgctatccttgtttgtattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctatgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttggatttggatctttttcgtatttcaaaatagtgaaaaagtcaaataagaggtgttaagcttttt

SEQ ID NO: 30137 - DNA, 539 bp, Oryza sativa
gaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttact

SEQ ID NO: 30138 - DNA, 47474 bp, Oryza sativa
  unsure (1)..(47474): unsure at all n locations
aatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcaagnnnnnnnnnnnnnnnnnnnnnaagactgaaaatcctggtgtcaccagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaagaagatccactatgttcattgcataataagctcccttgaaaagcattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttnnnnnnnnnnnnnnnnnnnnnnnnnnnnnnnnnnnnnnnnnnnnnnnnnnnnnnncaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaaaaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctttcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaagtaagaagtctccccatgggggagacttcttacttcaattagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctgccagctatggaaatagctgctctagctacagtttcggatactccgcccatttcataaagtattcgacctggtttaacaccggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatttgaagcgcatggatacaagttatccttggaaggaaagacaattccaaatccgctttatctacgaat

SEQ ID NO: 30139 - DNA, 169 bp, Oryza sativa
tgggatgtcaaaatgcatcggtaggggagcgttccgccttagagggaagcaaccgcgaaagcgggggtcgacgaagcggaagcgagaatgtcggcttgagtaacgaaaacattggtgagaatccaatgccccgaaaacccaaggtttcctccgcaaggttcgtccacgg

SEQ ID NO: 30140 - DNA, 1227 bp, Oryza sativa
  unsure (1)..(1227): unsure at all n locations
cgaggaccaatgtccgtctggcccgaggaaacctttgcacgcctccgttaccttttgggaggcctacgccccatagaaactgtctacctgagactgtcccttggcccgcgggtctgacacaaggttagaatccgagctcttccagagtggtatctcactgatggctcgggcccccccggaagggggccttcttcgccttccacctaagctgcgcaggaaaggcccaaagccaatcccagggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgccggcttccctgtcatcagttcaccaacttccttgaccttcggcactgggcaggcggcagcccccatacatggtcttacgactttgcggagacctgtgtttttggtaatcagtcgaccgggcctggtcactgcgacccccttttgcaagggggcaccccttctcccgtagttacggggctgtttcgccgagttccttagagagagttgtctcgagcccctaggtattctctgcctacccacctgtgttggtttcgggtacaggtacccctttgttgaaggtcgttcgagcttttcctgggagtatggcatgggttacatacttcagcgccgtagcgcctggtatgagcctcgtggagaagcaatggctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcctccgtccctccgtaccaacaaggggtnnnnnnnnnnnnnnnnnnnnnnnnnnnnnnnnnnnnnnnnnnnnnnnnnnnnnnnnnnnnnnnnnnnnnnccgtggacgaaccttgcggaggaaaccttgggttttcggggcattggattctcaccaatgttttcgttactcaagccgacattctcgcttccgcttcgtcgacccccgctttcgcggttgcttccctctaaggcggaacgctcccctaccgatgcattttgacatcccacagcttc

SEQ ID NO: 30141 - DNA, 175 bp, Oryza sativa
tccctctccacgatgaagcttatcccccatcgcctcactggcggaccttgacccctgttatttttgggtcatatgtagtattcagagtttgcctcgatttggtaccgctcgcgcagcccgcaccgaaacagtgctttacccctagatgtccagtcaactgctgcgcctcaacgca

SEQ ID NO: 30142 - DNA, 134 bp, Oryza sativa
atgctactcgggtcagagcgtaagctagtgatgctttcggctactggactttagccatctagggtgcggcactcaaccgcttcgcctagcagcacaacgcttgtattgctctcccacaaccccgttttcacggt

SEQ ID NO: 30143 - DNA, 10809 bp, Oryza sativa
gattcatgtacaggaggcacctaccagatctgacagtgatgctaagtacacaggtttgttcttttagtctgatatgtgtataatttgcctagatgatttatcattttttaaccttatcctttgtcattatattggttgatacagatccaatagatttgtcttgtttttcgggcattattcgtcgggatgcaaatgagaaaagccgtaactgctggacagtacctgatagcaagctctttaaagttcgtagtgagagctttccacatgacaaatcaaaggtccaaacattaaaagtggcacaacaggttttcctaattctgaagtatagcaggcaattaagagcttagtgcatttcctacctgactttacaggttcccgcaacaaagtaccttatggagcttgtagcaatcgactggcttagggacataaagcgaatggatcatgttgctaggcggaaaggatgtgcagctcaggtaagcaaatagtttatggttacttcatgctctacccacatctaggtgcccttctttctgaaatccactattacatgattatgtctatgcttaaaattccagtgtctaatatgcaaagtagcacttgaaaattggaataatatagaacgattaccttttgcagaactgtttgttctaccagaattgtacttgtaaacaaatcggttttccaaactcttttcatcgaccttgtgtgtgctatcaatcttttttcattgcatattaaactttagctgtgtagaagcttcattgcttcaggtagttactctgcgttctagtagtgagcactttgaatatgtacctaattacttatatgtatcctgtgaacaaataacctgctgtaagatctacatatgtgtaaaattatgaacgttgatacagtttgacagaattatctggactgtattttaattgatctttgttttagactttatcttgcatagtttgaaattggaagtgcgcgtcacttcgccattacttaggataggaaagttgatgagaatcagtgagatggtgcaatcagcaagtatctcacaattatgttaacagagttgatggtttttgcttgaaactttgttgtgatgttaagtgttttccagtttgactattgataaaagagatccttgcacatgcatattatatatatggtactgaagacaatcttccttatctgcatgaacttaagtgaggtcctaatgaagtatatctactatactaatagtatgatgattctcattgaacttttaccaatgtaggttgctgctgagaaggggatgttcacctttgttgtaaacattcaagtaagatcatatttcttttatggtctctcctccatggctagtttctttctgctgtgctcacggggttccttacaggaagagaactcctggttttcactttgacaaattgtttacgctttgacaaactagttccttgcacaattgctattagaagaaaaatagaactccctggttacactttgacaaaaccctagctcagaatctcttgtttttttttgtttgattaacattgccaatgagagcagatgcagtgacctgctgtgtagttttcaatgatcataccagttttgttggcttgtttatagcttaggccggattattttgttcgcttagagaaaaaaatcattattgctttcagttttcccttgaaaaataccagttttcattctgtgattccatcagggctcgtcttctttattttggtcacgctgatcaggtctgtttgcatttgcagattcctggatcaagccattacagcttggtcctctattttgttacaagaaccttggaaaaaggatcactgttacaacgttttgctgatggcgatgatgatttccgaaatagcagattgaagctcatcccatctgttccaaaggtctggtctaactttcggagtgtatagccctgttgatttataatgaaggcctttctcacttgagcatgttgatttcttcagggatcttggatagtgcgacagagcgtcggaagtaccccttgcttattgggaaaggctgttgattgcagttatatgcgtggtcaagagtacatagaagtgagacactgaatataggcaccttaaatattaacacaacacaactcctattattttaattactggagaaatacattattcgagcatgtaaatacctggcaaagttgagatatgactgaagcagtagaacattaggttatttagggcatctcttgaacaaacaaatttatttttgatattgttatgcaggtagatgtagacattggttcctcagcagtggccaatggtgttctgggcttggtgtttggcgtcgttacgactttaatagttgacatggcttttcttatacaggtatgtatgctcagtggctccctcattttcttcagtctttactctccaagagcacccttttggctcagccgcagccaaaactaaaattttgaaacttaattttagaattgatcttgaggtttttcttaacatagtttatttttcagcatttgcttttaagtcggtaatgatatataaaagttttactcaaattatttttgattcctaataagccgttttacggtttatcagctgtaggccaaatgattaaactgcaagatccagtttgaactttgaagacttatgtttctatagctaataaacagtagtatatctcaactggttcacatttctctacctttacacttgcaggcaaacacatacgacgagctcccggagcaacttctaggtgctgcacggctatccaatatcgaacccagctcagcaatagttcctgtacttgataaatagctcttcaagggaatgaaatcaattgaagcagattctttaattctttgctcggaactccattttctgttgattagctgcagcagtttgcagtttgagacggcaaaagtgtcatttcaggactggaagcgcgaccatatcctccaatctgtctttacagttttcagatttttctgacaccatgctagtaggtatagataacatatagtatgtgattatacggcattatacatacagaaaaaaccaattcatgtacaactcaacgtggtaccttgctttttttttttctctttgtagccaattgttgtcgatctgacacctcaattagatgctctcttcctctcctggatgtaaattgaactcgttatcacttgcttggcctttgagattcctatatacttcttagttttatattcaatagagtgtacttcctccgatttctaatgtatgatatcattaatttttgtgatatgtttgaccattcatattattcaaaaagtttatacaattatcatatatttagttgcgtctttatttatcattaaaagttctttaagtattacttatattttgtatgtttgtaaaaaagatttgaacaagccaaatgatcaaataaatgtctaaaagttaatggcatgatatattaaaaaccggatggagtatatagcctttttacagatctgtaacctacacgtttgagtttgaatttttcgacctgtaaattactcggatttgaataatgtcgtaaaagacatcctgaaacttcataaacacgccattgctcgcattgctcagtactatcagccaccagtgtgatgtttcattcactgggcttcattcgtcctcaaatacggcctactaaaagcccatctaaacacgaacctcacttcaacgccacgcagctttaaattcgcgattccaaaccccagccttcgttgcgttgtcccttctcccttcactccgctagggttttaccccgcgatggccgccgccgccgccgccgccgcgcggaggctcctctcccgccgcgccacctccttctcggcctccgctctcctccgccgcggcggccccggtgcgccggagtcgctgctgcgccccaccgtcgccgcggtctcgcgcgtcggcttccttcgcgggttcgcgcggcggccgggcggcgatgggtactccccgatgcggtccggtggcggcggaggaggaggcggagaccgcgcgccgacggagatggccccgctgttccccgggtgcgactacgagcactggctcatcgtgatggacaagccaggcggggagggcgccaccaagcagcagatgattgactgctacatccagaccctcgccaaggtcctcggaaggtgaagcctctctctccgccgatttgtctctcagtttgtgctaaccttgccatgtatttgctcctcacttccagttagttggttcggaggtcgatttcttatgtggttgtgtttgctgcagtgaggaggaggcgaagaagaagatctacaacgtctcctgcgagagatactttggtttcgggtgcgagatcgatgaggagacgtccaacaagctggaaggtttgttccttgcctatgttttggttttataaatacctggaatgagaatacttttagcgcactgtgtgtgttcatgtatctgatgcactatgtatgtgttgtatgacagggcttcctggtgttctgtttgtcctccctgattcctatgtcgaccctgagtacaaggactatggaggtagctttcttgcacaacctcacaacttctgcaggttttcttaggagatcaatggctttgtcatttcatatgatcactgattgactgatgttgtagatactatatcctaattggcccccctataggcatttgttgcttccatttttacaggataatgcgatcgaagttaaagtatattttaatagaactgcatcaaaatgaaatggaacattgtctggataccgtatgtagactgttttcatggcatgtgagcctattccgaccacatactgatgttttgctagtagtccatcttggcaaagctgtgaagccatataggcaatgccctgctttgaatgctaatggactgaaaaaaatgtctctctaacggttcggtaccttggtaaaatggggttctgatcagtggagatgagacattaagaacactttaccacctcttcagtttttgattaattcaaggctttggtctgtttaccaaacctgtagtccatcttggcaaagcggtgaagcctaatcggcaatgtcttgctttgaatgctaatggactaatagcaaatgtatctcacggttctgcaccttaccaaattggggttcagatcagtgtagatagagacactaacagtgtatttactgccacatcccccttgagtcttgatgttttactgttttttaaggatttagtatgttgttgactcaatactaaattgctgttctagacatactagtccatcttggcaaagcggtgaagcctacttggcaatgtcttgctttgaatgctaatggactaataacaagtgtctctccaacggttctgcacctcaaatgaatggggtacaggtcagtggggatgaaacatgcaatatgatcatgccattaaacatagggaaattgaaatttatgctatgatgagttagaatccacttcccaatgttccttgactagaatgtggcaaatttagctattaaaacaattttgtgtttctctcgcttgcttgtttcataacgatttggtatgttgctgactcaacagtaccaaactgctgttctagacttcacagtccatcttggcaaagtggtgaagcctatatggcaatgtcttgctttgaatgctaatggactaataaaaaatgtctcttcaacggttctgcacctcaaatgaaatgaggtacaggtcagtggggatgaaacatgccaacatggtcatgccactaaacatagggaggttgaaaattttccctatgacaagttagaatccgctttctaattttacctgatttgaaggtggcacatttagctatataaataatttagggtggctttttttatcatatcatttatggtttcttactgaatgtgaatgaatttatgcacttccccatggatttgtgccatgttatgcagtccatcttggcaaagcaagatagctatttaggcaatgccttgttttgaatgctaatggacttaaagagaactcttctttttctcttctgctcttcagtacagtgaagctgtgtggatcagttgagatgaaacatttagaacttattcgtggtcactggctttaactgtttgtatttgagacatcagaggttacattaaatgcatcattgtatttttggttaatctagtttgtttagagtagatattacatgctgaacaaaatctgaccattgtgtgaatctattggcttgaggttggtaggatgagttgctctgctgcactctgatttcttggaaagatattatactcatgccatataatctatttctattttgttttacagctgagctcttcgtcaatggagagattgttcagaggtccccggagaggcagaggcgggtagaacctgtcccacaaagagcatcagataggcctaggtacaatgacaggacccgatacgcccggaggagggagaaccaacggtgatctgattatcagaagccaaataacaaagccgcctgggtggcttgaggccttactagcatatgctgaatggaacaatctaaaaattgctttaatagttttgtcgctggtattgctatttttcatgctggtgattctcacatctttggatgtatcgcattctgtaattactggaaaacttgaaagtacctggcttggaatgcattgctgctgctgaactcttcggccatgtgcacacttgtaaatcagttagatgattttcacagcgagctacatgtcgtctactctgaatttgttttgttatgttttttggtaaaatgttacgcgtgaaagtgtgattgcatttcttgagttagaactcatcagtgatcactggtcgagaacttgtgaccccaaccaaatcaactcaatttcaattttgaagtttaactctcagtgtcagccgctggactctcagtgatcagtggtcgcactgcagttaaccctcagtgttagctgctgatttgaagtataactcgacgattttatcctgcgaataatcagtgaaatatcccttgccgacggagaggccctcgccggcggcgagccgctccaccatgccctgcacctgctcggccccgaccctcgccgggtcgagcaggttgcaggcgacctccacgacgccgccgccgtgcgcgagccccatcgcctgcacggacgggagcccgccgccgcgctcgctgacggcgcgggcgatccgcctcgccgcctccacgtcgccggtgcggacgggcacgttgtagttgtcgacccagccggtggcgccgacgaccaccacgcccttggatctcggcgacctctccggcccggcgtccggtgcgacgggcagggcgtccgtctccggcgctccccgccattggtcgccggaggagttgggcttgaagtagccgagctgcctcctgatggaggccagcgtcctcccctcccggtgcaccgcgccgaacagaaacgtcggcactgcggcggaggcggcggcgccggcgagggggtgagcggcgcgacgagcgtgtagcccacccggttgtaggcgtcgtcggtgaagcggttgacgacgacggcgccgccgccgcacgccgcctgctcgatggcgcgcagggcggcggcgttgcggctctcggagatgtagagcttgcagcacgccagcatcgtgggcctcgccatcgtcgacgtcatcatcctcctcttctccggcgatgtggagatgaacacgagaccagcatttgctgtgtgaaggagagcgtgtggacagaattcagcaacgcatgcagcctttggattcgacgaattttggagttctctttttctacaaaaagcgaactaattcatttgaaaaatcgtgtaaaatttcataggaatctcaaaaaaaagagtgaattgcacattggtccacctattttcaccaatgttgcagtttaggctaggggcaaatccatattttcaccttgggctagctatgtttacaaattatttcagtttgaacctgtcctccagttctctcgattcctcctctctttcttctccaattgcccaggcatgccgatctgagcaaggaaggccatgtttagtagtgtagcatagatcaaggtcaagctcagctcccactgcagtatgtgctctacttccttgatcttcaccaaagcctttgcagtactatatccactcgtcggtggggctgcagtcaccaagatgtgcatttgcttcgtctccaccgaagaggagcaaggctagaccaatcaacgagctcgccagcactacggggtacgtacgtggggtagtggttgtgcttgtgcttgaccagctctccttgctggcactgagaacctcgagctccccccatgtgggaagagagcagctcgtcgagcaacaccacatcaagctaagtgaggaagaagaacacattagtcactaacgcatgggcccactagactaaagtgcaaattatggtaacaaagtctggtccaagttgaaaagatgtgttattgcctagtccaatttgcaacttgggtaaataaaactagtccaaagtgaaatttactccaaaaaaaaatggcatgcaagaactgcagaattcgtccgatccatcctcagtcacattagtcacgacgacgaattatatgcagacagaaatgcgagacaaatatttggattgttttttaagcaagttaacaaattccaattcagcacatcatctgaaatactaattcggtgccagcatacaatgcataaaaagatttatgaactctgttctgttccagtgtcctttccagcaagaattgctgggaacaaaattgagaacctgaaaaatgaatagagccaatatcaactcaacgagtggcacgagtccagaggttggtaccgtgagttccatactttcttaacacacaaaattatacaatacaggatcctgccgcctgtctcactgatgctagtgacattaggagattgcaaacatcaggcggcgtggtgtatattattcccagctacaaaatttgaaactgctatatgtcggcatgtaaaattccatgcatccaaccaaactatatcttcttgcccctgcaaatttcaggcagcagcctattctatctcgcgatatatgatgagactaaagcactaatcaaatgtacgggtcgctcctaaaatcagctatcccgatgctcctgctgcctttgcgtctttctcctcttcagcttgctcttccttcgcaaattcctcgatcagcacgcgctgtctcggtgtcaaattcctgtgtataagtaatacatgaatatttgaacagaagtactagtaacagcatagggcagttcagtaagttccgaggagagcttacgcagggatgttgacattgaagtggacatactgatctccatagtacgatgaatttctcgtcttgattcctgcaggataaagtgatgcttatcactataggcaaaatgaaatgtatcaaccgctacaaatttatgagccatgacggcactgggttttaataaaacaaggcccttgcagactccatttttacttggatgtgtaactgagcatgaagtattaaacatgcagccatatgcaatttatgctaactaaaaaaaaaattttgccccacgaaaaggtaaacactatgtagtgcagtttaccttttcctctcagaaccaccttttggccaggctgagtaccaggcttgacctgtaatatgcaaggcagatggagaattccgacataataaacaaaggagaagattgaaaatgagggtaaactgattttggaggtacctttagaactacatctccagagagagttggaacctgaactgtcccgcccaaaattgcctacaaagatgtttgcagttaatcttaatctgaatactgatgaaatatgagaactgtggaggagatgcctactcgacaacattacaagttttgtttagtatcactagagattatcagacaatcaccacagcatcgttactcgctagagataacatactttagctagttttaacattcaaactactgtgaaaaacaattgttgtttgcctgctctgtggcaaataaggaacagtctaataacaacagtttgttctaagattaaagggaacagacataatctgctaacactaacttgttatcacccagccctagaaggctatgcacaatcctgcttacagaccactaccacactcccactcagattaccagctcagccaaaacagaatgtagtgacaacgaagtatggccggtaactgagtttttctgttttcccgctagggatgtccattactgagctgtgcagtggcaaatataagcataggatgcagaaaaaataatcaggctcaacttacctgagtcacgttcaatacagcatctacatgaatatcacctttctctcttcgaaataccggatcctcacgaacctggaaaaaacagcattacaaaggtcatctgcttatcatctttttctcaaatatgcaggagagccgtgcatcattgcatcaaggggaaaagaattggaacaaatgaccagacactactcttgcactgggatcaacctacagctagttgcaccgagtgcttggtcctgtctgatcccaaagtaaggtttcaactgcctattaccattcattggccaatggtataactgctaatgtgcaaagactaaccttcagagttacataaagatcgccaggactaccaccatctggatctgctccacctgatctaaccaactttataacgtcaccatcatccgtacctgaatgaacagaataatgctcaaggacattt

SEQ ID NO: 30144 - DNA, 5816 bp, Oryza sativa
  unsure (1)..(5816): unsure at all n locations
caagaggttggagctcttgttaagtttcctcaaaatctatatacgatgaggcattccataggaatttcaatagatttggaaaacttcaattctttaaattaaattgtcacatagaaaaaattcatataggattctaaatcctttgattaaaggggctataaaggttcaatgcggcataaaactttatatgattttcatgagcttgttttttccaccaaaaatcgaaaatatatcatacattctaaaagagttccctagtagtactcgtctcctaccatacttcacatgagctataagcatggattaacttgtacccatcttgtttcaaaataaataaaactagacttatttatctagatttatagtatcagtgttatttttatattagatttatttattttttttaaaaaatttctctttacagtatacatttgtttattttaagatagatttttgggacgcactccctccatctagaaaaaaattccaatcctagcatcccaatgtggaattggtgaagagtgagaatgactaaaatacccttaatcactagaaaaaagtagtaagagtagtaggtatgtaaagggtattgaagagataaaacttctcattttacatgctgaaagcaggtagaatgatagaagttagttttctgtggaataaaattaaaactctaaaaattttaaaaaaattgacggagggagtaactcaacgtaggagcaagcaacaagatccactcactagtcaccgctgtcctaacagccctagataaggatgagtgcagttcatttcaggaaggggaaaactcgagattgcccctgcaagggtgggctgggcatgaggaggcaggcaaggcaactgaaccaaagggagggtacagcttacaagtaaagacaggcagccggccaatgtggggcaacccaacccagcaaccatattattatactaacagtagtattagtgaactattatttactccttctgttcaataaaaaataaatataatacgagatgtgatacggtactattaatttggaccagagatatctaaattcatagtattaggatgtatcacgtttcgagctgtatagattcgtagtactgatgccgcactatgttttttataggactgatggaataataataatttcttgttagaaccaagttaatactaaggtggtgtttagatccagggacttaactttagttcctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtttcgcaaattagtccaagattatggatgggttttattaatagtctacgtttaatatttataattaattttcaaacatccgatgtgatagggacttaaaagttttagtcccatctacacagggcctaacttaacatccatatagatgtaggttttgcttgaagagattaagactgtgtttagataaggggtgtaaagtttttgcgtgtcacatccgatacacggacacatatttgaagtattaaacgtagactaataacaaaacaaattacagaatctgcctgcaaattgcgagacggatttattaagcctagttaatccgtcattagcaaatgtttactgtagcaccacattgtcaaatcatagagcaattaggcttaaaagattcatctcgcaatttacacgcaatctgtgtaattagttattttttcgtttatatttaatactccatacatgtgtctaaacattcaatgtgacagggtgaaaaattttaccaggagatctaaacaaggccaaagatggtaagacacaacttataataataaaaagaattggtcatatcaatttctactctgtcctaaaataacataacctagatgtgtccaacgattatggacatcctaaattaaattattttgtaacggagtgagtaacttctagcttctattttagtagtttactccctctgtcccataatataagggattttggtgggatttgacatatcctaggactacgagcctgtccagatttgtagtactagaatgtgtcatatcccgttaaaatctcttatattataagacgttatattataagagggatggagtattttctaggattatgtaactacccgtttaaaaaataattaaaattataatatctaattaaaaatttagaaagctaaacaagacctaaataggtatagatactctaggaggaagaaagaagcagatccccctctcctctccctctcacactcacacgctgcagcagcagcagcagcagcagctttcccaccgactcctccccctcctccattaatggccgccaccaagaaccctccaacccccacgtgacctcctcctcccctccccctccccctccccctcccgacctcgccgccggcgacctcccttcttcttcctgcttgcctgctcgcttgcctgcctggttcgaccgatgctgagctcgtcgccctcggcggcggcgccggggataggagggtaccagccgcagcgcggggcggcggtcttcacggcggcgcagtgggcggagctggagcagcaggcgctcatttacaagtacctcgtcgccggtgtccccgtcccgggcgatctcctcctcccaatccgcccccactcctccgccgccgccacctactccttcgccaaccccgccgccgcgcccttctaccaccaccaccaccacccctctcgtaagctctctctccatcttttttccacaaatggtccatctcttgtttgcttcatgcttgggtattcaaatctgagaaaaatttatatatgtgtgcgcgtgtgctttcttgggactttttcttttttttttgtttcttctttcaggacaggatctctttgctgccctgctcattgggattgatttgctattgctctcacgatttattgatagatgaacgtacacggatctttgcttatagtatgtccgtttaagctgttcgattgattctttgctcactcttatatcctaagcaaattaagcatatagtagttattaccattaccaactttgcattgggttgatgaaatgttgaagtggtgcattttgatctagttttaatatgaacaatgatgaatgctgatatggattcaatgtgcctgtgctcatgtcactgcagtgagctattatgcctactatggcaagaagcttgaccctgagccgtggcgttgccgccgcaccgacggcaagaagtggcggtgctccaaggaggcgcaccccgactccaagtactgcgagcgccacatgcaccgtggccgcaaccgttcaagaaagcctgtggaatccaagaccgctgcccctgcgccccagtcgcagccccagctgtccaatgtcacgaccgcgactcacgacaccgatgcgcctctcccgtcactcactgtgggtgctaaaacccacggtctgtcccttggtggtgctggctcgtcgcagttccatgtcgacgcaccatcgtacggcagcaagtatcccctctaatctcattgactctgtgttgaatgcttatttgaattaagcttgcctagattgattgcatattatgctggaatagagctgatctggtagctttcttaaaagggttgagacactcaaaatagtatttgagctctaatgttgttgatgcttattgctcaagtagtgaacctaccctcattccagtaattataagtgtgtgaggctgcctaagaatttgtcgatcagagcttattcaatgagttagtcagatgagtgatactgccaatttacatgtgaccataaccccaactaaaaattttgtacctggattatgttagttaaatctgtgtattgcattccatccatccttgatgctacaaacctctgtgggcacaatgtcataagcatatgtctgttgcttgtgcctttagccctattatactgttgctttttgcagtaatattgtacgcttttccagatcacctaagccctagctgattttgacctttattgccctaactcctgattatgttttgagaaatagtgttaacagttgtcatgttctggggtgtttttggtccatgccctctaaaatcttggtaccgtcttttttatgctggaaaattttgcttgtgtcatcttttttgtgtgccataccttagtttagtatttcctcctctgctagcaatcacaaaataaaaatattggaccttcgacaccatccttatgcttgtgctgcatgcatggcatatgttctagtttcgtgtcattttgcatttgcatcctgctagatgactgacaaagcttattttgctccttcgactatttttcggtctttttccttttttaactatagtaggtggtcttattatcgttttggtagcatttttcctatgcagctgctnntatgtcctccccttgagttgtagaaatcccttagctactgtgaccttgtaatcatcccatatatttccatttgatgctgcgcnaatctacatgtactgtgtctgagtctggtgtctggtcctaattttcatgtatcaatggctatgcaggtactctcttggagctaaagctgatgtgggtgaactgagcttcttctcaggagcatcaggaaacaccaggggcttcaccattgattctccaacagatagctcatggcattcactgccttccagtgtacccccatacccgatgtcaaagccaagggactctggcctcctaccaggtgcctactcctactcccaccttgaaccttcacaggaacttggccaggtcaccatcgcctcgctgtcccaagagcaggagcgccgctcttttggtggtggagcgggggggatgctaggaaatgtgaagcacgagaaccagccgctgaggcctttcttcgatgagtggcctgggaggcgagactcgtggtcggagatggatgaggagaggtccaaccagacctccttctcgacaacccagctctcgatctccatcccgatgcccagatgtgggtcccctatcggtccgcgtctaccttgagcatcccttcaccaacatttctctcacacaattcattccattttctttgatgatgcaggtgattgagaactttgctgcttgtggcagcggggtggacctctaccccgcattttaccgctgctagtgagttggatcagtgattgcgcctcccctggttctttgttcaattgtatcgtgctatgaactagttaagagaaccctactttttttttctagtagaagagacagaaaactcttatccatcatcatgttttaagattccacgatgttttgtacctgcaacccacgacctgccggctgctgaaagttactggctgtctgtaatgtttgtagtagatgatctatgatgtatcatgtatctatctacttgttccgaattgcggaaaccaaagccgataatctggcatgtgccaacgtcctccttaaagctcttgtgctatgtattttgcttttggtgggaaaaaagaagaaaagaaggttccatttttcttaataattcaagtttgtagaatcaaaaccaggcgtgacgttgtggtattcgttattccttttgctttgaaaagaagacgatgaaagaaagatatgtgcacgtgaactccaaaaggagaatgccgctcagatgttaactgcagccttttgagccgatatctgggagggatgatgcggcaactgcaatgcaaatgcaaatgccaaaaggatac

SEQ ID NO: 30145 - DNA, 1065 bp, Oryza sativa
tgttttctatcactcatgttgctgagtatatacagaaaaaagatactgttgtctggaaattcattttatctttgtagttttatagttattgaattgtttgagttttagcagaaacttgtgtcctacatactgcgacattgcctctttgatactttttccataagtggttttctgtttctttcattgcattatttaattattttacagcttgataaacaaatggcatctcatcatccttcattttatagatgctgatcacataaccacatgctcgtatactttaatcatatgagtataacggcactaatatgacttttgttgtctgtgtgtataatgaagttctttagaaacatattcagagagagagaatttagcgggcatgatgccaaggttagctctatactcatttttttttcacctatcatgtttttgctctgtgaatcgcagtttcatgttccattctacaggttgcacttgaaatatcatttatggaagcagttcaggggtgcacaaagacgatcaattttcagactgctgttacatgtgacacctgcagtatgtagatgcgcttctatttactgcacatatcaaactatcgatgtcctttgaattgttcctaatcatctaatgagagttctttgttttcccagagggagctggcgtaccccctggaaccaaacctgaaacttgcctagcctgcaggggttcaagatttgttagttcttcctctagcacaattatttctatttaatgtggtatctcatttaaatgttagtactgtgcttatttgtctttgtttttcatgtgctgttggaagatcttcatgcaaactggtcccttcaggatgcaatcaacatgcacacagtgtggtggtagtgggaagactgtgaaggtatgatgtccctttgtgttgataacctgcagtcaggataaatcagttatctagccttcaataaatcatctaggaggttaactgtttagagttgcttgtccttaggacataaaattccgtacctacctgaccagaattgctttgtgatgtagggttcggtatttctaaatttg

SEQ ID NO: 30146 - DNA, 44539 bp, Oryza sativa
agctgaaaaataggggaaacatagtgcaataagaaactgaaacagattaaagcagcatacagcaggggtatgtgtgctcatgctgaaactaccttgcagttctcatattctgcagacattttctcgctgtcagttacaaaatacggggagatataaccacgttcaaactgcattccctccacaacatagagattattctcagaacttctcccttcttcaagggtaaccacacccttactgccaaccttgctcatagcctgtgctatcatattaccgatttcataattgttgccagcactgactgcagcaacatccgcaagctcactgtcttcaacctaaagcaagaaaatgttttttataagtagaacaaaaaaaagcatatactacatagataaatcatctgatttgactcagtctagctaagcattgttgcaacaaacaccaggttgccacaaccacaactaaaacattctgaaagcattagagcctgacgattattttacctcctttgacaatttctttagctcttcaactagtgctttcgcagttttctcgataccacgtgtaatttgcacaggattggcaccagctgcaacgacctgaaaaagagcaaatgaattattttcacttagttcacaaattaacgactcttaacagattgaccatacaagtaatagaggtctcatgtctcaactaatagcataccttaacaccctcagcaatcagcccctgagcaagcacaacagaagtagttgtgccatctccagctaaatcattggtctttgctgctgcttgcctaaccaacttagctccaatattttcaacaggatcctccagtttaacctgcagtacagagatcgttacttgaaaatactgctcaaattctggaactaagttacacagataatccagaaacctccagttgacttgttcaataagaaaataaaattgaaaaattctttatatcatgactaaaacaaatggggcacaatcactatagttaagtcaatgaccagctatcaaactttagttcatcttggcagaggatcatttattagaacccacaaaggtaattatgatagaacatggtgtgcaaaaatgcaaccagccatagtaaacagaaatacacttgcgcatgaaacttgtgagcaaatgtgcatactggtttacatatcaacacaaacattttttttttggtggagtatagcatacagcaaacaagccaattgtagggaaatcaatgcgttctgacgcaataaacactgtaatatacctctcttgcaactgtaacaccatcattgacaatcctaggggacccatacttgctctccaaaacaacattccttccctttggtcccagtgtaactccaacaaggtcagcaagcttgtttactccagtctgacatgtagaaataactaatgagtgcctggtcaaggctaagaatcatagtgaccaaaatttgataagatgtgtccaagaactttggagctcacctgaagcttcttgatagccgagccatccttgttgaagtacaactccttggcagcttttaccctgaagttgcacttcctctgaaggcgtgcattgcgtggtcggctggcaacagaaacagatgacaccgaagatagagaagatggcttcttgtctgatacaattccggttggcgcagccatgaggccaaccgtagaagtggcaccgaatgttgaagccatgatttcctgttcagcaatgacaacattaacatggagcaacaatcataagcatgcttaagcttctattcagaaaatggaagctgaggtggaggtcccacatgaaagttcatgtattgccaaccaaagctaagagcttaaaattgttgtgcattctgtgcaaatgtattttccaagctaaacatagttaaggtttttttgggttggggccctttccccttttcctttttgtgctctctctgcatattaccacatattatcattgactacatctcttacagtgtcaaggtagaagattaattaacaactggacttcagggtatattacagtgagttgataacctgcatatgtatgagatagctaaaactgaacgaaaaagagaccaactaaagcatctctgctgccaggattccttctcgaatatcatgaatggccaaccaatacattctagcacttgaaactacaccttcaaatttaaatgtttgccattcaaccaccctaacagttacgtcagcttcaaatggctggccatcactagcatacatgaaaacactagcattccaactgccaaacagaatatcgcatgcaccctcctactccactctacttggctgaattagaacaccccatgccaaaagtcacaaccagacgaacagaacgctggagccaacaacattctgtagtccccgtgctaactaaaccaacaatttccactgatacattctgtagtccccgtgctaactaaaccaacaatttccactgatataacagttctagcgcaaaattagcccgcacgagcaaccatcaaaaggcccccctcaaaaccaagcggggggcgcgacctcgagctctccgccccccacgaatcgcgcggcgagaactatccaccgaatcctccaaccacgcggcaaccgaatcgtgcgggggtcaacacaccacaccccaccacgtcgccaccggaagagggagaacccagcgccccggggcggggaggagcggcggaggtggaggaggaggggatagggtttgagctcacctgacctcgcggaggggagaggagaggataaggctgcgacctcggggagggttgggttggggcgctgcgggtgaggaggggtttgggggaagggggaggggaagggatgaggtcttaaatacacgccagggttttgcaaaagcgcttgcttcctttctgtctgaccccctgaataagggtttatttgcatttaaaaaattacaaaaatatgcaccgttaaaccgtttaagaagtgtgcattatattagaaattaaacatagtctaagtgtgatcatgttgtcagtctctcgtgcatgcaaaacatgagtattgacttcttttcttattgggagaattgattgtgaactacttccttcgttctaaattataagatattttggtttatttatctctcgtctagatttattcacacccatataaatttgaacaaacacctcataatttgaaacaaataaagtgatacacaatacaagttcatcattttctttttagcgtgttaaccataatttaaatttgaattaaaaaaacataaaagttaataaagttgctaaaaaacacacaaacacatatatgtatataagatttaaaaataatggttgttaaataagcaggagagacgatgggccgttataatacctttccaagtctgaaatgataatcgattataggcaaaaaatggaatgtttgtagcagctcaaattccgagaagcatacgatgagaatttcgaaagtttgtttttcctatcttttgtcttgtagtttattttataaaatctaaaaatatgaattattaaagttcaggtgataatttagaccgtacaagaaatttgatactttgaaagaagctatagcagtacggttgccaaaagctcccacgacatggctaggttctgctagctacttttacacaaacgcaacagctgcattacctagcattggtggtgctcatgttgataccgtagttgtcattgctttgcagccgcagcaacacacagctgagctagtaactttctatacactatgtttacttgtaaatcgtattcaatttattgtttttgtttttgactatatatgtaacatgtgcactcaacgtttggtttggggtttatttaaaacaagagttattctataagatcttaaaactctgtcatacgtacacaaaactaataaagtttaaatatttttcaacgaaaaactatagaacgtattaaaccgtaaaggtgtagaagtacaaaatctcgtagtatgaagcttcaattatgtaacatgtacacccagtggttggttttcatttcatagtatggttaaattaagaattcttctactagatctttaaacttggtcaataccgtacatggaactactattaaggttttatactctcgatgaaaaactatagagcaaaagttataaaagtatataggtacaaaatcacttaggttctgctcggctgcactacaatgcagcccttgctgctgcagctacagacacatagtactattcgaattggctgtaccacagttgaagcatgtgcagccgaacagggccttaatgattgttcggtagctcttaatagcagttgtctagactgtgttgcacatccaaccgttcagtggcagcgatttaggctaggctgcattttgaataaaattaaatacaatacttttacatatgcatatggtttgtgttggttgtagcccattgctggctgactaatatagccactatagctattgctgcagcgctgcagcagttagctcttttgaataaacccaatgtgataatgtacataaacatgtattgcatcattactagctcttcttttaatcctactcaatgtgcaggaaagtaaagccaaactgtggaaagaaaaagaagtatagtagatccttttcataacaacacaaaagcaacaaaataaagccaaactgtggaaacaaaaagagggagaatcagcaagcatctcggactcaggggcaccaaagtgaataggacatttttccggggagtagaatgaaagcagagcggaggagagcacggagcagcctcgaccgttgtagaactgtctagaagcagcaagcgacgacccaacgctttgtcgtgggcgctataaggctcttcgggccgtgggccgataggagtatgggccccaatctaatatgggcaacatgggcgccatatagcggttcggcccgtgggctgatcgatatgggctccaatctaatatggcccaaattaaaaaaaggagtaaaatcgccgttgccggggatcgaacccgggtcacccgcgtgacaggcgggaatactcaccactatactacaacgaccttgcttgattatgtaatatatcaattttaaattaaccgttaatcatttattcacagtgtagtttatacttcataaacagatgattacgaagagtcaattgcatttttgtacaggatgaaggtaaaaatactaatagttcgaccggcatggagtgtaatttattccaaggtttcactaagaggtatgatcaatcaccatgcttagatccaaacaaaagtttactatgtctagttgaaacagggtacgttgtaatgttgtagaatccggcaataaataaattagattaaacactgtcggttgtggctgtctggtggttccatcatctccagatcgaccagcatcccagcaacacaaagcaagtattattattattattcagttcgtcggtaggtgcaagtcaaacggcaacgcgcgcattgcaaaaacaatcggagtaatggggtgtcatctgctgatttgcacgatgagaactacctcctattctcaaagcaataaaaggcagcctgaatcagaagaagaagaagaagaagaagcagagattaatcaagaggaaagaactaatggtagatagatcataatcatatatcatattcaggcatggggcagtccctgaggaagctgttcgacagcttctgcacaaaggagatgaaggtaacatcatgtcagcattctgaaatcgttcaccattctcagtttttcatcctttctgatgcttaaccaggttcagaatttttttctcttctgatggatgcttaatcaggttctgatgcttgggctggatgctgctgggaagacgacgattctgtacaggctgcacattggcgaagttctgtcctccatacccacaatcggtagtgatacatcgtgttcattgtcatttatttcatcgccgaaatgggcatgacataatccattcctggacctgcattgacagacatacattctttcatcctgtgaaatgaacgaattccatcagggttcaacgtggagaaggtggagtacaagaacgtggccttcacggtgtgggacgtgggaggccaggacaagctccgacctctctggagacaatacttcagaaacgccgacgccctggttaaatctcatcttctgaatctctctctcgatcgatcattgctttgcttctgaaatctgaatgtctgaaactgaatgtgtggggagttgcagatctacgtggttgattcgatggacagggaaaggataggagtagccaaggaggagttccaggccatcatccgcgaccccctcatgctcaacagcgtcatcctcctcctcgccaacaagcaggacctggtaattgctaaaagcttgacgaatcaatgaacaatttgccaatggcgattagttatacaacaattgacatgtggatgcatgatgcagaaaggggcgatgagctcgtcggaggtgtgccagcggctgggggcgtacgaggagctcaagaaccggaggtggcactgtcagggagcctcagcgctcaccggcgacggcctccacggcggcctcgactggctggcctccaccctccgcgacgtccagacgtggggcacctccgtccgcttctagcaacttgattctttcacgtcttgagattagtttctcaagaatcgatgatcgctagctgcaacccaattccaattttttgtgcttgttcagaagtataattgagaaaaatcagtgcctgtggggaatttgagaggatcctcacatccaatgtaagagaactattccattaatttgctgagtgggattttgcaccatgattcgtctcaagctttgtgatgtgatgctgcatccatgccgtcgtcgcatcagcaacctacttgtacatcggctagcagaatggtccagatcggtagaaaaaagattcatgttgagcatcttttttaaaaaaagagattcttggttgatatgaaattaaccacatttaccaatatttagcgtgcataaaaatatgatgcttaaaaataaatagaaaattcaaattttatacatgaatggaatcgaaaaacagtaccatgacgtctcaccgcttatacagaaatgacgctcgatctatcgagaatttccggtatgtctttcataaataaatagttagcaattgtgaacaaccagcgcgcggagttgggaaatggagacagcagcgcggacggaagagtggtgcggggtgaaaacggtcatgaaaattcccgttcgacttaacactgtttccgaccgtgctgttttttattatttataatttttgttttttctaatttatttttcatcatataaatatcaatactgagtaatttaaatagtaaatatggttaattatcgatcgatctagcatcatttctgaagatatgctaacaattccaacagttttcacctctagtgccgcctacgtgcggcccatttatgtgactccggcgtacgtacggcccatatatttttttggcttggaccgggccgagattccgggcttccgcgttcaccggcgacggcgtcctggccggcgacggccaccaccctcagcctcagggacgccatggggcacctccgtccgcttgtaccaccttcgtttccgaatccctcgcactaggtcaaccgccctgcctctggcccccacctgtccacccgccgcttctcaaccccacagccaaagctccgccgcctcgccggccaccgcggccgtccgtccactacggcatcctgagggcgccgagccgccgaggcgctccgccgcgagtgcgctgtttgttgagcacaggggcattatgggatgggatggtgaccaccggccattccaggcagtcaggcaccactggttcttggatgcgtcagccatggcgcaagatctttcttcctcggcagtgtggccgggtcctcgtcgaagaatctcgcgggatccttccgccgttctttatcagctgaacctgcaacgcgagtgaaggtgtagaaggaatcccaaactggagaaatgcaccttcttcttcttcttcaatgaggggaggtattatcccaactcaacatatactgttctgcaatatatccagttgagttgatttcagtatgtttgtgaatcagttgtgaaaagctcttcaactatacactttgctgaagatcagtgcgttcatcggttgcgtgctttatgtttctcactactagattgctctcagatcattatttcgacagaaaacggccatgtcgtgtcgatatatgctcaattgctcacatggacgaagggaatgcacctgcaatcaggatatgtggttgagcaaaaggtgatttctctgaactattccattgatttttcgaccatcgccttctatgtggaatgcatgatcatcttaatttcgagatattcttctttttcgataatggaagctttattaaaactcagtcaaatacaccaagatgatacattctaactgagctcactcccggcctctgcatgaaatgcacacagctacaaaacatgatctaactagaccctcaacacaaaacaaagaaattagtgactatcaagccgtagactagatcaccacccatgctccagggtaaaaaaaactcccgtgccacttgatccaaacgacgtgataccaccacaatagtatcctaaagacctggtttgtggaggatagaccagatgcatagccactgggtgactaaagcaataacctgcaaaggagaagtcaccatcttgttgtcaaaaattaccccgtttctgtttagccaaatggaccaacaaaaagctgttgcacctatcaaaagcagatttcttatgtccttaggaacatatgattaacattttgagatgttcttctgcacctttcttgtttgatgacacacatctggttgttttgtagccaccagaacttgaccaaatcgaccactctttgcttagattttcagatgttgaacattcaatctctgaattgcaagacacacgaaaagttttttcccccatttacgcttggaagcagctgcccataagtttttagcggatacagagtagaaaccaattgttgtaactgtgctggttcagaaatccttgaaactaaactaaacctgacgttatttgcaagatctgctgtgcatgacaaataataccattgtcctaatgcggcttttgacccactgggccacagcggtttgcagctagcagagtgttcgcagcaagcgcgaagcttttttcggccaagctataggaacgcttttgattctttcttcctgatggtttgttggctcatttgaaaagagcggaatggaagaatatttgagcacaagtttaaggtcgctgagcagctcgttggggatatcaaggagattctcaaggtcaaggtggttggtgactcctatcacaccacaaggctttaggtggatctccaattgtgttggtgatgtgacaaaaaaaaaagcattaacaaggtgtactagggttcactatttcaaaaagcataaacctagggggaggggcggtgttggcaaaattttaggaattctgcttgtcggagaagtgggagcaggggttccctttaccctggagagctcaaggtgtaggggggcttggggcactgcgagccccaccaagcacttaaggtttcaagaagagtatagagatgtacaagatctacatcttcaaggtttcaagaagagtattgagagtttgagacctacaagatctacatattcaaggtttcaagaagattatcgagatctacaatatctacatcttcaaggttttaagaagagtgtcaagacctacaagactaagcatatcaagtttagaggagtaggctccactccatgcatgcaacggtattgtggactctccttcatgtatataagtagaattcatgccaccgagaattcagcaagcaaggagttgagtttctcctcctacgtcaccttataattcctccaatcatccatagtccaccgcggcctaaacctgtatatgtgcttgtgtttatctttaccgtgcgatcaaacactcgatctcaaaacttgcacctcggccgaactcacaaagggggagtacttagcttccccattacaggagttctatactctgacacggctattttttttttctaaattcaaatcatattgaaaatttttatcggaagaactccctattggtacccacggataaaacgaaatttcgaatgaattgaaaatttcgatcggaagaactccctaccggtacccacagataaaacgaaatttcgaatgaaaagggtctatgtgtgaactggttccaaggaaatttccagaatagcaaatcctagggttcactgccaaactaataatgataaaggtctatgtgtgaactggtaccaaggaaatttccggaatagcaaatcctagggtatactactaaactaataatgaaaagggtctatgtgtgaactggtaccaaagaaatttccggaatagcaaagcctagggtttactaccaaattaataatgaaaagggtctatgtgtgtactggtaccaggaggtgtgtgtgtatgtgaactggttccgaggagggacatatgcatcttatctcttaacatgtcataccatataaaacccattgaatccccttgcctcgttccccccaaaccctaatcattagctagttccgccgccgcttcgtcttccctactcgctagtcgtaaccattgcagaccctcgatacgtcctcattaacatcgacggcaaccattttggggcttctttgttgccctcactatcgttgttatcttcattcatcggtaaacttcttcttccacgtactttgtccacccattttgtgttgtctcgttgtttctatttattagtctgctaactcctctaagatgtacgttcaaatcttggaggataggggaattcttaaggactatgagtacatcataagtcttcaaaatctatactgactcgggtggtggtgagacaatatttgattatcaacaaaataatatgtacgcaatttttgttcattaattttctattaatcaaatcccaaataagagaacttccactgatgtcttggtattgaagattttttttagaaatactgaagatacttatagagttatgtttttcagcagttaatacttaatacgtctccaccaaaagtgtgatctttggattaggctattttgtatcacaaattgtcaatgttttaggttctcatagtaaatactaacatcctatcaaatatgttttttttttaccatgatatttggtatgattggaacaaagaaaggaccagttattgtggttgaggatcaagcaaggtagaagggggtaccccatactttcttagtatgtatgttgatggctaaaacacgagttattttataacgatacaggtttttattacttatatgttgtgtgtaatattttaagttataaacgatataaaaaagtcaaggatgtattgctaccaacatgacacacatgcaatgtgtcgatactaaattcatgcatattatagaatgaaataaagcattaactatccgttttcttcaatggtatttgaaatgtgaatgaattcaattgtcgagtcttgtaactacatactgcattcataacattgcaaaatattgtagcaccactgtactccacttcttatttgtcacttagtggctaggatttctaatactcattttttcatgcgcccacatgacgtagtgaattagtggactatgttgcttgtcctttaaccagaacttctttgttctgattgctcccattgacttcattattgacttgcagagcctgctatcatggaaaacacctgcaagaggatctccaacacccccaactccatgccagtgctccaaggatgggcagacctcccagatgacctactgcagtgtgtccttgctctgttgagttcacccagtgaccttgctgccttcattgccacctgccccaattggcatgctgccttcaggtctgcaaaatctaccttacgcaccaccctcttccgtcctcttgccatccgcagctgcgcttcctctggcgatgatccagtagtatgggagctctttgatccagccaagccaaccatctgcatacaccgcgtgactccgccagattttctggcggggatggattatgaatgctgttcttatggccatgccatcttctctggcaatgccccctcgctgaaggacacaaccttcgccatcgtcgacgtgttcaccggcactagtgtttcacctccaccctgcccattctttacttttgtcaactcttgtgccctcacagctccccttgattatcacaactcgcatttccttgtcgaggccaagcactccctgttcgcatggcgagttggaagcgaccattggtcgcagtgcagttgcccgcccaattctaaagctcttgagcagtttgtgcccttcaaaggccagctctatgccctcgagtatcagcagctttacaccgtcaagctggaaccccagctcagcctggaagaagtacaagttgtctggagcgtcgagatgtcggagcctgacctctgcgagccatcgctggtggtgtgtgatgacatgctcatcctgctcgccgcctccatcggcgaggccttctgccttgacctgtcatcccagcctgcaatgtgggtgaagatggaagaggaagagttgaaggaatgggccttcttcttcgatgagaagagggaggctttcaggccacggccaccattgtcttgcaagaacccacagagatggggagggatcggctatgattcatactgtgtgtcatccttggcgccaaatcaaggcaatcgcagagggttgctgcccaactgggtgaagcccaggatgctactctcttgcgatcattagctgctacaaggaagctttgtttgggtttatcttctgctgaaattctctcctcaagtgctgcagagcagaagggcttttgcaactcaagctactatatctatgatggcatctgaattctgaacaggctgcaagggatggcttgcaggatgtttatgtttttggtgaactgccatgttcgttttaattatcgtctgttagaaataatagtaatggttgttttgttatttgggttagttttctggaggcaaactgttgtgcctgttactctgaatgtctgaaccttgttttatctctctacaagaaataatatttaccttgttgtgaaggggaaaaatggtattgcatcctgttccgtgttaaatgcagtattacttgtgcgttcaatttgattttccttccaacatgtttattatgcatgagatgtgtgcaacgatgtttttttggatgtgatcgatgcatttacagcttggttcttccaaagggaaaaagcattttcaggctttcagctcttccagcttgctgaaaatatgcatgtccagaggcacatgcttttgtattcctggatacatgaagatgatttcgatggccctgaggctttccaggatcagatggatgatgaaggtaaaaattcagcatgacgctgtttatctgaaaatcaagatgaaatcaaacgcgatgttgttcatctgaatcttgatgaagtcctgagtccgacccatgttagtcggctcgtagctcatggatttcttctcacgtgaggcccatatgtattgggccggttggtttatgggccttagtttcttatgcggcacataagtcccaacctgtatccgtccccacctgtcagtacttatgttttgactttttgacccacccaaactcattctcacctcatcaccgggcaccggccatggcgccttatccattaccgccgccgtcgccgccgcagcagcagcttcctccggcgagcagcagcaagccgaggaggccaccgcctcatcgctcccatggcggctacaagaacggcaccgtctccgtggattccggcgcccctcacgacgcccgaggcctccgggctctcatcaaggccttggccgcggagcacggcgaggccgcgccggccgtgcacgcccacgcggccaagctcggcctcgaccgccgccgcgccgtccgtgacgggctcgtcgagctctacctcgctcgcggcgagctcgcctccgcgcgggcgctcgtcgacgggttccccgccggccgggacgtcgtctcttgcacggccatggtgaccggccacgcgaggcacgggttcttggacgaggccgtggtgctgttcttcgccatggcggatgaccgctgcgtggccatcgacgccgtcgccgccgccgcggcgttctcggcgtgcgcgcagatcggggacctcgcgctgggtcgggaggcgcaccggcgcgtcgcggagaggaaggttgctatggatgtcgtcgcgtggaacgcgctggttgacatgtacgccaagtgcggcgacgcggcggcggcgcaccggtggttcaggaggatgcccgtgaagaagaacgtcgtctcctggaacacgatgatgtccgcgttcgcgcgcgccggtgagctcgaggaggcgctcgcgctgttccaggagatgcaggccgcggcggtgcgcccggacgacgcgacgttcgtcgccgccctcggcgcgtgcgcgcagctcggcgcgctggacaccggcaggtggttgcacgcatacatggggaggatggggcacagcgccgacggcgtcgtcggcaacgcgctgcttgacatgtacgccaagtgcggcgcggtcgaccaggccacggaggtgttcgacggcatggcgcggcgagacgtgtacacctacacatccatgatcctggggctcgcaatgcacggccgcggcgaggacgccctgtctctattcgccggcatgcaacgagccggcgtgacgccgaacgaggtgaccctcctcggcgtcctcacggcgtgctgtcacgccggacttgtcgaggaggggctccagcaactcaacgccatgccggaacctcgcatcgagcactacggctgcgtcgtcgacatgctcggccgcgccgggagactagacaaggcagaggagctcatcgcggcaatgccagtacactccgacgcgctcatctggagctcgctgctcgccgcatgccgcgcgcacggcgacgtcgagcgcgccgagcgggtgatgcgacggcgcgtggccgacgcggacgccggcgactacgtgctcatgtcgaacacgtacgcgtcgaatggccggcacggtgaggcggtgaaggtgagggggcagatgaggaggaacgagatcgacaaggtccccggctgcagcctcatcgagatcgacggcgtcgtgcacgaattcaaagcaatcccagcaaattccatccgataaaaccacaacaagattcatcaaagaacagattatccgattgatcactgtagataacaagattcatacaaccaacgacgcaagattttcactggaaattttctagtactagttgtacatgagatttcagaaggcattatttggctttattggttattgctgctactgctgagttgatgctcatttgggcttgtgattggcagcggccatgtcgacggccggcctctcgacgtcctccatgtcctcctcgcggacgaacaccgcctggtcaagcaccgacggcgagccgccggccgccgccgccgccgctccgcagtggtcgtggttttcggtgccggagacggcggcctcgtcggcggggacaaagacgccggtctcgtggtcgggcacccacgcgtcctccaccgtctcctcctccgggtgcacctccacgttcttgcggttcagcgccgcctccacctgcgctccggcggcgccgccgccgtcgtggatggccttctgctcctcctccggctgggcctgtgcgctaatcgagtaattctgatgagcttgatctcctctcctgctcacacagactttcatcagaaaatgaacattctttttctctcaaaatatggcatctactctacaagacaacaacactctcaatccatctaaaaagaacatgacagctcaatcaacagctaaaccataaacacagcccaaatgatttagagatggagcagtaactaaataacagctagaaggatcaggatctgtctggaaaatgaacagtaaaaaaacagaagagagaaacatctccaaaggaacttgaacttgcttggctcatttctttctccatcagagtttatcagagttcatcagcccaaatgaacgttcattcagagttccacataaaaaggtggcatgtttatcatcgattgagggttgcaaaccaaagaggaaaaaaaaatagtacaaagagaagatcgaaggcaagatactggcgtcgccatcagctcatcacgattcacggcctacactaaactgacgtactggacactgataaaccatagcagaaacaatccaatgaagaagcaaaaaaaaaaaaaaaacaggagaaatacatgaaacagagctcccattctttcagttatagccagttacctgcaggaggcaagaagagggaagccagtctgtccggccatccggcgaccggcggcggcggcagcagcagacagtgctcgagcggccattgagcagaacaaccgaacaacagagctactgctactcctaccgagcttgcaatggtgtcgtcagctgcaggaagaagatgcacggacagacagagcagagagtttcagaatggctggagcttatcctcagatcagtactagttactaccaaggttgtgttcgaggagaaggagatagaaaagattaggaagatacgtaaaataagatgagtcattagcgtatgattaattaagtattaactattttaaactttaaaaataaattaatatgattttttaaagtaacttttctatagaagatttttataaaaaatacaccgtttaatagtttaggaagcagcgtgaaaaacgatatccatttctcacccaatctctcagaacgaacgcacccttagtttactgctgccaatgcagatgatgcaggtgcaagaagtactagactgtgatgaaggggaagaaggatcaagtaagtaatggcgtggtgacacgcgggaggggagcgtggtggatttgtagtggcgacggggggtcgaatggtcggtgcggcagaaggaccgaccgactagggaatgctgctgcatggtgccacccccttcttgccatcatcctatcacaatcacagaatctaatgacaaatactcctccgtccccccacccccccaaaaaaaaaaaacctgggaaggggtatgacccctcctaagataaggaatctgaactactatttgtccagattccatcgaccatcgagaccaaaatattataacaagtataatactcccttcgccccaaaaaaacttaacctaggagaggacatatcataggttaagtttttttaggacagagagaatattatactcgttctaatattttggtcccaatggtcgatggaatctgatggagatggcatgtaaaatgataatgtcattaattaagttttagttattataaacttaaaaaatagattcatctaatattttaagccaacatttatacataaagtttttcataaaatatattacctccatattttaatgtatgacgccgttgctcaaaattaaaacttcttattgtgtagtacttcctctactacttgttgacattgaactaaccaacattatacattatgagatgggtactataaattttgatcacataaatacttatatagagcagtattatttagtgtgtttttgttcatttgtaactatcatgccctcaaatgtttatatttgaaaggcacatagtattgtttatttgttcctcttttctcccagtcaaaaatgaaaaaggtaccacctacgaaagtgacccttaattttgtactagtagaatataaagcttccatcggttgtccatttagccaaaatggcttatttagcttataaaaaattaaaattaatttataagtaaaatttttgtagatttgtccgtagcgacttaaaagccaattttaacaaaaattacgttataagtatttcaaaatcaagttcaaaatcaagttaaaaatttaaattttggcttattatttggctgtttaggccaaatgatggggctataatagtggtatatcaaggacgtgtttccgtaccagtttcaattttattattttccgtacgtcaactagtatctgttgattcagacggccacctggaaagtcacgatttttttcagtgattttgcaagcaccacgtatgactacctgggagtatgtacataaacatcgtgtacggactacgatgcagggtgagtgacgtgtattgcccacagtttgacacgtttccaatgacttcgtttcttaatttctgtccgtgcttcagatcacatcctgaactgctgatgatcagcatctgaaccttgttctaaagcagctcaaagctcgggaaaattcccagatgggtatttgatgaaatgctgatgcgaaaacgaaaacgacccagagttaaatcaggcgtgcaaaatctcccaagatagaggagatctcagcgttttcatctgacaaatactggcagcagtgtcaaatgtttcgcacataaatcttgaccaaactagcaacacgtttctgctagctgatctacttttgtgtgcaagaaaacacataagcttcagaatcactgaagaagcctcacgaaaacggcgagatgctgtctgttgctacctacactgagattagagaggccacctggattctggagttgacacaagtggcctaaaatctcttgcatcagtagacaaggcacatattccagtgtgacagacagatagttccattcactcacaatagcacaagcacaaagtagaggttgttactgcataagaacaatcaccaagatgacaatgtctaaagcagatatgcttcaggttctgttcaggctgcactaggcaaaatagttctgttttattgagaccaagtactcacgtactggttcgggagtacggcataggtaggtagtttgtagccacagccatcgccatcttagtcacggcgcaaccttcagcatatatgctcccactacaatctgaacaagcaaaggagctttagcatcagcacctcaaatgaaagatgaaacgtggcttcaaatgggctcttgttttgattgaggggtgcaacggcgcatattgcgcgattagtgctaccttaggactcgagatccttgacgatgaagttctggcgactgatggggttcatgacaaccggtggcccagcagtgcgaggccaggcttgaaacttcttgtcagttgcttgccaccattccttgtcggacacggtatgtggtgtggtgcctgatcaagaagtaagatgattgttttgcacatattctttatacagacagatttgccaacggtgtatgttaagcgtgctgtcaatttacaaacgggtacttgggatcagattccatacctccaaatatcttcttctcagcgataaaatgatcacaaacatatgagatggcaaaggaaccaacaagaccagcggcgatgtacttgccagccattggaaactacaaaattaagtacacactagttatcaggggaagactgaagagttctatagattacggacacgaacgatgaaatatcatcactctaatgctttacttgtaacaacaaaaagggaattacatggtaaaaaatagccatgttaggtatggtctacgtggaagaattattagtagactatcatttgcacaaggcaaagcaaaaccgtgcctacattcataatatctttcctggtactattgtttttttaaaagattttctaccaagtactattattcagttgaaaaaattgaacacaagacaacaaacctgatctaagccacttgctttgtttcacattataagacgttttttgggttttaaacagattctgcatgaatccatgtatgtgtttcatatatgtgtccaaattcatatggatgctagtgaatctagacgagggatggagagaccaaaacgttttataatgtgaaatggagggaatatggttttaagtctgcacacactctgtttattgtttctggctgccctttacagttgcaaaaagctgttgtcaaatgagtagcaatccggtttcagttacaaaagaatttatcgggttcatctctacaaccactggtttagcaaataattcatctgcaaaacggtttagttatctgactgttaaccccaactgtgatgcttacttgaggacaccacatgtagtgagttaagctaaaaggctaaaacaagagaagctcacacaatccaaccccctagtaagaagcaaatgcaatatgcatgtcaaaccaacccacgttaacaaatcttaatcttttctgaatatgggatccacctcagaacacttagaatcacattttgtattttgaacatcagagaagccgggccatgtgagcagcatttcagtttatctttcagcaatgaattaaaagaaaaaacgagatttggagggagagacgtctctccaaacatttttttaaaaaagaaattgttagcatgttggggattgaacacggctgtcagcagtgaattgtggagcctcaggtacactctttcactcaaaattcaacaatgcggaaccacctatttccttttccctctaggttgttcgcttacaagttcgtggtcagggctccagaatcgtcaagctaggatagattctaccgcatggtgcaaacaaaagatttggccgaagagaatgccccaaagttttgtcactttctgaatcgcttgaacaaaacgagcgctagtacagcacagaccacgaacataagaacgaatcgggacagatttgtacaaccagtggctgtatcatcgcgctctccttgaccagttcatctaaattgcgtgggaaagggggcaaaaaaagatgaactttttagggatcgacacactcacttcccaagaaacagacaaactgcgaactgctacaacttcacgggcaaaagagcaattgaagacagtaagatttcaaagaagtagggaaggtaataagggacgatcattacctatggatggatggatggattggatccggtttcttgcttggtgctgctgtctcagctccaacaagttcttggtgttcttggctccttcctatccttttgcttgctttctgcctgtctggttggagtgttgtgggtcacaggaagagagagagagggttccagaatgcagcagagaggtaggggaacgatgagctgtctcggtcccagcaccctactacaccaacatactcctacgtggagcaacatggctgaacctgcactactactgttaacagtgttattactgtgctacaagagcattttagaaattattatgaccaaaatttgaaagaccgagtgaatctttatcgaaatgttaaatactaagcatttttaagtattcaaattttatacccaaaataaacattcctatgagaccgattctcatacatggaaatcaagcgttttcagccaatgggctgctgaggaggagaatccacgtaatcaaaattcaaaatttaactaataaaataactttaaaaaagaataaaaattaattttaagtacttgcaaaacataaaatgctccggaggaacggacgggatattcatgaccgtagtaaaaatttctctgtttatttcttggtctaccacggtataaacagaagagtatagaaaaaaaaatccggcccagtaggatggcccaaagagtacgcttacctgggccgggcctcctagcaccgcgtctgacagttgggcccacacaaaaccggatttcgctgacaagttaagggacctcaagtgaacttattccgattaattaagcgacggcttcctcctcaactagagacgcccacagcagcagcagcacgccgcgcgcgatggccgccggagcgccgccgctcgccggcgtcggagaccggggctcgtcctcctcctcctcgcacccgcctccgcctccccctcccaagatccttctcgccaagcccccgcttccgcccccctcgtcctccggcgccgacgacgacggcggcggcggaggaggcgcgggccgctcgcggcaggccacgcagcctggctcgctcagcctcgtctccgacgcgtgggaggtccacaccgacaagatcctcccggtgcgtgcgtcctcaagtggctttgctacgaggatatgcttcttgtttctttcatttccttttgctgttcagggtttacttactggttcgatgcaagcattgtgataaaattgtgtgagatcctataactagattcagttgacaatttttttttttgtgtctggttaatgcaataatccattgttcaatgcagttgttagttgtaggctcgtagctcttatacagtttagttcatggtttcctaggttctcttgagatgcattctaatactatccctgatgataaagcttaaatcttgcagtaatatgatatatgccaatgcgacctttgtctagcacgtcaaaagttacagtttgtgcatgaaactggatttgaatgatgacaagattatttaaaagtatctgtagatatatccctcaaaacattcagatattttgtgacattttgatgaaagtatttttgtataacataacttctagagttcttgaaatgtcaaaccggtgattgatcgagatcttcatgtttcttttggggcctatatttttcagtatttgactgagaacaatgatttcatggtgattggagtaattggtccaactggtgtgggcaagtcaaccatcatgaacgagctttatggatatgatggaagctcacctggtacaatcatccattcttccaatagtttcagcattcagtcttccaatagtttcagttcaattcattgttgttactttcatgtgtcaaacaaaacatgcgcttgtcagaattattttgtagatgcactctgctgttgataatatgcactctattaagtccttaagcttctgtttttcttccatacatcaattttcccctaacctcttttgtgtcttttggcttgctgaaaaagcgtagtgaagagttgtaatttggctagcaatttgttccatgtggacacctagatcaaaccgaagctcatttagttgagtattgcctgtaggaatgcttcctccttttgctacacaaactgaggaaatcaaagcaatggctaagcactgtactgctggcattgatatcaggatctctaatgaacgggttatacttctagacactcaggtgataagagttatttaactcagtttctgctatgcaatgttccaaatgccagagctgttaaacatattgctggtaacgttctaaaaaacaatcaccttttgtcttgcagccagtattcagtccctccgtactaattgatatgatgaagccagatggttcatccgcaattcctatcctcagtggtgatccattatcagcagacctggctcatgagttaatgggaatccaggtaaatgctatacttcaattctcgcactgggttgtacccactgctaactgagcttgacagtaccgaatagttgatcagtgttttatgttgttctgcaaggaattgctgtagcttggtgttttcttggcatctgtttgcaatattttgttggttgtatcggaggggattaatgacctgtccatgtgggacctcattcttacggtaagttgtctgtctatatttgtttatgcctttgtttttatcatccataccacttgatcacattttcttacagtgaatagttaagaacacatttatatcctccagcgtattagagagctcagacctgaaactccgtattagtatattgtacttatgaaaatttgtggttatgctgtgttgatgaatttagtttctgccaatggcagaaagttgaaagggtgatttaatacaatttttgcaggttgatttactgaagcacaacatacctgatccatcattattgacctcctcaactacccaagacaaggaaaacaaaaatgataaccaatcaggcattgaagattacatagctgatctctgttttgtgcatgctaggtgaacactgctcagtttcatgcttgtttgcattttcttatgttatcatatgctcatttcttttttgatgaacaaagagatccttttgttgtttccggtattttggcagtgaagttagttgttgtgatatgaacacaacacttttgcacttaattctacaatccaatcttttataccaattaatttgataatcttagaatggtgtggttttctaactgaacagattgcgggaacaagacttttctccttcaaagctcatggttctgaagagggttcttgaaaaacacttcaagtcctcctcctttagcattggaagctctggagcaacacctcaagtttctgactcctcagttccttcaagcatgaagattgaggatctgagctccaatcagcaggacatatatcttcttccattaagaacacctgataactcaacaaattttgagtatcggacatgtccatccatgttagggatgcttcgtgatcaggtatgcttgcagctttacctaactggttgttggcgctcagcaggttgagctctttcatattttaacagaattagcacttcgcattctttttttcccaagtaacgaaaaggaatagttctgcatatccttattaatcgatagatgcatatcatggtatatggaaaaataaaaataatatggtgcagaactgaccctgaacacaatgatgactcttgtcctgattctgatgtaaaggcagaataaacgattcttttcagagtactacgtttactctggacacaattcacttagttgtggatattactgtgggtgcagatcttatcaaggccatcgaggtcattctcgaagaatctcaccgagcgtgactggttgaggagctcagcgaagatctgggacatggtgaagaaatctcctgtcatcttagaatattgcaaaacacttcaggattcagggtttttcagaaagtagccatagttacctagctgtttgcatgttcttacgtgactacattactagatcagatgaatttggtactgtatgtgattatgtatatctcggattctgtttttgcccccatcttttgagttcatcttaacatctttgttctcaccggtagcaacagcttttttcttccttgcttcagaaaccagaagcaatgctgaaagattcagagaccagaaacaagttcagtagaaaccaccaaggtctttgctgagctagaggaacatgaaagcatcaacttgaatccaatcaaccaagacttgagagaagttggtatttccatcatcaccaactctcgtcctaacttgtttttctctatagaaagttgtcattttcttgggaggatcctgtataacaacaatatcctttgaaagatgatttctgttgatactacaaatgttcctcttggataaggatgtgtgataagctctgagtcagcagcaacaacaatgcgacagcatggacatgaatgaactgtaaaagagtctttggaaacaccaggtcccagtctaaagtgacggtgaactgaaaggtgaaacgtcaggtggtcttgctttgaactgaagacgctttcgtctacgtctcatctttggtagttttagtcatcagacgacaattcgcttcaagtctctttcttcgccgtccaatcctaaaacaatcttgtctttctatgtttggattcgggaaaaattctccttatttttatgaggatggccatagtactcactacgtcaaaaatgccaaattgcagtgttcatgcaagtcaaaatttctagactagactaaataaatttctcccaaaaaatgatagattttgttcttcaatctcgagatataaaataaaggaagagcaatcaagccaagtagagttgttgccgccgccgctgtcgtcttcttcctcgtttattcgcaggtttagtacgctcttgtcgtactccttgtcgtaggaacagatcgagacgaaccaccaagctcatctatggctgcctccgatctcacgcaccgaccaggtcagtgaccaggatcagtgcgtgcttgtttcgtttttaactcttttgatctgtttagtttcttctcgcaatttcgctgcaccgaattggttcagatttcctgttattcatgtgcatgttcaccatgttcttgttcttgcgaactgaagtgatggatcccaaacatgtattgcgaccatacctgtgattttggtctgacagaataggtgctgtgttgatttctgaattgatgttttctttttgaagtgttaaagcttaattcaaggaattgcttggaatgggattatcattacaagtactaatcgtaatcagcagagcttgggtgtctgctaattcatctttgttcaacatctggggttgcaggtttggcaatcgtgatcatgggagtcagtggctgcggtaaatcgtaagattattacttctttctttctgattaccctgtcaagtattcaaactgattgtgttgttttagaccaacctcaagtcctcagctcagttcatgcttaatattatggtcaagttggtcaattttaggcacattaagtagaagcaagcagaaagagacattatcagtacactgatatgcattttgtcaacaattcaacattgtgatgtcaaatggatgttgctgtgtcttttcctcggagaaaacctctgcatttgctgaagagttggttttaggatgtgactttcaaacctacattcagattttgtaatagtactgttcagctttaaatcttgaatttacttcttttttttttgtcctcagcaaaatttatcacattttcttatgaatttagcatttcattgtgaattcgcaggacagtagcagcactgcttgctgaaaccttaggctgcagcttcatcgaagcagacgactaccattctcaggcaaacaaaggtctggcatgatcaagatcaatatacttctctgaagaattcatcatctcacaaccaaccaacctacatttccctttttcgtttctgaacttctctgctcttccctgtccctgacaacagccaagatgagcaagggcatccctctcaccgacggcgaccgcatcccgtggctggaggccctccgcgacgctgtcagggagcggctggatcatggcgaggacgtcgccgtcagctgctcggcattgcagcagaagtacagggagatcctcagggaaggagactgcagcttcaggtcaggttcagggagctactccagctgcagggtgaagtttgtgtgcctggaggcatcagcagaggtgattgctgacaggatcaggaggagatcaatggaaggggagcacttcatgccggcgagcttgctccagagccagctcgacctgctgcagatcgatgaggcggaggggatcaccgtggtcgatgccacggtgcgccccaacgccatcgtccacgacaccattgctcggttcagggagcagctagcatccactgtgtgctgaatgactgctcatcaagttcccacaggtgtaagacagattgtaattccacatccatgatccaattatcatgtaaaaccttcagaatttgcaaatagcaagaaactcaagctttcttcaacattgcccggttcatgtaaaatcgaatatccgctgtgatgaagcagaacgtgcgacagtagcgctcaagaaagagggggaagaagaaagcaaaaaacatgactctacctaacaacaattgttactgctactgttctaacctggaggcctatacaaaccaaacataatgtatcagaatggccctcgaaacagcttgcacagatcatgatttatgggaattgctgccgattgtaggtgtcctcgtggacaaacaccggttcgctgctctgtggagggatcacaggttggcccatggcgatgccttggttctgctggggaccccaatttggtggacttttcgccgatgatagggcaacgtagtaaactattgccagtgccacgctggcaagtgagagcactgcccctccagaaaagacccctggcttgacaacgtagcagaagctgccaaagtacatgttctcctcaccccgttgatcgttaagtgcagctccggtcagtaggagaaggaacgcgattatgaaagtggccctgcagaatgtaacaatatccaggacgacgttatggcaaataacaaatagcagagtattttgctaaaatatagcattcaggaatcaggacttccgcaaaataagccacaacattctgatctgaaccctaccttagaataaagcacagctaaccccccaaagatgttccaagaaaaaggtagaattgcacttcacattactaattgcacttgaaatctatgcaaaagttattctatttagccatcatgtgaaccactcatatgaattccttgcaaagaataaaacaaacagcagcctaatgctagtacgctatctcacagaaaaacacacatgttttaataaagactactgaaataaggcatcaactgcaaggaacctttgtagtgccaaaatgacagagtcaagaactccaacgcatttggcaaccaagatcccttgtttccataaaaactgtttaacaaactgtcaaggctaagttaggttcaacataacataataatattcagaattctcttagatcggtaagataagttgaaacccgtcaagatagaggaaaaaggtaaaataacacaataaacatcaagggtagagttttaccaagacacgatgaatgagatcagagctacgctccagttagtgtctgagggaactggatgcctcttacaacagatgcaaccagccactgtatttataatagactgggcgaccataagagcaaccgcagatattaaccctagggctaaggctgggcttcttgggtatatgcattgacctggagaagaagtttgcacatctgaaacctgcatgagttaagcaatgtgcattataactgggacatgataattattttttttagataatggaatagaacatcccggcctttgctcagaagagctacagccaattattacaatctagcactctaaaaagagtaagggacatgataattatatattgctttagcgatggtatgactgttattgcaagaatctatatgtaaaatctaagatcatacatagtgaaacagttaatactacagggcctgttcagaagccctggctgcggctgcaccacagccagctactaaaggaaccgaactcatatttcttctaaccgtccgtgcagcgcagctgcagcaagcgctgccaaacagccccacagttaatatgtccagtctgtttgttttttaagttattctatagtaaagtttcacttgcagtcagaagaactttctgcgtagcataagatccttgacacttttgaggtttgcatttgcattatgtaaagctataaacatgtaccaccttatattcctacatcgcggcatgattttacatgcatttcagtgcaaaattagtctatcctcaagcctcaaagaggaaaatatctgcaatgtgcttacaggcactagggtttgtaatgagtttcacaatgattaagctgttctagccgcattgtcaagagtaaaagaacagtagaataacgagtttaaagatttctaataagtaaagcttcaccatatatagtagactaatagtgctatatcctgacaaacaagatgaacattgccagaaaaggaaataacttggacagattctgattcaaccatataattttacacgcactagtcgaatcagattgaactaaacatccactctacacctaacatgatcgcagcactagctctagcgaaaatcaaccaaaagcataaaaaggctcaaagattcacttctgccacagcgcattttcctagcgaacaaccacggataagctacacgcatctactcccaccaggtcagaaatccccgatgggaaacagcgagatccaaacaaaagctcaacttagcagacacaccgagatctataaaagtaacgcgagcgagttcatccagaaagtagtagtagtaacaaggcagttcaagaaaccgccgccgggaacctcggcggcggcggcgagagacgtagctgcgcaccttgacgcgtgtgccctccgccgcgaagccgagcgccgccgagaggacgccgaggaagccgaccaccgcgcacaccaccaccaccttcctctccatctcctcctcctcctcctctaccaatcaccaacctaacctcccacagctcaatccacctccctctatctactcctccttctcccccgattcctacagcgattttctctcgctccgccgctgcttcgccaccaatcggatagtaccaaaaattcgagctttgcctcgatgaatactcactccaacagcgaattccgccgaatttttctgcctttttatttttttctgggtgccttttattctgcagcagcaaactcatctcgctttgggagatgggaccacgcgcgccactgcaggtggggaccacggtctccccgggcccacctgtcggtgaggctcacgtgggagggaggaggacgactgccacgccacgtagagtagtacggattttttttttgcttgctcgaggcgagggatcgatctgtggacgcggtccaccgtggaccgggtgttgggccctcgggcggtgtgcggtggacgcggtgtaggaaggagggaggagcgtcggcttctttcgttggtgggtatctactactagcatcttttgctttgatttgctttaccagttgcttgcttcggttggtaattgaaggtgacccaaccgttgaaaatttagtacagtattaatctctaccgtgttttttttttcgttccagataacaatttttttcgtcgttttgctcgttggtcttatcagccacgaccaaaatttgaaattatttcaaacttgattttatgttgactttgaggggtttgttttccttccgagtttattttctactagtatttacttttcgattgctaataacatatgaaatttttacttgtatatttatttttggatgttttttctttaattttctacggcttttcagccataggccatagatcaaacgattagaatagaatcgtcagctcaagctgccgttatctttcaacgatttcttcaactggtataaagcggagtcttgtgagaaagtacacactgaagatggctgaaagaaagttgtatacttggtgactctgctggcaaagctttactgataattaaattacctactttttcgttctgaattatctacgagccatattaaaatggtactgtaattaacactagttccaagtatcgaacaaactttttcatgccatttttttcttcaatgtgcagtgacagttaggcgctagaaaatgctcctgacgtacatgcgcgcctcggcggcgctgctggtgctgtcggcggtggcgcactgcgccggagtgtacaccgtcgccggcctctccgagctggtccccgccgtggtcgccgccggccgccggcggggtcgtcttcgccgcgtccatgctcgtcgatcgctcactacgtcgtcctcgacataccaaagcataattaaatttgaaaatatacatttcattcaattttttctcgggaatattcgagacgtaaaattttttgcaaaaaacatattgtcggtctcgcaaaaccgttacgcgaaaatgacatcgcgagcggtatcgagtgcggtgaaagcgcgagaccacgcagtctcgcataatggatggaagagcgacctcgcccaagcaatcaacgacactgtccaatgggctccgtttgattagtaattaattacttaattaacaattaaataataataattagtgattaagtatctggattaggaattaattaatcactaatcaagataattaattgctaattaaatcggcatgacactagtattgctattgcttgagcgagaccgctgtttcattccgccagaccgctcggtttcgcgttgttatcgcggaatgcggtactattgtaaatatttgctaatgacgaattaattagacttaataaattcgtctcacagtttagaggtggaatctataatttgttttgttattagtctacgtttaatacttcaaatatgtgctggcatactcgatgtgacacgccaaaactttacaccccaaactttagcaaatgtttactgtagcacaacattgtcaaattatggactaattaggtttaaaaaattcatctcacaatttacacgtaatctatgtaattagtttattttgtctatatttgatactctatatttaatgtgacaaggtttaaagtttttgggtgggatctaaacaggcctaatttccgtctgtgtttgttcttttttcttcggacaacaaattttccatcttctgctctcgttagctgatcaatcgcgaccaaattttagattttaaaactttattttatgttgagttttttttgtcagtttattttctagcgatcgactagcttttcaatcactaataacatggatataaattttcaattgctatttatctgttatattacttttggttgcttcgtttattttccacagcttatcaaccgcaactcaaaagattataacataatagttagctcaaactgcggttaacttgcaacgatttcttcaattggcataaatggagttctgttagagtacgctgaagatggcttatagttgtatacgtcatgactttgctggcaaagcttttctggtagttcacctgttttttccttctgaattaagagcatctccaacagcatctttaaattagactcttcaaatatctatttagccaactctccaactgatttgggtagtcaaactagatgtatgctccaacagtctctctatttacatctccaaaatcacaaagaaacccacatgtcatcctcccatctccattcccttcctcttcctcctctttctctttctctttctcttcccatttcttttctcccgcgtggcagcatcgacccatcgatccagcggcagtggcgacggctccagcgcgcgaggcggaggcggcggtggctccctgcgcagcagcggcgatggctgcgacggctcgtgcgtgaggcgcgacggcgacgacgacgactgccacggcggacggtggcctagacgacgacattggcggggggcgctcatggccggcatatgccctcagttcgtcgccggcagggagagatgttggatggggatgggagtggtggtgggacccacctttagccagtggaggaggttggctacatttagctagccggaggagcaatttggccatccggaagccatccggatagagaggctattggagctcgttttttctctgtgttaactaaattttaccttggagagctaaataaagagtctgttgaagttgctctaagtggagttctgatcaagaaaccataatgatatgctagctaattataaacactagctccaaatatggaacgaacttgatatggtttatttaggccagaaaatgctcctgagattgattgcggtcaatatcatcctgcaaaattaatccattcttgattctactggtgaattccgaaatgcagtccatacatttgttctacactttacactttcttgggctcagcgttgttgaagcatcggcttcctcaaaaaagtacaagaaaaatactccatcagacaacgaccacaaggttttatatatgtttcattttccagtgcccattcgcatgatcttggttccaataagtaataacgttcattgtgtttttttctacaataatcatatgtaattgagataatctaaataagcctaaattctaagtgtttttttacagtgacgagtacattaaaatgtttaccagatattgaaaatgttttgaaccgaaaaattggtttccccgtgtaggggtagcggcgatcagtcgcgcacatcggcagccaattcggtgctagtgcttctcaaggtatgtgttggagcctctagcttgtggtggggtgatctttttttcttcttcttcctagttataggattgtagtgttgtgatttttttttctgttatatcaatatgaaattccgcaccatcttgtgtgggtagttgaaataaaaagattggacgtcctgcccggtacactcccaacttctacgtactgttcatctgttgctcccttctttcccatcagccatgcatgtaaccactccattggtaaaatctaaatggtttttcttaaattattgcgcaaagtgtttggttcgttggttcgtaaactcatccgtatatattatttcgatttccgaactcttaaaatacattttcagatctacgaacatgataaaatgtgtcattccggtccgaggttgccatgatccttctaagattctacgtgacacttatgtggcatgccacgtaaatattgactctttttatttttctttttcatctcctctctcttttcttattccttcatgtaagtatggcaaaaaagaaaagaagaggaaaagaaaggagaaggaaaaataaattttacgactaaaatatccgtgtgacatgccacgccaattgatcttggaggagttgtgcctatttgaaaccagaatgacacactttaataagtttaaaaaactaaaaataaattttaagagttcaggatctaaatgacacacacgaacaaatctagatattggccacgtgatttactctaaattatttatctgtataggatccaatcacatcgttgtgcttgttggtgatacctagcaagcgagtttcctctggaaatttcaagtcgatggatggagctatcagaatgtactgtagtaacaccacaagctgtgttgcaacggagcagagcagaggcaataaccaagaaactaaattaattaatcgatcgaaatcaaacaagaaccaagcccgaggaattgaatcacatggagcccaagttacatgctccttccgtcccagaaaaaggcaacctagaggaggtatgacccctctttggttaacttttttttagatggagggagtacatgatatatcctgtacatgcatatattgtgacgatggaaatagactaattaaggtccggtttgtttggagctagtgctttatgttggtcaatttggcgttgccgtaatgatatagtttttaaccataaaaaaatatctaacatcatgcaggttatcttcatgtgttccaattggctccactcttggtgtatgatgatttcacaggaacaacaggatactatgcgcaatggtgctacacgcttggaattagtagccaaggaacttttattccattttggatggcgtagtacctacagaattttgtgatagaatctacgtgattttgaaaaaaaatattattttagtagatcatatcatcggcagaagttgggggtttgtcccatcttgtcttttttaacttttctgttcacgtctgaattttttggctgtgtgcctacgggcagaggccggagatgtaacacatttccattatctaaaaaaaaaggtccggtttagttactcaattttttttaaaaaaacgtcacgtcgaatctttggacatatgaatggagcattaaatatagataaaaataaaaattaattgcacagttagaggggaaatcgcgagacgaatcttttgagcctaattagtccataattagccataaagtactacggtaacccacatgtgctaatggcggattaattagactcaaaagattcgtctcacggtttccaggtgaattttgaaattagttttttcattcgtgtcagaaaacctcttccgatatccgatcaaacatccgatgtgacactcaaaaaaaattttcgcgaactaaacgaggcctaagtaagagtagtaatcaatggagaagaggaaattaggtgcaaacaagccgaaatatgcatgattatgacaaggacattaagcttaccggcgaagaaagtagccatacgttcttggcaatcaattaatggtgtgggaggtgatgaggaaatcctactcctcctagatagacaaagaagaaagatgtatacaaagatagaagcaagtagtcactcatgatgtgtgcgatggcctcaagagcaaattaacaaattaagcaaaagacgaagagcagatcgatcgagcagagccaaattaataagagagattggacgcgtacgtaattaagagaaacgggattaggattcgtagcaggcaatgcaatgcaaatggggaaaaaagtacgatcgacttcacatgtgtgctagctctgctcatctcaaaagccagccggccagcctcatcaagtaatctttcctactataccaatctcgaagaccgatgaatcgatcgatcatgtgtttaattaactttgcagagattatgatcagctgtggtaagttattagttgctgctgatccatatctcatctttctgatcatcgagcatgcatgccaatgcaagctcacctcagcattatatatatgtttttttgaaatcgtagccacgctaaactgaagttatattaagagaatagaaagtatttacaatattaccaagggactaaatactatcaagggacgtgaaagagagaggaaaataaaagaaacaggaagaaaacataaaaagaaacacacactaaattaaaatctaagcggatattctcgcaatgttttttgccccacacatgctctatagcttgattttgtcatgtattttggcaatgtttttttttttttgccccccacatgcttcatagcttgattttgtcatgtattttggtgagaagttgcgacatggtcttttcttgattttggaatacccttatattttagtggtgtagctagaatctgttttagtggtgtagctataattttgagtaaaggtggtccatttgtatgtaatatgtcaattaaataggtggtccactatacaatttttattatattaactagaacatatactataattaaataggtgccacctagctagctacgcccctgtaatgtttcgttcacatcatatttcctatgccaccaacaagtgaattgacttgtgctttagccctttgcactatatatgtagcccttgcacttaatttgttctcatgcatgctgcatcgcgatctccacttcactaaccactatatactcactagctagctagctgcccagcttcgctagtgttgaggatgacgatgtcggtgagcggcatggcgtgggcgcacgcggtgatgggctgggcggcggtggcgttcgccctcttcgtcctcgccatcaccaccgccgacgcgtcgtcgtcgcaggggccctgcgccgcctacggcggcggcagcggcggcgccacgttcatgcgcgccggggcggcgctggtgctgctgtcggcgacggcgcaggcggtggcggcgacggcggcgcgggcggctgcgaacggggcgcggttcctgtcggggttctttgccctggtggcgcacttcgccggcgcgtacaccgccgccgtcctctccgagctggtccccgtcgtggtcgccgccgccggcggggtctgcgccgcgtccggctacaagcacatgctggtcgcccactacgtcgttctcgacataccgctcatcgtcttctacctcgccggctttgtcgcgcttattaatcagtatcatctagaataggctagctatatactccctcatcccctaaatatttaacgccgttaaccattttaaacatgtttgaccgttcgtcttatttaaaaaaatttgtgaaatatgtaaaactatatgtatacattaaagtatatttaacaataaatcaaataatagaaaaaaattaataattacttaattttttttaataagacgaatggtcaaatatgtttaaaaaaagtcaacggcgtcaaatattttggaacggagggaatatatatataggttagctacatctacatgcactgcaccatgaataatttatagttcctctggttctaaatattcgacgcgttcgatttttttaaacatatttaaccgtttgtcttatttaaaaacttttataaaataatatatatatacataaaattatatttaacaataaatcaaatgtataaaaaataattaataattatttaatttttttaaataagacgatcagttaaacatatttaaaaaaatcaaaggcgtcaaatatttagaaacggacgagagagtactatgcaatgttgatcgatcgatggatcggtacgtagttcgttgatgttgccgtttcagtcctacgctgatcgaatgtatagcaagtttgttttatgtgccagccatatgtaatgtacgtaatatcgatcgatcgatcttgcaacattggcagtgtcaccgtattatttatcatctcatattatatatatatatatcattctgcttaatttgctgtgaacatatatatatgttcagtttggttcaattaatcaacagtctgcagctagctgcaggtttattatacacagaattttgcttgtgagttctgacttctgccccttcctccttttggatatttgcaatttttttaatccaggggccattttgcataaacatgctatgggccttcaaaaaaagcccacgaggcccatataggaatcgatcattaacccgcacgagagagaagccaagaagccaccgtctcctcctttccaggaacgcgtctcctctcctctcttctcttctctctccggcggcggcggcggcggaatccgatccgaaccaaggtacgtgctcgccgacccccgcccccctagacctagggctcccagatctctcgcggatctgctctctccgttcatctcctccatggtgctgcgcctctccgtcggacttctctacgtataagctgggcttcctaactcgttcgttcgtgggtcctgccgtgtttgcgcagcgagctcgcctgcgttttgggggtcccagtttcatcttctctgatgaatttgtgcatgaatcgtcgagatttgaagtggtcgtgtttgatcgattacaagctaccgattcctcagggatgatcgatcgatcgatcgcggagtctactctgtgatcctcttaaccaaatactatgattaattggagcaggggcggaggcaaatgactttttgctaatcccactattaatacacattacgaatagaaaattgctgttgtgaacatatactttgacaccattatagttgaagaatggccccatcgatactaccactggtttcgattggatgaaccatccactcccacccaagccaaccctttcattttaacccgttgcttcaaccaataatccccttgggtctagatgttgctatgtgagactgtgagagagtagggcatttgtcaggagaataaataaacaaggtgtctatatcttcagctgatttttattaaagtatatatgatggttgtggttttaattacatttattctaccacaataagtccagtgaatcacatattgcttgtttgaggacaactgtttgatcttgcacgaatctaatctgttgaactagctggagattcagttgtatattttggaatcgcatattccttatctacagttctacacatttgcgcttgaggcgtgatagttatattttctaactgtggatgactatgtatgtgctggaagactggaacttattccatcgtaccaaagaacaagaaagcagctgatttatagttttgacaacttcgacagttagcaataagcccccttgggtctagtttgctcctgcattttggctgtgagatagtggagtattatcagtagaataaatgatgtgtctactctattatctataactgattctgttaaggtatatgtaggctgtggtttgagtcgtactgcacatttactcttccacaataagtccagtattatttatcatatcacttgtttcaagaggaccgccatttgatcttgcactaatctaacttgttaaactagctggagattaagttgtatatcttggaatcatatttgactatctgcatttctacacaattgcgcttgactatatgtacgctggagcttatttccttttgtctgtctgttgtgtttataccaatgaacaagaaagctgcttatttatagtttgagaacaactacagttagcaggggacttgtttttctagactgtgatgttcactcatgcttctcttcatatgaataatctgtaacattcattttctatcagacttgataatctgtatgccatttcatgattgtgcagcaaaaatgacggccggatacattgctgggtccttggttggatccttcttttgccattgcttacctgtgtgacacatttgtttctgacaagaaggcatttggaggtgagtttaatcttacaggcatgtgcttaacctcccggaagattggaccttaatttgcttcattcattggacgcaggttccattccaaagactgtctctgacaaggagtggtggcaagccactgacaccaagttccaggtctggcctcgcaccgctggaccaccagtcatcatgaaccccatcagccgccaaaacttcatcgttaagtccacttagacgagagaaactggttcagtgtcgtgattttaccatgaatatgaagtttgttttctaggccttgagattgtaataagatgcacagtcaggatacgttttgcatttttcacttcacctgtgagcaaacattggagcttacattatactcacatttgatgaattctgttcctcggtgaaaaatttccactgggcagtaaagaattacattgttttcctatattcatatctttttgtttcagtaagttgttgctcaagttcaaatttgtgctgtttcactgcctccggtttctgcattttagaggcaatgatagtgggtcatttgtgctcaaattatgttgtcatcccagagtttcagttctgctgctatccggtttattttcgatgatatatcaggtctacatttttttggtgaaatcttgtttgataatgcaagggcctagcaatgaattactgcccactgaaatagaacggaataatacccactacaagggaggaagtggaagttaatgttaaccaaaacgaatctgaacttgttttagcataacgacaggagcattgctctacaattagaagcatgaagttacttccaggatgcaaggcccaggcagctgatcctgctcgcctacgaaacgatttgctactgaaagtctgaacctacctacctaaaaagagttgaatgctccacccgctttcaacttctgaaactctagggttgtcatattccggttgtgacagatgttgatccggctgctgacagcgctggtcttttgctaaacagtacttcagtgaacaaaggaatgcaaggccttttgctgtcctgcagaaaatggctgaaccggtgaatcctgtagttgcagtctgcagaccgagcagagttcatgtctgtcagattaaattctaattcatgtaaaactgtcagaataaattctggtatgatatctcccagataactaaattggttatcatctatagatgggaatcagattgaaggaatcacttgtcatgctaaaagaacacaaaaattagacaacacaggctaccattctaagccccatgtcattgtcaccaacttaagatgatgtagcagttgcaaccactaaaaaatatctgcaatggcagtcagcagatcctccttatcttggaagcaaaaaggtaatagagagatcagatagtgatagaaaatcaagttaaaatgttacacgtgatgtgttgagctttaaagtttgcaaactgtgtcattaataactttagtgaattctgaaaaaaaaaaagatctcactgatattgtagtgtctatggctaaaattattgcaaatgcaacttgctgaatttttctgatgctcaacacgccactgtataattaaagcaattccatagtacatcctaccagcctatcattgttaaaaattattgtaaacttgtccaattttcctacatcgttgaagatggaagtcatacgaaaacagctcaacaatcccttctttcatagctataatgtaacccataaatttcaaagttatttcaccatctgcagcatcatatcaatggctgtaatgtactcatgcaaatacaacatttttgagttacatcttacaacaacacacatgtggatcgctgcccacattggtgcaggattttcaaaaccccttcaaaatttagcgtgttgtctacaccgctaattaaacagtcaatcaacatgatcatctactactgtctggttgcttgagaacaatgtgtctcttttcttgggaaaaccagggggctccatacctgggcctcgatacttcagctccggtgtggttcgaagcacaggctctgttgaaacaggtcgatatggaattcctgcggcccctgtatatctagtaggggacacataccttcttggagcacctctcaacgccccaccccgtaggtccacacccctggtagcctcagcataggctcggtctgtcgctcttgtggtggcatccacatagcttctatcactggctcttgttgtgccatcaacatagcctcgctcaccagttcttgttgagctatcagcgaaggcacggtcactggtcgaatgattcaaaatgctccctgtaggagctgtgactgaggtgttaaatgtctcctccggagtccagcccaacgaatccttcttctttacatagacttgccaaatgccaatcaagaacaggaggaagagcagcgctggaccactccacaccacagcattgctctccggtttgtacaccgggaagttggacctgtatatagcaatgtaaccatctccgagtcccaagatcacgagcttctccctgtccgcggcaacaagcggcttcccagctggtgaagcaggcatcacgccaccagaacccgcaaacacagacttgatatccttgattgatgtggcgaatagcaggcggggagccccaaccctcccatagtactgagttgatgtgttgtacacaaggatcttatcttggctggctaccaagaggtagcctttgatcgtctgtatcgccacggggttgtcgatctcagccttcttgattgcccggaccctgcatttcaggctggcaatgtcaccgagcagcaggacgtgcacgagatcgccggcatcagtgaaaccataggccttgaagcgctcggaaggatcgaaggagtaggcctttgggagggagccattgagagcttcagcgaggccctcgcatggtgtctcgcggacagacattgatcggaggtcgagcgacgcggcgccggcctcggtgaggaagaggagtcgctgcttcacaaaggcgagaggcgtcgacgaggcgatggcggtgccgtagagcgtgccgttctcggtgaagacgcggatgcggccgccggagtcgcaggacagcacgtagcgcgcgcggccggcgtggtgggcctcgaggtggagcacgggggcggcgtcgaggccgcggacgaggaggcgggacgacgcggcggcgagggtgagccagtcatcgccgtgcggggacgactcgatgaggcggtgggcggcgatggagccgtcggcgtggccggcgaagaggaaacaatccgtgcggcgcggcgagaggtacgcgagcagggcggtgaccggcggctcgccggacaccccgggctccagctcgagcagcgcgtccccggcggcggagaacacgaagacgcggccgcgggagtcgccgacggcgaagtacttggtgagcccatccgcgtcctcgtagggcagcgcggtcgccgcggcggcgtaggccccgtccccgagccgcgcggccgcggcgaagtggaaccgctcggaccagtagggcctccgcttcgtcacggccaccccctgcggcgccctccggtcgccgggcgccgccgcggcggctgccggcggcggcggatcgggctccacggatctggcgagcgcggactccagcgcctggacggacttggcgagcgactcggtgagctcctcgagccgcgcgagctgcgcctcgcgccgcaccagcaggccggcctccacggccgcagccgcctccgtatccgccgccgccgcctcctccgacgcggcggcggcgacggcggcgagcgtgaggaggaggaggaggggagcgacgtggtgggccatggttgtcagtgacagcggagcgggagtggagtagggtttagagtagttttatgagttttggaggttgggattagaagaggggatctggtgtgtgtaggggaaagtgcggggacgggacggctccgtggggcccacatgtcagtgggtcgtttatgtctcggccggctgtgtgggccccacatgtcagcggttagttatgtgtgggagaatttactatttgccaaatgccagtgcccaaatgccactctcccaaaatttcattcccaaat

SEQ ID NO: 30147 - DNA, 3119 bp, Oryza sativa
catttgggcactggcacctattgctcctgctacacaggacagcctcgttgactaataatattattatctacctgtggggccgaggtgtcagtgggcagcgcttgtgacttgggtttaagatatgggtggttacttgtttgccatggcgtggtaatgaaaaataccaggtttatttaataagttactaaaaaattaaataaaaatttaaacttaggatgaaatttgtctgattttttttttcggttttgcatagtaaccgtcgtaaccagactagcaagggtaacccctcttccaacgataacttggtaaagaaatgcacttgcaggtgactgaacatttttttttctttgtttctgttgtgtagatcttagaacagataatgtcggaacatttcttccggaatctgaacttgttttgctgaaatgatgtaaaatccctgccttgaaacagttactaccctggaaacaaaagagagaagaaaccgttaccagtcgtgcaatcaaacggtttctttctctacttttattgttcgctgttcatgcaatgagacaatttctttctttgctttcatagtttactggtttttcctccttttgctttcattatttacttttcaagcaatcatacagtttgtttgcacacacttgttactatcaaactacactaaaatgacagttgtccaactaaatacactactgcaactttactatacttcagtagtcccagagtcctagagtcctataactctagggtctttgactatgtgctttcttcggtcgcagtagtcctagagtccatcctttcagagggccggctgtggtcgttagcggccgtcgcttcctttggggaattgttgggagcgtagagtggctctgccccctccagttgtttggagcagagttcctttcctttcgttattttttatctttgtttttcttccttccttggcataggccggtctatttgagtgcgtcgtgtttcaaaaaactctattcttctaatatattgacgtgcaatccttttacgcgttcgaaaaaaaaactatacttcagtagtacatagtagatgtgtttgagtagagacaagagaagggcagtggaggttcattgcatcatcctgattattccagcaaaagaggagatggatggatagagagaaacaccatcatcttttgccatcctcatcctctccctgactcttttcttttctcaagatgccatgaatctgcaggagaggaggtgcactccactccagtatggcaggcacgccatggtcgacggctgcagtatacagtatatgcttgtggaatccttgttggcttaaacaagcacaaaagggacagacaaacttcgtagaattgtaggaatttgaaggcaaattgttcggttcattcaacagctaggaaaaattcccacaattccgaagcgtagccttaaaacgataagttaaattcagagaagacagacagacttaattatactcatgaacaaagtatggattgagtaagaaattctctcataaggattggcaaatatataattgaggaaggttatagaagaaattgaccagttggaaggggaatgtctttcgataggaggaaggcgtgtgtcaattaattcggtgttgagttgtctaaccatgtttaaagtatcctcaagaagctaaattactataggtctaaattttttttggcaaagtgatggacataaaaaaaatatagaatagggaatttagatatgcaaaataaatatttgttgagtaaatagttgtatagtaagcagctgccgcggcaacaggttgtctgacaatgtaaagcatgtcctaccggattttacgagttttgaactatttcctatagaattcatgttttcttaaaagcagaccagttattagtgcaatcaaccggatagtttcaatgttcgctgttcatacaacgcagcacttattttttttgttttgttttatttatcgtttataactgttgttctctatccaacagttcactttctttgcttttattgtctactgcttgatttaattgttggtactgttttgccttcacagtttccattgtctactgttgttactgtttgtcttcttcgcttgctgttcatatgcaatcgatatcattgatcattgctagtatgtttttgtacgcatttactgaccaactacactgaaatgacagttcccacaaaattaaattacaccagtaccgttgtagtagatgtatagacaatggaaagagcagtgaaggttcattgcatcatggatacagaaacataaaggcccatcaacttgcccttgttaagctccaaactttttcttcgaacttctaacttttccatcacatcaaaactttcctacacatataacttctaatttttctatcgcatcgttacaatttcaaccaaacttccaattttagcgtcaactaaacagggggcgtgaactaaacagggtatagtattatatgcttaatagaatccttgcgtataagaaaatcccaacaactccaaaccgtagccttagcaacaagttaaatttagaaaagacggacaaacttaataacagtcatgatcaattaacaggaccgagtctgcttgaaactattacaagtacagagaagggatgatcacaaagcgcctgatgatggtatagtatttatgtttattggtacatatatgcagcactattgatggtgttgttcataatagcctaagaagtggatgcagaagcctcctccagcagctgcttcaccttggtgatgtaatcggccatagcttcctccttggatttccctgaattcaccatgatttggatttgtaagcattgatgggagtttgcagatatgacaaagttatatagtttagctgatatatgtttttgaggacttaaagagatcggcatataccttcaacggccttccaagcatcccatttgtatctgtctttcaggttgaaaatacctgggcgccctgaaagatgaaactgaattgttagatacgataactcgaggataaaatgtgatctttggtgtctgtattacgaaacaagtccaaaagcattgcctttggaacttgaaaggtcatgatttaaaaaaaaagtagaacagctgct

SEQ ID NO: 30148 - DNA, 14657 bp, Oryza sativa
aacgccctcacaaatcctggttggggaccacaattctgatgctcagtagatcggaccagtaccactgcaggtttaagaacattgaatcaaacaagttgcttcagaatgatgaaagtgaccaacaaggagacatccaaagattaccataacttccatcatcattgcgccgccaatatcgtacataccaaagatcccggggccagaccaacctacatgttcagttatctattaaattagatgtagctatgttattccaaatctgaggtaatgcaataatatatcgatataaagtaaagaacccaggtcttgtggagtatgatactgccatatagaagttctcatcctacaattttaatttagcaacagttgtccaaacagcaaaaacagtaatgaatttggcagttggcattgccctattgggtgcagaggcaattccaacaagtgaattgtacaatatatgccaggcataaatattctacactcaagtccaaatgaaaaaagttcgtgctcaaatagtttatttagactttcaataagatataaaatgcaatcctcatgcaagttataacagaaccagatgatatgtgcacataaataatcagtacaagaaaaggtgttacattgaaaaccagttcagctgtagccgatgatatagtattgcagtgtgaccatcaacctcttcaactaaactcccatactggaagctacaatcccacctacagtggagcataaataatactgaggtcagcattcatagaaaagcaattaggaagtaaaacacttaaacagcacacacttactcatatcgtgttacatccatactcattattagcccaaaaatggattcacatgtggcttccaccacaccaacagctctcattgctcggctacagcttcttgcctgtaagggtgcacaaggcataaaaggttactcatagcattggcgtgtctgcctttgacagtatataggtaagagaggtacatacaaggtattcaacctccacaagttcttcaaagatgcgcaagcctgccaatcataaagccaggaaactctaattgtaacttcatttgaacaatcctaaagttgaattcaaaattttaaagtaccccttatatgcatgcctatatataatctacgtaaagggctgtgaacttaccattctgacatctaagtagccgcagttctttcttgagtacgcatggatggtgtcattctgatctgacagcccaatatcaggctgcttggtccaatcatgtaccgaatcaggagggcctagaaaaagaaatggtgtatttaagttctctcgtgtagccattacaaaatattaataaaaaattaaaagtatgtttaccattcccgatagttgtcctacgaagcaaagtaggccggggctcttcttcatcttccggtctataatagagtaaaatctcctattacttttaaccagaaggacttacatacagctagataaaatatgaaatcacttgcccactgtcacgatcagagaatgataatgggcctccaaactccatgtcaaagtccagtgaagcaaaagctttgcggtttttagccgtcatagtgtcttgttgctgcagaatgaatatctccgatgttatgcctaggacagttcattggtgtgtcatagaattattgaaaaaatggatgttatagatttcttttgaatctaatatgtacaagggagaaccttcttacaccgtagctaaacaagaaactaatgaaaaaggggctgaaatatccttattacttcgaacaattgccatatgttgttacagtctgttggacttactacacctgatcaataaggagctctagcttctttttccagaccagggcatcctcgatatcatgcgcacccatctgtagaagaacaatactaggattaagatggtatttgaataatgacaagtttactgtatgagaaattttatggtccttaaaaaagtacctcgatgtacctaaattttacactaattttttttgtatctcaaggtacttaatacctggaggtaccaaattttatactagaaagtgtggtacctctcagtactttttcaaggatggtaaaattacccttactgtataggtatatgtgacagaaaaaggctataggatactaaatgaaagagtacacacaaaaggaccactagcatctctcccatatgtagtgttacactgttattgtcaattaaacttgagcaaataaaattgcatagcattagtcaattatcaagcagagaaagggaatccaaaagctacactaatgctagtgaaagtagcgtcttcttttaactatatccaaaagctacactaatgctagtgaaagtagcgtcttcttttaactataaaaccagaatgatgtagaaagggcatcgctcccttttttaggtcaacagaaatatatgacccataaacaaagtacacaaaaaaggatggcaagaaaagggttaacatccagcttatatacttgctttttccaatacactgcagtagtaaaaactatatattgcagacaaaatatcagcaagtgcgtttaaaagcaaattctcaaacatagagtgtattctggtttggcaagttagcatcgtaacgaaccgtgatatgattctccttttctttcttgttgtatatgcacagaacatagaccatctgcaaaacaagaatatcactacaaataagtaaatgacggtattaacgtcacaacagtacagcagtacccctcaaaagtaaggtgtttttcttaaactaaaagatagtgaatttattcaagaaaaaggtatcaagaaactttcccattgaaggaattaaatgatacgctttatgctttatgctttatgttatgatgctagatgaattaaatatgagaagagggaacttacttgaccatgatgtgttttaagccctctgtcttccactctgcaatttccatctatttgaagcgccttcactggcacctgcccatccacaaatcttaaatgaataatcaaaataaagcagccaccatgctcctgttgcagaatttccaatctaaactcgtgtatcagtatggcaatttattaggttaaaatcctccgaataaggcgtacaatcaagagtacttcagctgaagtactctacaataaagagtacttcagctataagaatcttattcaagaatcataatccatgactcattcagacattcttactctccaacgatatgctttacatctaccgaagcagtacatttacagcaaacgctactctaaatgacccagagctgaagagacaaaactccattacttaacaacagtatgtcattaattagcacttcctagcctcaaattaaaagcatccggagatacagatggtaaacagttccaactcagcttcacggttaaatagttggcatcagtttgcaataatcatataccattaaaataaggcaggtggttctatgtgctagtcaaaccactcaaaaatccaaaataacggcagaaaactcatgtgcatcgcatcatgatgcaggcaaattcccctacattcagatttagttatcgtaactagaacatcctccgatcctccactccacccaattggacagaataaaccacaagtcacgaaatcccgctaaaaattcatgagaaactcttgaaaaaaaaaaggtagcgcagctttctgcgagactacgacaaatgaatcgcatcgcgagttcgcgagtatgacagcaaaatcaagagcataagttgcaggatgatgatgtgtataccatgttgtccttgggctgcttcttgtagtaggcgagcagcttgttgtcgaggacgaagtagcgcgtgcggacgaacgacctcccaatcttcctccgcccgtaccgcagcatccacccctcgtgccgcaccgcggccgtcgccgccgccgagaccttggggagctccccgctccgcgccatcgccgccgcggagggcctcgggggatccacgccgccggcgcgccccagctcggagctcttcgccgccgcctccctcctcgaggtcgacgagctcatcatcatctccggcggtgatttcgaattccaactgggtcgcgtcacgtcccccgggccgccacgtcaatgagccataccccagcgggtgaggtggcaccggaggggaacgtggaggcctaggcaaggcgcaggccccgccgaatcacggcggccggagccggcgaggtggccggcgacaggcggaggaggaggggagggtttcgaggcgggggaggcggagagagaagacgagagattaattattattgtaagccactattaaatccccaactactactttgcatttttatttcaaatatttggcttttgcctttttcgaggaaatttctggtctagaccttgtgttttgtctaaattacttattgttgacttggggggtcttttgagtccattgaagttttgtaattttggagatagtactgttttaaaatatgaaagacaatagtacaagcattaaaggaatttgtggttttccaccttttctgtgacattttcatttatttgaaaatgaatatgaccacttcttggtcttcaacttttgttttgttcatattcaatggtacaaaagaatgaattgaatatagcaagttaaatgttgttttaaaaaaggtattgtaaaacatttatatatagaaagtgatactcttcccatttagaggtttggaaaacgtgcacgtcgtaatccacagtcataagagaaaacagtgatggttagataagccactctaacaaaaaaaaccgtaacccgtaagtctagaacactcttaaccaaaaaaaaaactctcaaactagttgaaatacccttcactaaaacaccatgttgaattttcgattgttaagtgtacaacatctaagttttttttaacgactcacgtaacatagtgcgaagttcatattgatacaaccctgataagtcgtaaccagaaaaacgaaaaattacaatattacagtatctatgttgacatggtaccaatatgaacatctgatatcatcttacatgtaattttttttcctttgagattcaagattttattgattatgtaaaaatgtcacatgccagacaggaatggtgctcaaaacacacaacttgtggagtttaatatttattcaaataaaaaaaggggaaatagatgttatagaataaacgaatcagtgtatgaaaaaataatttgtagagaaaaacaccattcacgtgcatcaatatacaaatggcctaaaatgaactgcactagaacaaacacaaagaattgcgattcaaagttttgttatgaccatgaagaaagtttggtttcggaacggatgcataattatttaatattttaataatcttgtaatggattattatgtcactagatgtcatataaaatgaaaatgttccaacctgcatacgtaggaccaacttctttttcctgaaaaacttatgtagtaccaacttgaagtaggcaagaaatgcaggccgtcaaaatatttcttatcaacttccaccggcaaaagcactgatacggagtagtggtatcttctatactacttaaactttactagattcgaactgaaaaggagcaaaagattaacagagccttccatctgaaattctcaatggcatcagtttaataattaagttgtgtatcatgtgctggcctcggagagctagaggggccatttgtaattatcttgatttgaaggggctatgctgtaagcttcagttcgtgagcgagtggcgggaaatcccccgcccactccacggtccgcgctggaacgctctcccgtgtttgaaagctacccattttacccctcgccgtgcgctggacgccatccgtgcgacgtggtcccgacacgtggacggctgagatgtgcttagcgtggaaagatctcgctgtctttaggacggactgattagcgattagtaattgcgtgctcaaatactaattaacccacagaacgtatacatatttttatccagggacacgttgacttccatcttattctcgcgtttccatgtgatttctggaggattatcagaggctagctaggcgttattcagccagttcttaagtgtggaaattaatatgtgcagtgcagattctttttgtataattaaccatatgtttaagaacaactccatgtcacaatctttttgtaaagcatgtgtttgagaataactccatgtcacatatagggtataattagatcaagatgtatccaaattaatgagtaattatggacagcaaagctgacggatgaatgctggtagtgctcctgtcctacgtgcttgctggtctgcagctagcgaatctccagcagcagatgcacgcatccacaacgtggctggcaatcaaaaaactgtcacagctaattaaccagcatctgcagtttgctcataactcgtgttaatggctatgaagaaagaaaaaaaccgagcaactttcctctcggagtatcggtaatctttcgttacgttttcgtgtgatgagtagttctcgcaaacggttttaattggttaatggtcacctaaaatcaattaaattacgtgtgtatgctgcaagtaattaattggctagtggatggacaggacaacccaggaagcaatcaatcaagcagcaaagaacaatttagctcgtgtttagttactttccaatttttattaagtatacgaacacacatttaaagtattaaatatagactaataataaaataaattgcagattctgcctgcaaactatagaatgaatctattaaacctaattaatccattattaacaaatgtttactgtagcatcacattattaaatcatggcgcaattaggctcaaaagattcgtctcgcaatttacatgtaaactgtgtaattgttttttcgtccacatttagtgctccatgtatatatctaaacatttgatgtgacggaatttttagaagtttgatgggaactaaacacagcataattaagcaaaaaaaaaaagcaacaattacacaatgatacgataaggagaccccacctactagtacaaagcagtcatgacattccagagaattagtctcagcaaggcatattcttctcatcctctcatcaaataatatcttgcagcagtttgctgatgcatattccatgccaacttaattgcagttccaggtgtcattagcccattattacatttaacactgttgtgaacttatgatccaaatggcccatcagccgaagtgctcagatttaggcccaaacaaggaagaagcccagccgaagaaacatgggctcggcccaagccacgtcatacgagcacggatctcgaggtgggagaacgtacggacgcgatcccctccgagcggccgtaggctggccctcccgacccagcaaaatcttcttctcccgagacgaaccacccgaagccgcagcagcagcgatggcaatggagaggcttatctcttcgccgctcctcccgcgccggcctccccgcgccgccttctcccgcccgccgccctccctcgccgccgcgccaccccaccaccgcgccggcggtgcggcctccgggtacggctccaggccgcctctcgcctcgctcctcctctccaggcaccaccaccaccaccagcctccggtcctcgcggccaatcctgctgccgatgtggccgccggcgaggctgtccctcccgccaccgccaccgccagccggcgcttcctccagaaggtgagcgcctcgttgcccgccagttttccgtgtcgcgcctcactcgttcttgcatgtctcgtgtgatgattactgatgtgaatttcttcttcttcttccaagaattgcttctgttttgtgatgttgttgtggtcggaggagtccaagagttagcggagattattgagctcacgcgtttggtttgacaggtggcgtcggctgcggctgccactctgttggcgacgattgcactgacgctgatccagccggcgtgggcgccgccggcgttggcgtcgttccactcggcggcgaaggcgggaggtggcatcttcaagtcggagctgctcagcagcgcgtggacggggttcctggccggctgcctgcacacgctctccgggccggaccacctcgccgcgctggcgccgctgtccatcgggaggtcgcgggtggagagcgccgccgtgggcgcgctctggggctgcggccacgacgccggccaggtcatcttcggcctcctgttcctcagcctcaaggaccgcctccacatcgaggtcatccgaacgtgggggacccgcgtcgtcggcctcacgctgctcgtcatcggcgccctcggcatcagggaggccaccgaggtgcccacgccgtgcgtcgcgctggagaacggcggcggcggcggcggcgcgcaccgtggcccgctcgatgctctaccagccaccaggaagaagatcaccttcgccacgttcgccaccgggatcgtgcacgggctgcagcccgacgcgctcatgatggtcctgccggcgctcgccctcccgtcgcgcgtcgccggcgcggcgttccttggcatgttcctcgtcggcaccgtggtcgccatgggcagctacaccgtcctgatcggctcttgtacggaggcgctcaaggagagggttcccaggatcacggagaagctgacatgggctgcctcgctcgtggccatctccatgggcctcggcatcctcatcagccagtctctcggctttagcttgtactgatccgccatccctcgcgacacctccttcttcttcttcgccattgttaagcttccactgcctccactgtaggaatctgccatgagaattttgcaaatgttgcttgttgagatccaggagaattcaagtttagttcacaagaaaaaaaaatgccatgagaattttgcaaatgttgcattgttgagatccaggagaattcaagtttagttcacaagaaaaaaaaatgctttgctgagaattgcttaggtgatctgcgatgagtaaacatgtgttaattgtcacccaaatgtattacacgtacttgaaaaaggactggttaagaacgattcacatcaaatgtatttcttgtacttggaaattaaaaagattggttaagagtaattcagtgtgtctaggagatctggcatgcatttctgtcattctgtttttgtgtcatttgtagttgctagctgacactttgtacttgagtgagatgtactgtatgtctgtatcgaattgtggtttccattcacaaccctgatagattttgagatgctgatatagataggcacattatgttcctctgcttgttcagaaattctatcttggcaaatttgggacaccagatcgtcagcaggtgacgcagaatgcgaatttgctacacagttcttcagtggcaaatcaaggacaagtctggaactgggatcaaataataatgtatatatcgaattcaacctgtgaagaacaaaaaactgaacataagagctggttaaaatattcaaccaaacagtcgccttgtccgcagataagatgatgtatgattgctgctgttgaatgaactcttcgtgtttgcttgctgtcttatcagccataaccagaaaagtaatttaaaaacttattttaaacttgattttgaaggtcttcttttcaacattggttgtttccctgaattagttttcaaaccattaaaaacaaagatatacaagttgtccataaactgttcatggttttatctttccacggcttatacatcaaacaatcaattacacagactgaacttgtacgtagtaaacggagacaaatcggaggttatgcttatgcttatcagctaaaatttgaattttcaatcttacatttaggggtttttttttatcaaagtttatttttagccttttcttttagatcactaaaagcatgtattatttacaaattatttttcgtttgcaaatataccgtttataagccaaacgatggggcattaactttggggctttaacctatttgccactcttacgagtagtgcttaacgatttgccactaagcccacatgttatagacacatgagagcccacatgtcattgacagggtgtggcaaatcgttaattgtcatgtcacaagagtggcaaatagttaaatttcccgttaacttcaaacaaggtgcttatcgatttttctatatatttgtcgataaattttcttccaaaaatttgacagatgtaattacagtacaatcgtagtgtaattacactgtaactatagtgtaacttatatgtaactttcaaaaatctctacataatatgttattctggtaaaatagaggttgtgggaacaaatccttacacatatgtgtgttgtggttttatttttcttcctcaccaaaacaaatcttatatgaaacttatatacaagttacgctgtagttacgtgcaagttacagtgtaattacactacgattgtactataattacatctgtcaaatttttaggagaaaatttgtcgacaaatgtataggtggtcccggtgcttatactgcgaaaaaaatacgggccgttctgtccgtgtaatgggccttccgggccagaattcggagcccaaatgggcccgtttaatgccttggtggtgaagtcccaactcccacgttgtctcgtctcgtctctcgcaccaactctctctctctctcccttctctctccccgattcctcctccgcctcgccgtcgagatctcgccgcgcccgcgcccgcctccgccggagctctcccgcgccatggcgacgcggaaccggacgcctctgtaccgcaagtaccgcgacgcgctgcgccacgtccgcgcgccggcgggggctccgtcgtcgtcatcgtccggaggaggaggaggaggaggaggcggggggccggtgatcgagatggcctcgctgctgcgctccaaccgcccctacgcccccctcagcaccgacgacccctccgccgcctccaggtaacaaccccccttccaccaccctgtgccgtctaatctgaaccccacctttagatcagtgcgctagttaatcgtgatgcgaggggggcgcgagatgcggaattgcgacatgggaatcacaattgctagacttagatcggtttccgtgcgagtgaatagcgatgtcccgtaaaatcttttacgatggtgatccaattagcctgtgattcaaacgaagcagtagaattgcagatcgctgaactcattcccttagctagcctgtttaggcgtcatctactgcgagatatttataattggttttgttagttcaagtagagaagttgaaaactgttgtgagtataaacatcgaggtgtggtagcagtccaccaattggtttgggaaccttacttggcactcacatgtggtgtatgtggtgcagtagaagtgctgtgacggtcgggctgcccccggcatgggttgatgtttccgaagagatatctgccaacatgcagcgggcaagaacgaagatggcagagctggctaaggcacatgccaaagccttgatgccatcctttggtgatggtagagatgaccagcgagcaattgagattcttacacatgaggtaacagacttactgaagaggtcggagaagagacttcagaagctatccatgaaagattcttcagaggattcaaatgtccgaaagaatgtccaggtgatgatgggctcctatctttacttattaaacagctacaggactcataagggatttttgttttgatggatgaaatgccctttgattgttatatgcagcgttcactcgctacagacctgcaaagcctttcgatggagttccgtaaaaaacagtcaacttatttaaagcagctacgccaacagaaagaggttcgtacgtcaatctgctcaaagtccagatacttttgctacttaaatcgatctaattgagatgcttgattaatgaatcatgtttacaggggcaagatggagttgatttggaaatgaacatgaatggttctaagtcgacatttgaacttggagatgatgaatttgaggatgtggtatgctattactttgtctttatctttagtccttagtcctgcagacttgattttacaatattgttatcctgaaagcttggcttatagtaactagtaacacactcaattctaattattatttttattgtttgttgtgtattgctcctccctatctgctagtaactgacttgaaaatcagaatcaagggtttgcccgacttgcttcacttcagagttcagacccacaagtatacacaaaatttgtgaagagaaaaacgcaaaatgaatagcggcacacattatgtgcaatgaaggccatgtctaggtttgggtggttacagtggcttagaataaggcaacataaatctgatagtatgtatttggcttgcttggatcaatttgcaggtgtgagttaggaatctagctcaagaatgagcacaatctagttacatagttggaattcttattctgttatacttctattctaggcattttaatttgacgggattgcattataggatgtagctgttggatgtttatagcatttcattttgctcctaccttttgaccacatgatgacattgtggatcttaatatcaagtccagaaagtcagatttttggcctgtgaatctgtaatgcttgaataaacataataagaaagtaacgcacacttgtgggatggagttttgaggcttaagctattgttatggcagtactgggtagtgaagatcttgcatttccaagcttcccagccctttcactttgtaattgctgtactgatcaagaaaggccgggttctttcaattgcgttttaaaccaagtgaatttaggtacatcatttcaactggctcccgatgcagaagttataatcataaaaaaatacaaggctttctaagtaaaagtgctatagtcccgtgctccacctgcatccacttacctaaatttttctcttctgcgttatcagatggcaggcaagaaacatacaggcgttactgccctttttttttaatcatatcatgaatttagtaacataggttatgttcatgaataaaatcaaagaagtttgagtagctttgcattgtcatgaacaccacaataatccaagcatccatacaccatggccttgcatccatgaattcttagtatagttcatgcacatacttagatggtatccaggcagctgcttttaaactggtttagtgtgaaaaagagtcttaagtgagatgctcaaagaaaacattaacaaattatatgcttcattatgtatatatccccttttagtgttctcgggagtatgatgtttgtgtatgtttttttgttggatttgaaatcaatgtatgggaatagatttgctggtatcaaagaggaggattaaagttccagcataccctttaaattaagtaattgatcgatgatgtagtttattccatgattttaatttcagggtttcacggaggttcagatgtcaaaacttaagaaaagcgaagcattcaccagagaaagagaaagagaaatcgagcaggtgagttctttgtttgttatttgcttatatgcacaatgctatatacatactctcttatttgaattaaaaaaaatcaatcatgggcacaactttattttatattatctgcattctacttgaaggttgtcgaatcagttaacgagcttgcacagatcatgaaggacctttcagttcttgtgatagatcaggtataagaaaaaccctaaataaccgagttatcaatgattggttttgttaactggttcaaactccagactcataattacttcatctcaacagggaactatcatagatcggatagactacaatatacagaatgttgcagcttccgttgaagagggttataaacaattgcaaaaggtttcatcccccaacccattttctatctttagagtatttttatgcagatttctgtagttaagatggaaaaacttctatgccatgtttcatttgccaggttaacttatatgatattttatgatttgtgtccattacggagtagcacagtggtttaagaaaacttgtactataatgttaaccctaaaaaattgcttcccacctgatctatctttttgtccattgaaagaaaatggtatgggtagattaggcattaaatgaaattttaaaaaggtatactatataacttcagcagttatctggtgataaaaattcagtgcttgattttgcatctcccagactgtggacagtcaagcatctcatagcatgtaaatggtgtccaataaatagtacagatcataaagttttttttttttgtgactactagaggtagtaatactaggtcaaatcttcaggtctccgcaagtactgctgtgtgcctttgcgtgcctgtgtgtgtttgtgcatgcatatgctactgtgtgctagatattatcataaaaagttgaggagaagtcctcagtgtttccacctgcagcacctttaccttatatatcaaagcgtttctgcagaggaagagaaataaggcgcaccttcaattcctggggttttcagtctaacatcttcatctggtctcttttatgcaggctgagaggacacataacaaagggggcatggtcatgtgtgcgactacccttgtcattcttatcttcatcatgatagtcctcctgattttaaaga

SEQ ID NO: 30149 - DNA, 837 bp, Oryza sativa
aatgcgatccatacggaattgtacacaggagtacatccacatacatagaattgggtggtggccccaaaagtactctgcatctacttgtagtagcctagtataatactggaatgtgatgttttactaactttgtaagcaaatcatgcatgtagccatgtaacttatgcttctttggcacatggtaattttcagaaagttgttacattcatccattcatgtaaaatccatgcatttttagtatcttcaaaaggaatatataggagtttatttcacaccattgatgtgtttatcttgtgtcttacaatactcctacctaaactagtccagttggttccagcgggggatgttaatacatgccgcatgagctatcagtcatgattgcagccaacatgtaattgtaatgcttctccaactgaaattgtcgagttggaaggtgaccctgacctgcccaaaaaggtgaaaaaaaagaaaaccaatcttgctgagaaagtttgcaatattatccatcgagcaaaccaaagcacaggtaggagaaaaactcccacatgtacattacctactcactaccggccagatatacatatatacagagtagtgtgtagcctggctaatcaattactaagagaaaaaaaaaacctccaatgttgctgctagcaatcttctacccatgctcatgcaaaggacagctactgagagcaagtttagtagtacaacccactacttactataagccaatattaaagctaacatgtataataggttagctataaggttagctttatttttttttcatcctctctctttatctctctatgaatttaatgcttatttcttgga

SEQ ID NO: 30150 - DNA, 5308 bp, Oryza sativa
tttttctacaggatccctgctgtacaatggtagtagcttcttgcttcaatcagggcaaatggaggacagattttagcttgagctaacatgtgagcaggctgctggccacagtgcatgtttgcacacatggtaggcccttaactgagtggactgaatgggggtaaggtaaggtgaaaaccagactctcaaattcactttcattttttccagttccattggaagatgtttcacatgaaatccaactgcatgatcctaaaaggcacttattactcctgtagtacattgcttgtaacatctctaataatgcgcgggtcattgtcgccgaaatcttaacccgattcccttttatgtgtctgtactcctattagtatatactaaaacatccatgttgttcatgaaaatggctcattgctggtgacatgctgatgatcgcatcacgggcgtatcgctgtccgcagcaatacgttttgatgcgaactgaaaacattttatctgtactcgcatgcctgcttcgtaatgtaatgtaatgcttgtgatgttattgcaagcgatgtttgatataattgcttggttttatgtcatgacagggaagagagggaggtggtcgccgtcatggactgatgagggccgtgcgtgttcgttcgccaggccaggacaacccagcaagcatgctaactggtaagcatccatcaaagcttttctctggaaaacaaaacttggcctcagaaagtgggttctgatgaagaaaatgggtaggaaaaacagaaaaaaaaatgggtaggaaaatgaaaggggagatggttgtaaaacccttatcctcccatggctccatgccagggaggcatggagtgatggacacaggtcaagaggagaggtgcaagtgcaagaaggctgttttctttgtaaaccagctagtagtaaaaacttgcaattctctaatcagtgagccagtgacccctcctgggtgcaggtctcctaggagatagggcaagggaaatgaggccaggtatccaaaggcccatgtctctatttaccaggaaatgctatgggtccccatccatgcccccctaaaacaatcactgctttcctcctggaacaaaacatactattataactttataagggatgtaaacatgttgtatggtaaatttagctagccagacatgattaataaggatatgcgctttacaatacaaaggggtgttgtgtagtatgaaagatgactatattgtattataatttgatgatatctttaatgcaataggtttatatttaatcattaacaagcacaagtgattatagctatgttaaaatgactagttttatgatcttctataatcgatacgagaagacagggcagatgtcccttttgccaaccattcaaactcatctcgtttgataactacaagattgaccaactctactcttgaacttatgcatatgatccataaaaacccaagcatatgtggtggtcactattctagaagataccaaccttgtgaactatttcgtctcatgtgctgctaatatgctatatacgagctacgtgttgagtacctggtatattttcacaacacaccaatatctctagtatttcacctcactgcataaaatcgcaaaaccaccaaagaacaccctaatacggctgcaactaccaccataaacatttggccatatgtaaaaacaaacgtcaccaaatcacaagggatgaagtcacaactcacaagtcataacctcccagcccaaccaaggaggaaggagggacttaggccaactcatcaacaccaaacagtgtccaccctctcttggtccccctagcagatcccacccccataaaactgcccctccattggttggctccattggcacaagcacaaggccctccacttctctcttcactcccttccagctccccccaaaaccccatttcattccaacctttcaaatccgccatcaccacctttttttccccacacacacacacacacacacacacacatatacacattgacacatagcagtagtgtgtgtagtactagtacaaacacacacaacacaagcttctctcttcccttcttggttttgcccaagaaacgaaaaccaaaaccaaacccaagaactctcctcaaaagaaccacctcacttcatagctctcacaaggctcacgcacacatagagcttgtgagagcttcttctttctctctctcttgtccttgtggtagctggtgcttaaaggaggaggaggtgaggaggaggcgcaatgtcggagcagccattgccgcagcctcggagcagcatgcgggaggcgctggagaaggaggacaaggagaaggcggcggcggccaaggagaaggccgccgtccccaagaacggcggcaacgggggaggaggcaagaacggcggcggtaacggcggcggcaacggtggcgccggcgcccagcccggggaggagacgacgagggagattcaggtggtgagggaggcgtaccggagggagccggcggcgccggcgtacgtgatgccggaggagccgccggccatggtggagctcgtcgggtggtacctctacggcttctgctcctacttcatcacccacctgctgctccccgtgctgttcccggccatcatcacccaggtcgtcttccccgcctccgacttcaccccggacaccaagtacatcgtcaagggcgccacctgctccatccatgagatgtccatgtaagagagactcagctcccttccctccactgtttgttcaaatcttttcacttcttcttggctgttttctctttgtttttttgagggggtttggtggggttttttggtttgagttttgaaggggttttcagtttgtttccttggtgatttgttttgttttcttctgggtgtatttttctcactccttttttttttcctctcttcaaaatggttgagaaaaatacttgcatctgtgtgagctaagctagatttaccaagttactatcatttttcccccttgtgtttgcactggaagtagtactattagtatttattctttcctttttactagaactttgagcaacttgactagtgatgactcttgcagtgaggtttttcttctttcctagtgtttcccctctctagctcctcttgtttaagacctctacaagcttatgtctccgctttttgaagtttccacctgatgtcttcctaaaatatgcttcttgttttgtacatcaaacgaacaggcatagtgcacttaggaaaaaaaaacttactcttttttctctgtagttttcttgctagtctcttctctgctcttgttcttggtttgaaagttttgagctcgttttaactttacatcgtccttcatcttgtgatctgtactcgtagttctctactccacctttttttaacctcttttacccacacatcttcaaggtaccccaaatgtgaaaataaactggtgtatagtacttcaaagattggatttttccgggctgcactttatatgtggcgtatatgcaaaatcctaaaaagaaatagcccgtgattcctgagattccatgtttctttgctctccattattagcagataagagattcttgtgcaaagctccaaaagatgctactgtttggtcctagatattgttcagtgaggctatttcccacatcccacatttctcttttattaatatattttcgtttttcctgagattttctctacctagacacgtaatgaactgcatctttttttgtcagtttctttttgttgtactactactagctgtgctcttgtgactgtgagagacaagatttcttgggaggaggataaggtcaaacaagaaatccctaggggtgcctttgtaaatttgttttaaaaatcttccgaacgttgagaaacattaggtggtgagatcgaaaatgtagtactgaatggacagtggaagccataagtatgaaatttatgaggtaccccaagccgaggcctgtgtgtctcattaaatatggcctgtgaaacttgcttccatgcttcagataactagccatatttcatttcaactactagtagtactgcaaaatttcttttgtgatccatgcagtgccatatacccctggagatggtagtagctcatttccttggctgatagatctagtttgtgtagctgagggttacattgcttttgtctcacttttgatagaaccaagaaaaagagtgcgcaaaagcagggccatgcttttgcctattctctttggcctgccctcctccctcccttttatttttttctcttttgaacaggaaaagaggcccctaaaccgttgcaattttgcctttaaccccaaatgctgttgagggctagccgcatgaccagccaactggtaggtgcaccacagtatggcatgcttaaattgcatcaggccaactaactgcccttgattgcaagggagattgttgatgctacttaaatgtgtcaacgttgacacctcaacacacaaaagttaccatcttttaacgggttaatctggtatgaacccctggaattctagcacggtgactttcagcaggcaatgcatgtgcttcttgcagtttatgttcacgcattgtttgtacaccctggaagcttttactgcataaatttcatagcatgcaatgtttacctgtacatgttcatgtgatgcaaccaaaccatcatggtcacaccaagtttgtgaaatgttggcaggtaccagaggctgaccaagcattcgattgccattgatggatcccggctgtccccgttgggctggagtggcctatcatgggcgattggaatcctcattgcggctccgatcctcacccaggctgcacaccaccttgaccgtggccagtatcagtcgctcatcctcattgccgcgacatcgtttggctcattcttctgcctcctcactggcttcttcaagacagtctgggtgttcctcttctacatcctgttcattggtgcatccatcattgttgctgaggctgtgcatacacgcaatcttggactcatgatccgtggccttgcagcacatgactctggcaagcaccttgtccttcgccgtcgtgctgctgccagtcagctcaccctgtattgcactgccattggtggcattggggctgcgctcatggctgctttcatgtaccacatgcttcggcgcactgaccagctcacaggcctttgggtcgtctccatcttcagtggccttatctggttcattggtatctgccatggtctcttcacaaaccgacccagcagctcatcgcccaccacagcatttgagcctaacttcttcaccaagctcagctacag

SEQ ID NO: 30151 - DNA, 577 bp, Oryza sativa
aaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtcttgcaaatgtagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatgggtatgggttcagcgcccttttatatctttatggtttaaattctatttttaagctat

SEQ ID NO: 30152 - DNA, 566 bp, Oryza sativa
cgtttaggattttcttccctttggcatgcaatatatatcttgtttggagtaccatactaccatgtggtttaacagtatgttaatttgtaattaaccaatctaatctacctgctgttcgttcctctgttggttaatttagtagtgacagtgttctggatcaagtagctaggtaggtgcagtagtgataaaagatcaaacctttttgtgctttagactttagaggagccatcagaaactgcaattgatgcctttgttatcctgttcttctgaactccaaatatgcagagcagtttcctgaggtaaacaaattcaagtcgattctgaacaaattagttgttgttcttgttgtgcaggaggagtttgaggagttcgccgagaaggccaagaccttgcctgacacaatttccaacgaggacaagctgcttctctatggcctctacaagcaggcaaccgttggcccggttaccactggtatatataggccttctgctcttcttgaaacgatgcattcatcaattgagctaattaatttgctgctgttcaagtgctaagattccatatgcttt

SEQ ID NO: 30153 - DNA, 429 bp, Oryza sativa
aataattacatgtaaccgaatcatgaacaatgcatgtcatgtagaaatttcaagcataccggtttgttacgccatcaaacacaaagcctgacaaagaactgcgtagtatgcaccaaatcttgggatgatcaaacaaaaagcaagcagtgtaggggagaagagagcaaacggaagtaaagaaaaccagaccctgttgagagcaagaaattcatgagaacaggaacacatgccatttaaatatcaggcaattagcttctcaaataaaagcatacctagagattaagcctgacaatgaagatctaatgtcagatccgattgttcaaagaaggtccgatggtaacttttgctggctgatcagtgccacaacaaaaactaccggaaggatgcaagaggatgagatgcaccatgctcgaagaaatgtgctacagc

SEQ ID NO: 30154 - DNA, 26186 bp, Oryza sativa
caactcccagtctcaagcattagaaagcatgccaggtttaaaaataacagcccaccagccataccaggcttaaggtcgcggtgaaaatatccacgctgatgcatgtgactcaaagcttgaaatatctgaaaacaccaatttcggacttcagtctctgaaaagggcttccccctgctcttcatcagctggtagagattgcattcctaaaatcaccacgtaaacagaaaaaacttcaatcacttcagaggtcacaaatgccaaatcaaaagcgtctaattaagaaatacaaaccatgtattcaaaaacaaagaataacatatcattctcccttatgacttccttgagtttcacaatgttcggatggttcatccttcgcaaagactgggatgcgcacacaaaaaaaaaatatattaatgaagtataatagatatcatgatcaaacttgattacatgttgcataataaagcaccttcacttcacggagattgatgcactcctcccatgaataatattttttcttcattttcttgattgcaacctgtcaaggccagatatgttaataatatgtcaaaaaattatgccattgataaggcagatcaagtcactgtcacttcttttcataagatagatcatgacggtaagagttagctccagtttaattcagatttaattactactaggtacaatataaagtaatcacctagcatactaaactccagtgtaccaataaacaagcagccaaactgcttagctactgaaaaaaataataagtcataacataaacaaaattacaaatattggggcaagtagagtggcataccacttcaccactctctttgttgatcgcgcgccaaacactcccaaatgttccgtcaccaacttccttaataatcttatacctgaagcatgatgcaggaaagaagttagcactcagcaggtacaagctcttgaacatctgagagagcccttacacacacatacacacacacacaacatctgagagagaaggggtgttatttacctctccatttttactagctggagagtaaagctggtcttattctagaagagccctgttgtgaacaagactcatatgtgtattgctgaaatgcctttgaagggtagatcagcaaagccactcaacgcttctggaaaaactctataagcaatacccatactctgacaaaaaaacttgaacaccttcactctgaaagagcaacaaatagatcagaagatttggaagaaataaaaaatacaaataggctgagtaacataataattacatgtaaccgaatcatgaacaatgcatgtcatgtagaaatttcaagcataccggtttgttacgccatcaaacacaaagcctgacaaagaactgcgtagtatgcaccaaatcttgggatgatcaaacaaaaagcaagcagtgtaggggagaagagagcaaacggaaagtaagaaaaccaggacctgctgagagcaagaaattcatgagaacaggaacacatgccatttaaatatcaggcaattagcttctcaaataaaagcatacctagagattaagcctgacaatgaagatctaatgtcagatccgattgtccaaagaagttccgatggtaacttttgctggctgatcagtgccacaacaaaaactaccggaaggatgcaagaggatgagatgcaccatgctcgaagaaatgtgctacagctgcactgtaatcaatagtcgactctaatgtgcaatagcatgggaccaggcaagacggctgctgaatgaggtgtgatcttcaggtgcagttgacaaaagagataacgaggaagtctccgtaaagagaaaacctccagccaagaacttcctcgagcagcgaaatgtgcaatacagaggaacttgtggtgtagagggtgtactccatatccttaatgagaatgctagagccctggcagtgcacggtgttggaacctgcaaaggcatgcaaaatgaatataaataagcagcaaagcaatggttgaaaacatgtgtcagtgaagtaacagggaaaaacatagtcaaagtgagaagagggcatttatcgattcatgctaccaaggagcaccaaagcacccatgaaattagacgtcacatgcatgtgccaattcatgttacctacaagcatcaaagcacagagcacccgagatgcactaatttactttcgtcccagaaacactatgagatttgagtctatggatgcatgtgccgtgaaacaacgttaccaaaattaacataggacctcaacagtgataaattgatactacaccatatctattgattgcaacgaattgattgaattctcgcttcctgcacaattaagacagtgatcttgctacagcatacatattactggtaccaacatgatgccaagtgatgagactagacatgaaaaaagtattgagaactagagtaagtttataatcagttgccagtaaattaaacatcagacgcataacatgtgcaacctagcataaatcggcatgatggatgctcaggaactgcgattcatgaatagacgtgaggaatatccgtgactgatgaaccctagctcacacacatcggaaccaacaactcctccaccaaatcccgtagaaatcatgatgcgccaatcccccaaatcaaccctgctaaactccctcgaaattcgaaccaaaacaattcatccacccccaacaaacccccgcaccgatccgaaattccgaatcaatcacccgatccccacccccacccccaccttccccggcgcccgcagcaaccaccgcgcgatccccaaatcaaactcatcagacaccccaaccatggcacagccaagccacgcgtcgattcgattcgattcaccaccaccaaatcagcccaaaattgaatcggaaagtgggacgacgagcgagcgagcgagcgagacagacctgggtgcctctcggcataaccgtgcgccaccgccgccgccgagggatccaggggacgccgccgccgccgcctccagcgctgaagaggggggagggggagggggggaagggtggggatcggatggcttcgtctcgtctcctctcgcgtcggggatttttttttcttcctctcgccttcctgtcctctcctctcatttatctctcagtcgtccaatgtggcggggcctttttgcgatacggtccctgtactactcggttatacctagtccaaccttgccgcgttttctttgttctttactcggagtagtttttttattttattttatttattttttttggaatcgccttgcggttgccgcggtttcagacatgccgctttatttgacgtgtctccctgttttgagtgtgcagagaaattaattgcaaaaatagtgttttttgacttgcgttttatgtgtttctttaagcatcagatagatcgactttgttctagttcattgattttagttaagtcatcttattagtgtttttttttctggttaagatgttaaggtggttgttcagctcacttagcatgtgttcttttgttgcatatgattaattaactattagctataaaaacttgaattgattaacataatttttatagcaacttttctatataattttttaaaacatgccgtgtagcaatttaaaaagcatgcatacaacgaataatggagcagtaaatgagaaccatgagtagtagtaggtctgagcagacccttagtaaggtggtgtttggatccagggacttaactttagtccctatatttagacattaatttagagtattaaatatagactacttacaaaactaattatataaatgaaagctaattcgcaagacaaattttttaagcctaattaatccataattagagaatgtttactgtagcatcacataggttaatcatggattaattaggctcaatagatttgtttcgcaaattagtccaagattatgaatgggttttattaatagtctacgtttaatatttataattagtgtccaaacatccgatgtgatagggacttaaaagttttagtcccatctaaatagggtcttactttctttgtgtgcgaccattttttttatgtttcttatcacacgacatatatgcatatatacaattaactagcacatactcctctttttagtttatttttctaaatcatttattctcaatatctatgattctattgatcacatgaatttatatttattagagtgatccaaatgagaatatgataacaattattttgaggagacgacaataattttcttagtatttacggtagtagagatttgtttctattttttttaagaacggaaggagtattatattaggttaaagagttcgagcaaacatgtcgaaagatcgggctacatgttatagccggattatcttgttatcttagtcggaaagtcaaaagcaagatacgtgagatttgagaaccgtcatttgaccatgtcttttaagaaaaactcatggtagttatcatgttacactgtggatcctaaattgcctatccccacacttgaattaatatatttttctctttctcttaacagcattgagcttgaataaatttccacttttactatacatgaagcaattttgtccctgacctgaaaaaaatataactttaaataaacaatttagatgtggtaatgatctactccttggtaaattaataacgggcaaggtcagtgtgcatgaccaaatatttggtctgattaggtgtccttccagagtggcagaattcgttcggtccactactggtccatgtccctcttgtccaagacacctaattaaactaattaacaaatgctattaatcgtgattagtacactgcatgggcatcagagaaagcaatgggtaccgacttgcgtacctaaaatgcctaatccgtatcgctgtaaacacaatgtattattggtgccacggtgattagtagtaggagagatttttgcttgaagcaaaaaaaaatcgcacatggtacgtgtggtcgtgggtgcattgcgaatacattaattgattggttcatgatttctgtctatctcaatccgattgttcgtgcttatatcgatttagagcaaggctaataatatagccgatatgttagctataaggttttttttttgtcttctctcagcctacttacaattaatatagttagctctttacaattaatataggacccacttgtctctctcacatggtttattggttcttatatccaggccgcctctaagtttacagcccgcttctcctctccctcctctcttctctcctctacctcggcatttagccgacttataacctattattatattttcttataggtgaatatcacccacgatttaggacttgatcggttgtgctagctgctgtagctgcaacaagcaagccattcacaactgccgcaaagctctttggtttggattattggggctggtgcagcagcgcgccagcccgcactttcgatcaggaccttaattacagtggtctcgttctcttggacgatgttaactctaaaaataattatcacaatgttgtctctttcgtgcgaatagtgttatcttaagattatgttattcctcctctttcccaactcacattcatttttttcgcatgcacgtttttcaaactattaataaaagtttttttatagaaaagtttactgaaaaaaatcatattaatccattgtattaaagtttatttcagttaatacttaattagttatgagctattacatggtttgttttgcgtgctgaagagaagaggttcccgaatacagcctaagggccaagagattaaaattttgagaagcagctggttagtagctggcttctgagagtctgaaaatgctgggtttttcggtttatgatttctaaatcattttctagattctacgactacatattattagaactatttagagaagcttataattctgacagaagctacagccaaacatgtcctatgtagtggtcgattcaacttttcatgacttatccactgataattttgtttttcctttctgctagcatccatttgtgtgtgcttatcggtataggcggtaccgtccatgactaattaaagtggtttcgacctcttggatgatccggagactaaagataattagcacaaggttgcctcttttgattgcaaataatgttattttaagtggtggtctccctatttcgatctaaatagcagccacaataattgctactacatccgtaacgttttatattataagactttctattattacccatatacatatatctggatacatatatgcctagatttattaacatatatataaatatggataatgttagaaagtcttataatataaaacggaggaagtagttgattaagtattaatgcaacgtgatgggggtcgtcattacatttgcagacaagtagacaacaataatggcgatgcaggtttggattatccgtgtatttaggtgccatgcttagcttaatactactccactttacagtcatagccacgtcagcgtgatatgcttctcattttctaagtaaattatagtgtgatttaagttacaccaaaccatagtaattcgagaacttctacggtatactacagttttaaggctttgttaactacggtatactacagttttaaggctttgttaactaatcactgtagcacggttaagagcaagtttaatagtatagccagctactggctctaaattatctgtagttaatttaatagtcaattcatacaatagttacctacaaacatataccgcataattaatctctggtcccacctatcatacacatatgtatattggagtccgtgctgcagctggctataaatctgtaacccgctactcttatctctcctcttttatctctttaaaatatgtttataactggcttataatttgctattatatctgctctaaatgacatagacggtgcattaaatgaacttataatttcgatacataagtttagaattgatatgtgaccatgatatgtatcaatatacgtaacacattgcgaagtgagtgtaactcgagaagggaggtcggactcccccatgactactgccctctgccacctccatccatcgatcctgagttcctgacaagcaggcgtagcaaccacccttctcggcccctcttccctgcatttgctgacgttgttcttgtttgcactctcaaggtgagcctcgtatttccccttatctcctccactgtcacagattccggataggctcgtgtttcttgattcgatggcggatggatttggttggtggattgtgtaggtaggggaggatatttctcggttttgccatgccgtacaacagcaagatgggagcgaggaaggacagcgaggcatgagggtcgttgtcgggttaatggtgtcgtcgcaacgagagaggcggggctcgtcgtactccaatgggagcggctcggatgacggcgacggtgggggtgactccgacaccacgtcgaccctctcgaggaagaggccgtcatcggtggtgcaggtgccactcaagaagcagcactagccagaagaggggcgcggcgaccgcaacggtggtggtgggtggcaggagggcggcgacgacaatgatcccttattaattgttgtcgtccgtgggcccatcacgttggctattggctactccggcctcttcacatcgcccgcagtgcgccaccttgaagatgggaagagataggaagagaggtgtcgatggcgctcttcagtgccgtgctggtgccggtcgcgttgcgacgttgatgcgtgtggcgtggatgtactgctcgctagcctcttcgccgagctagcctcttcgcctccttcctctccatgcacgctcggccagcttcgactcgccgatggagatatgagagaggtagagaggggcgaggtggacgaagtgggactcactgatgtgtgggtcccacagttttttttatctttttgtttgacggacatatgtgcccgtatttttttttagtttcaattttgctctttttttatcaagctgtcacgtaagcgtcacgacattaccacgtgagatgaaaacttagtcaaggagccatgaaggcaccacgcgagttaaaaacggggacaatactaccgataaacctcgtttacactggttttataagttggggggctgtatcagatatttcggttcaaaggatgaaaatgggatttggtgtcaagttaagggacctcaaatgaactttatcgatgccaagggccggcccatctagttattacccaggaagacctccggcccacgcagcccgtcgcgtggcggtaggtggggagggggcaggtgggtcccgcagtgcccccggcgtcgcggggtcgtcgtgtcgcgtgccggctgcgctcccctccactcctcctcccctccccaccccacggtgccgtgccctccacacgatcccccccccctccactctctctctctctctctcgcccgagtctcctcctcccgcacggaagcagtagtcccgcaggcggagctctctctctctctccggcaaatcggcgaggtgagctctctcttctcccatcgctgaatgaatccgcgcctaaggctctagggtttcgtttgcttcgactatcatccaccctgctcggatcgccgccggttttgctcttttggttaggggtgtgtgggtgcagcgagtctaggcggatctggcggcgatcggtgtgtacgggatctcagcctcctcgttggggcggatggtcgccgggccgccgcggcggcggttgacccgaatttcgtgtcgaattttgcgtgttagtgattgatctcggtctgcttcccctcccaattacttggaggttcttcagagttggggttgctggtcttcagaattgggtggggcatgagacaattcgcatggcatacacctctttcgatttgtgttgtgcgtctgtgttagttgcgccatcaacgaccgggaaggctttggtgaaatgccgcgccccactttgtgggggaatgagagatgattgcggtattgacgcgtgcagactgatcttagtgctttgttgtcgttgaggttcacgaaacatgagcgaagaggtgaggtgaagaataaccgagacgtttatggtccttatcatataatcttgtctaactagtggtaactaccatgatgccatggaccaataacagctactagaactcataagactacgtatccatccacaataggaatatacgcgtgaccaactcttagttagcacacttttttcctaaatgcacacatcatgtttcagtcctttatggtaacatcttgaccttcactgagccatttctctgaccaagtggcaaccttgagtccttgaccatacaagaagtcgagtgtctcttggtgcgccgttggccaccaacatagatagacaatgccattcatgtagcaggggcaaggaaactcttgtaagaatctgatatcatttggttaatgaaatgggagaggagctcctctctttctcaaaaaaaaaaaaaaagtagcaggggcaatggcagcatctccattttttttcccaggatgtactcatctagcttgactttgtaagtggttttattccttatgatgtctaatagggttatgcactgtttctccgcccttttagaaaatctagtttgctaaaaggtatgaatgctgtttttagtagaacaaaaatgattgatctagcatggcactgagtaagtgtgttatgttatatttctcactttgtaaagcaaacactcctgaaagtactatactctattgcccttgtaattcatttagggtaatgtagaatcacagaaccagctaaattaatgtcctccatgtctcccccattagtaaaggtacaatgcgttgcttcaacttaccaggcttctcttttgctctcacatgcgcatgcatgctgtttgtttgagggtgatgtgagtatgcttaattatcatgacggtattatttatttcctcatgctcaagtgtgttgcttccacgatcctcatttctgcttttttaaactacatttactaccataagattatttatgttcatttggcatggtttctccaggatggaaatgttctttggcagttttcttaatgaatcagcatcacaagagtacttctctggtcgtccaaatgtcgagagatgcccattcctgagaaacatcaatggagctacaacattttcattttcttctgctttgccagtagctgtaagatcttctttacatgacctctggtgatggcattatcaatatcaaaagtgcatttgatccttaatctgtgctattgtgcaggcccgaggagccaagggtccaatttttgaggacggaccaggctttgattcagcatttaaacttttccatggacgggatggaatagttccgctttcaggaaagtcatatgtacctgatgagaacaacagcgagagcgttgatgccaagcctgaacctgctctgccgtttaacccattggctgctagagctgccacaataagtctatctgcatttgggccattcggctttaacttctttaatggcaagggcaaaaggcagaacaagaagctcaacaatctaaatcagtcaaacaagaagcccagcaatccgaatcagaattccatgaaagtttgtcctcattccttccttttattttctttcttttcgcatatggatatggtgctatgtttgtgaagtcctatctagtttctcgctatcatgtcctaatagcaatgcaaactttaatgtttctcgctatcaagtccgaatagcaatgcaaactttaatgttttgtctattattccaagtaagaatgttccgtctaacagttttaccattttattataaagaactgatccagattttgttcagttgaagttaagtgatcgtgattttggttcacaagtaggcattttggcatttccctgggtgtttggctatatgttatttctcatgtatgatgtatccaagtgcacagtgttcttgattggacagcagtagttgcatagctaggattttcatctatccaatcagtttttctcatgttctgttttgaaccattttcagcagaaaggaggtaattcatcatcgcacgaggcaatgagcaacgaatggctggaaaatgggcagtgcccacttgcccggtcttaccgagcaatgagtggcattctgccccttgttgccaaggctttacaaccaccagccggtgtgaagctgaagtgcccacctgctgtggtcgctgtgcgtgcagcccttgcacggactgaacttgtgaagtctctccgtccccagcctctgcctgcaaagatggtagccattgcgttgctcggaatggcagcaaacatccctcttggggtgtggcgtgagcacaccaagaaattctcccctcagtggtttgcagctgtccatgccgctgttccattcattggaatgctgaggaaatctgtcaacatgcccaagactgccatggcattcaccatagcagcctccattgttggtcagacaatcgggtcgagggcggagcgcattcgtctgaaggcactggctgcaaagagcgacgctgattccaccaccgtggctgacatgtatccaaacaagactggaaattgcagtgacaccgagggcaaggcatgggatccgctcgcgatgaagatgatggcgggacgggcttctggtggtgctgctgctccaacaccaagcatgtgtttctgattgctcactgattggaaaatttgtatctaccagtatccctggagagtggagagttgatattgagtctattttatcttgtgatgtaattgcctttgcttgtccctcagaagtattcgtttgtttgtggggtgagacaagtggaataagagtgctactatatacacgatcattctgttgttaagtttgccagttctgcagttcatgtatctgtaatttgatgatgctggatttctactatttatcaatcgtcattatactgtgtgtaacctgttggatgaacgcttgttagctgttctggtgagtgacatgtagccctctttgaatctttttattgagaggataatcactgtatctacttgattgtacaaataaattaaatattttaagaaataaactcaacaaatatcttaaaacaaatggtttaagtaatgcagtaaaagtcctttttaaggaaacatattttttaattgtagagcaaataatttgataaataaactaaaattttaataatctaagagtaataaataagctgaaatttcaataatccgataaatacgctggaaaaacatggcttggacattggctgggtcctaccggcagtgagagagagcagcctgccaagtggggcccagatgtaagagaggtgtgaaagcgagattaaccgggaggaacagcgggctcccgccatttccattcgcgcgtagcgacgcctttcccgcgcagaagaattcccttttcccgcgagaatcctttttaccgccatttttcttggcgccaagcccggctttcccgcggcgcgctcttctccttcctataaactcccccatttcctctctcttctccatcccaattcccatctgctcctccaactccaatccaatcgagaggtcgatctctgaatctgatctgatcaccatggtggtggcactgggtcccggccggttctacggcagcagcctcccacggccgcgcttcttctccggcggcgaccgcgtcgagccgccggtggccgtcaccgacccgctcatggcgtgggcgcacgaggcgcactggtccatgggcggcctcagctccaagcgcctccgcctgcagggccgcatcgagggctccatcgacaagctccgccgccgcgcccgccgcgacgccaggaaggcggccaaggcccgcgccgccggcatcaagccccgctcgctcgccgccctcggctccgacgacgacgactcctcctccgacgaggaagaggaggtcgaggcccagaagcagcagatcgtcgacgagccgtcggagtcggaggaggagcaggaggaggagaacgaggaagaggaagaggaggaagccctcgccaccctcgccgccgcggccaagaggaagcgggcgaggaagctcagcgacgagttcgaccgcgtcgcgaccatgcaggagggggaggccaagaagcagaagcccgcagcaacctctacaccggcgaggacttcaccgaggaggaaggccgccgaggtggctctcaccccggcgccggcgagggcgtcaccgagggggaaggctgctgccgagggggctactgctgcaccggcgagggcgtcgccgaggaggaaggccgcggcaaggaggacatcgccgaggatgaagcactgagagaggtggcctgcttaatgtgaaatcctagttcttgctctgttacattggtcgctctagagaatcgagatgtgattgatggatatgtaatgtgttatgtgtgtgtgctaagtatttagtgatgaaaccattgaaatgtgatgctaatctctgaattagtcatgaattcctgaatcaacacatttccagatctgaattctgaacatcttgcatttcttgtttatgagtgatgacatttttttttgacttgctcttatcagccatcaattgttttgcatgatgaagagaaaacgcgattgtcgtttcaatcaaatgatatcttatgatctgtgtccgtgatagaaaatgtcactgattcgtctgtttcttaattaatcctgaaatgacatgctccccgatctgatttctgaacattttgatgctactccccatctctctagatggaagtagaatgcaattctcaatcctttgcttgctggtagtggtatgtgtttgtgttaagataagaacaggaaaagaatggtacatttaggccagcactgtaattctgcagtccttttggtttgtgtgtttataactttgtatctagtattctttgttctacagtaggggtactaatacagggagatggcctattatgtgttggtatcagagacgattcgttctatctcttctagtagtcgctctttttcttccaccagatcctcattttgcttctgaagctcttctatctgcttggtctgttctgaatctttcctgcaaacacataggatgatttagtagtggcaatagttggatcatgcttatgcgactagcgtgctgagaagcatgagatgtctgtgaagcaatgcgcgtaccggttcatgaaggagaggttaagcttcagtgaccggacctctttctctagagtttcgcagcgcttaagcacaacctgtatgtcagatggtattactggtgttgagcttctttcctttgcttctgccatcctaatcaataaaaacataatccaatgtcactcattgttcaagaaatggcattgtcgattacgaagaaagtgttattgtaggtccaaatgccttgagtcttcagatgtataatagttgtatgtgtaacataccaaactaccctacaaactataagaaccacattgtgcatacatacttgcgtgagcgctcaaccctgcgtttctttgtaggatctcctttatctgcaaaagccaaatatgtagggctttcaggtattaaaaacatgaaaaaaaaggcgctatgtgagatggactacatgatcctttaaacttgtttcatgtttcaccagtgtataagcttttgtctcttcagtaattctttgcagtagtcatcctatactgaacttttaagtttttaaaagtagagttccttgttgggtttacctgcttgttcagatgaaatggatcccattcgagttaggctccctttctgcaaatgagtgaaatgaaccgtataacatctgccatgagaaggaaaataagtgatcagaaatatcagttagaacatacctttctgtcatccttcaaattttcttttagtattctctctctgaaatctgtacaccatgaacaaatacacacaatgttataactagagtagagttcaaacaatttataacagcaatagtgtgctcattgaagattttatatggcctcgggtttaaatttatccttaaggttctattttttttcttaaatgtatacctttgccttttgatctacagtcagctgtcccattgccatttgcagcatttgttctagtactctcacaaacagtcattgcttgcccaatgggaggcaggtcatcacaaacttcaaatccagctgaaggtgctgggatagcagtagatgatccactctgcgaaggctctcgagatgctgtaccaagccaaacctggtttgcaggagcaacaaagttcccactgccttgttctgttggcctctcgactttcggaagcatcaccgagtcttgaatttgggaagttgtcaccagagggaatatatctgttcctccaagaatgttctgttgaaaatgttgactgtcataaaaaccaaaagatatgcctgatgaggtgtctccattagcatggctactaagcttcttgcgctccagtgtatccttgagcatgctcacaactgaggtgatggtatcttgtgctactatatgtggattatccaaaggggatgttgatgaacttgaaggagatacaaatgttggagtctgactgggtgtattgctcattggtgcactgttcacagtacttgcgtttgtcagatcttgtctcagtttgttagctgtttcaattgtttcagttgttattggtggcatgttactttgcatcgccgcatatcttttcctgcacataatggaaaattttgtagatattgagctaagaacatggaattgagctatggattgtaatgcgtaattgcgcatagaactggaaattcctgcctgagttctgaagatctgcttctagtcattggctgagtactatgaaaccaggcctacatatgaagaaaccaggcaatataagcaaattcagccatttactaattataaattcatccatgtattagtagatgggtgatgaaaatgcctaacctttgccaaaagtaggtcactagcttgcattcccttttctgctgcattcctgtcatgggagacaaccaattcagtacaatttggaaaaaatccagaacacaatatgatgttggtgaaaagctatagtacttgagttgttgctggttatggttcattgtaaactctgaatgaactgccaaattctgcggaatcaggttgtcagtaggaaaatgttcttgagcaatttcatgttgctgattaggaaagccagctgcttctgatgacaacctgcatatatttgacaaatatcctattattcacataattattgattttttttttgcatgcagtggtcattaaccataaattgaccaacatacaaactgctagatatctgtacagatttctgattccaagacaaaattttctgagttcaacaccattcacttgctagaaaaaggaatagaccccatgcaaattagagctttctgaatttaccgtaagagtttctatttcatgatttttcaaccttaattaagttaacatgacatggctagtttaatgagggatacaaatctggatacctttgcctgaggttaatcgacattcagttattctagtctatgcaaggcaaccaatccaatcctacatacaattttattcatcactgcatatttatggatactaaattgaatagttagttctggcacaccatgccacaatcttacctagatggttgtcgagggcgattattcatggcactaaatcctggaatctgtgcacaagcaatcaagaatttcaggtaacattaaccatgaaagtaatcagtacatcaatgttcatatctatgtaagcttatgcactatctctaaatatatgtatgtatacaaaaagttgtgcacttcataaaacaacagatgagttgggatttgttttttctgaaacatgaactttcatgtactgagacaaaatcttatggattttcagaaaacttgcctctccattcataagccagctattgaacaactcctcgctgtcttctctgaaaccttgggacagatttctgaaccccatcatctccatgcttggtgccgccgccgccactcccatcgagttctccatcatcgcctttaggaacatatcttcacttgtgttcctgaacagctcagacagacccctgccctccatttccatgaaccctctcaactcaccttcagcccccctgacaaaatacttaaccagattattgactataaagttcctaaaaactgtctttagtacttaactaagtagggtcacaagaggcaatcatatgatttcaagaagatatagtgaaacaaataagataatataaagtagaataccacctaaagcactcactaacctaagaaatggaactagcagaagagttcaagcacacaagacatgatactaattgaatattatactagttggcttataataaacagagtggaggtatcttcccttctgtggaggcaaagattccacaattcttgttttgtcttatgagttgaaaaattggcctctgaagaatttgaccacatttgcaatttcgcatggaaatgagtaaataaaatgcgcaaagaaggtctatgtttaccaggcaggtatgaacggaataactgtacattacttgaagttactagtccttccacttaattaacctggattgaaaaattctgcactatcatcttttgtaaattatgaaaattgcagcagatatgtgagagatctttcacagctgcaatcagaaaaactcttagaatttgttccaagatatctaacatttccataaactcttccaaagttccaatctgcttgtgttagcgataaaataagcccattgatgtaaggaggtgacaccatcgatgacatatttgatgttacttcaggaattcattgatctacatggcatttcattggcatatttgaatcatacacgcaaggctcaaaagtgcagttttggaatggccctgcttgaagcttgacataaacttctcaccagaccatttcttctgcttgtcaggtaaaactactcctgtcttgattaatcgaagatatgccgacggcaaaagctttgttttggacatttctgctgacactgacaattctcatattttcatataattttcttattaactcatcaccgagctgaaaatccctaattattttactgactaggcaacacaattttgagaacacattaggcaccacaatttaaaatactgaattttcatcttcttctctaagactctaagcagcacatgatcacactgatgctgaccttaaactttcctactcttttttccatctagagaagaacaagactctggcgattgaggttctgagttctgactaagacatcaatcaatcaagatctctcttgaccatctagatacatttatatatccctgatagctgattagttggcacatcagcatcagctaacgatcacaagacggttacagtaagtgctccagcaagctgtagctttgcatcctgcccaaaacggctcccatactatagctgttgtccattgcaccatggatggattctctggtgccggcttcacgacgcgcatcgccgatgacgacccgccattggtttctctctttctttttcaaatgttgttcttgccattttcctgtttgaagttttccaagcaggcgatgcaagaaccgagctgtgcctgcctgcacaatcgcaaacatatattttcttaaaacataaacaaagatcacacagggatagtaaaatatgatgaaacaatattcagcatcaacttgattctttaaaatttgggtttgctaaaagtcttcagaattcagggcttatacaaatatacaatatctgcagtcgcttactgtcttggcctatcacagagccgcttccatttccatcgaaatttcgcttcaaagatcagaaagcgagtacaatctaatacgcctccgctgtcacaagcgtattactatctattacgcctttatgcggggaatgcggaagatgggccttatatccggcccacgtagaggatacctttgcttcgatatgggctggcccatgagaaggcccaactagagcggcctcggcttctcttctaaaaccccacctcgcctcgcgtcctcttctccaaccctagcgcgccgccacctcgcgtcggcatcctcctccgcctccgccgccgccgcctcgccgcccaaggtagggtgccttcccgtccatctcctcccctctcgcgcagcatttctggatcagtcgaggcttccagttcgatctagaccttcgtccattcggatctcggttcgttgtactgcgcgcgcgctccgtttcttgtttgtttctggatgtagtgagatgttgtggagctaggacgagagatctcactgttctgttcttatggcagcaggcgaagcgaagctcgtgatttgtaatttgtagcagtaatttttggttgattctcatgcgttttagtgggatctagaacagggtgttagccttttctttcagtaatctggtgtggatttttgctgcaactgttagtaagagctgttaggaaggaatcgcatgatgcttatggtttgtgtttgtttgatttggtgtaggtaaggtaagccatggtgaagcacaacaacgtcatcccgaatgggcacttcaagaagcactggcagaactatgtcaagacatggttcaaccagcccgcccgcaagcagaggcgccgcatcggtaaagtgattgatctcttgcgatctatctaatgattatgtgaatgaatgagcatgttagcttcctacttgctcgtgagattgtgctgtgtaacatatgcgtgaactgcaattgtgcttctaaatgcccgtagtgcttcttccctgggtgttcgtatgatattgactgccgatcacgcatttcttgctctgtagtgttttatttgctggtagctgcttagacactgtttacttatgtacatattttgcttttatgtctatttgatcagcagccatctgcggtaacatataagttaaattgctatgctgtttcttaattttatagtttcttctggtaatgtgttgtgtgatttattggtgctatcataattttagtttgctgcatagccagactagattaaaattcagtggtctggatcttgataaaccctcatctaacaatttgtgcatgtgtttgcgacaaattgtctactttatgctttggtaccagtcacttatcgacttaaactttacatgcttctggattctatttggttttgcatgtacaataagctaaaagatgctttgtgtatttcttttagttctgctccttctattatttaaaaccagccacaagatgctgtgagttatgcattgttgctgtctaaattggaaaaaaaaaaggaatgctcaagtgctatttgtagtcctgcatgaggcattaaattttatgtttgaagatgctgctatttcttttttacccagcatctaattttcttttggtgttggcttttgcagctaggcaaaagaaagctgtgaagatcttcccccgccctacttctggaccacttcgccccattgttcagtgccaaacacttaagtacaacatgaagtctagggctggaaggggcttcacccttgaagagctgaaggtaaatcagattgcttgtttgaatagcaacattgtagctttgacgccataatgccgttgaaactttaccatgtgttatatttggatcgtgattctgatctcaataaacctattgcacacaggcagctgggatccccaagaagtttgccccaaccattggcatctcagtggatcaccgccgtaagaaccgctcacttgaaggtctgcaggccaatgtccagaggctgaagacctacaaggccaagcttgtcatcttcccaagacgtgcccgcaaggtcaaggtgagggaactttacccgccttagccttacacttaaacccactgttctgaagatcccttacattaaccaactcctttcgcaggctggtgactcgactcctgaggagcttgccacagccacccaggtccagggtgactacatgcctatcacccgtggcgagaagcgctcggttgaggtcgtgaaggtcacggatgacatgaaggcattcaaggcctacgccaagctgcgcgtggagaggatgaaccagcgccacatcggtgcccggcagaagagggcggccgaggctgagaaggaagagaagaagtgaaaggattgcaacctgcaacgttaagaatagatgccctaagttttattaccattattgttatcagcttctcctgatgcgagactggcattctgatcttgctgctgtctgtctactcttcagtttgagcttgtttgggtttttgtctgaagtgaaccaaactaagtgcatactacttgtcttaagatgaattcagtcatttcgctacgtctcatttacctgccagccatatggatgatagtagatgcttgtgttttcattcgccatttggctgtcaaattctgttctttttactataccactgaatttgaaactgagtcgtcgtggtcgtgttgcgacttgtgacgaaacagatcgatctaaaaacgtgccaaatcgcaagtaatcacaaactggatcaaatccgaagaattttatattctgcaaaaaaatacaaaatggttgataatagattttttttatttttaattttttaaaaaatatttacagtaatattatactagagaaaatatttacagaaatagactctgcagccctccccgagggcggccagatcaccttgccgcccttcacttgggtgatagggtctattttttaaatatttttacgggtataatatttttgtaaatattaaaaaaaattaaaaatgaaaaaaaaatcttggtaataatgtggcggcccactaagctccagctagaagcccaaagcccacattagtttgggcccattaatatctcgggcggccgcttatcccctcctccaatcttatcgtctcctcgaagctttctcccaaactgctcgtccatggcgttcgccacactggtgggagtgggaggcctatcgcctgccctcttctccccctcccgccccctctcctgctccagctccacctccgtctcggccccgttcatcctccgcgccggcggcggcggcgacgcccggcggcatggcctccgacgcctcgtcaccccactgagagggagcgcctgcagggtaaactgtcgcctcctcctcctcagcttagcatttctagttggtagctcgagctgactgattggcgctgctcgccgttctttgtttcctgtgtattattttggataagtcacactgttacgtgttaattcaccagacttatcaagcgagtagctcttctttatggattcactgactcaagaaaatgcattttcatttctgtagatatttgatttgtcatgacattttcggttggatgtgtgaaatacatttattatgcaccatttctagaataaaagaatcctctccagttctgtagacgattaatttgatgtggaagaatgcatatatctatgtattatttcaacagggagagagtacgaactcacgtgtactccagtgtgccaatgaggctaatgtggtgaccgaggatgacattgtgaacgatggtatcgatgatgaaaccgcttccgatgctgaaatggatgaggatgctgaagcaaatggtgatgagtcgtcaggcactgatgaagatgcttctgtctcctggatagagcagcagcctcttccttatccttcagtaagtacacaaataccaatttgtggttttgcacagagtagtagtgacaactgtgtgatgggaaatgtaggatgccctagagccatacatcagcaaggagacggtggaacagcactggggagttcatcagaacattcacgtcgagaggctcaatggcatgattggtggcagtgagtgggaggggatgtcgctggggcagatgatgctatcctccttcaatgagggcagggaggcaccccatccccccttcttccatgctgcacaggtatcattccgtatgctgagctgtatgtcctccatatgactaattactggacattcttttagatatggaaccatgatttctattggcgatctatgcaacctggtggcgggggaaaacccccagaacgccttttgaaatttatcaacagggactttggatcctatgatggcatgattcgacaatttatggatgctgcatcaactcaatttggttctggatgggtttggctttgttgtaagtgatgtacagatgcttagcgacatacttattagcttcatcgtaccagtttcaaaatttgcatatgttggtgtgatgaactgaactcttttttctgtaactctctccagacaaaacaagcaagttgcctcatgtgaaatcaagaagcccaatcccatctgataattatggtagactggtcatctcaaagtctccgaatgccatcaatcctcttgtctggggtcactctgtgagtattaacttgaaacacttaccctacattgctatgccattcttctgtcatgattcgtatgcaatggctaaagttgaaatgcaaagcatacgcctggcactgtatgtctgctggtttttttttgccgtatgcatatccagcagggatctcatgaggctatttctttttgcagccactccttgcaattgatctttgggaggtatgaatattgcaatcaggtttctctttcttttcctggcatttttattaataaacaattatactaacaaaacctattactttgggcaacagcatgcatactacctggattatgaggttagatgacaagtgatgcttacatttagtacttaaaaaaaacattttgttttacttattttgttcatggctatatctttgcaggatcggagatctgactatgtctccacatttctagagaagcttgtgtcatgggaaactgttgagtccaggcttaagaaggccgtacaacgggcagtagaaagagatgaatatgttagcacaaagcatataaggaagcaacttttagctcgggcaaagagccaaatcagagctatgcctcagcaggtcaatggggatgcaagagagcagaccagcggtcaagagaagtccctaggggtgtgacaacggagccaagtaagctacggcaggtgggtcatgttgccgagttgaaccatggggatgatggacttgtaacacaggaagctagagcagctgatcaatcttcaaggtagcagtatccgaagattgtatgcacatactgtgggcaaccctttgcttaatagcaaatgttgtcgtacaggcagcttcacagtttctgtcgctgtcgatgaatagatctgtagttcgtgacactgcagcaaatacaagtcacaaacccagagtcatgtgcgagctaaattttgataggagtaattaggtttgagtatcatagagatagacaagaattagtcacttggagcaaatgagcctgacatcttgtattcctgtgctgtccatgtttgaatcctgaacttctgattgacaaaccaaagaaaattgtagttccgaagaaatacatcactggtgtcagtaatgtttgtttcgacaggctctcatgaattgccatggtggttgcttggtacttggtaatgaggacctacagttttgtcatagatttccatgagctgtgtgttattttctggttgctcttgtccaggaactcaataataatgtcctgatgcgttgcgctacatttttttagaaaacagtcaactttcattacccagctttgaaaccaaagccaaaagcagcagaacagagcattgctctgcatttacaatctggtttccaaaagtttacctgttgcacctgatgccagagattaacacactgttctctatttctctacttattctagccgtgttggtctacccttatattctttatctctctacttattttccttttatgtcatttgcgctgatgtacaaaacctcgatttgcaagtcttgcgtgtattcctgaataaaaagaacttttgggagtaaggccgtgtttagttcctttccaatttttttttaagtatacggacacacatttgaagtcttaaacatagactagtaacaaacaaattacagattccgcatgtaaaccgcgagatgaatctattaagcttaattaatccgtcattagcaaatgtttactgtagcaccatattgtcaaattatggtgtaattaggctcaaaagattcgtctcgcaattttccgtcacatcaaatggcgcttagcaaatgcggcggtgccagaattgcctcttcctagcttggttccacggtcacaaaatctagtcagagattaggccttttgctccattctgtgtcctgtaacccgtcctcttcttttattttttagtttttgggtccgttgtacataaactttattcctattaataaaaaatgcgctgcttgcgtattaaaaaaaatctctactaataacctggtcatcacattgacaaaatgacaagtacaaaagcggaataaaatcgagtaaactattcaagcaagccagagaatgaagaaggccttagaaagttcactgttcctccctcaactatagcctcagtttgtttgtcatccctatatcacaatgattttcggcccttaccgttcacaaaaacctcatacgagatgtcatcctgtactgtccatgtttgacttctgaacttctgattgacaaaccaaaggaagaagttgcaagtgagatcgtacggttctcttatggttgctctggtccatgaactcaacaatgtaattagtcaaaaaaaaaaaagaactcaacaatgtccatatccattgctctgcatttgcaattggtttccaaaaaaatacttatttcatttaattgtttaggattcctacaggcactactatagtactacggagtaggagatagacaacccaatcaaattaattagttttttctcaacagtttgctttaacctattagtagtaggcaacacataaagccttttttattccttcagtatcagggcaggactgtatagcacaatcttggaatatccaaatatctttctctctctctccaagcaaaatcgttgacgtgataaaatctaaaaacattaaataaaacaaccacaaaaaaaaatattttttccttctcatcgaaattatcgccacacacgagag

SEQ ID NO: 30155 - DNA, 4978 bp, Oryza sativa
aatccaagttttgttacttttgataggtgggagcacaaacagagaccgaactaaaagagaagaagttgagagttgaggatgccctaaatgctaccaaggttagtctgttgttataactgctttgagatagaaatagattaatgtttgcttcttaaggaagaaaaattaaggtagtttgttgctcactgagttgatatcaacgttcttctggctttggatctttaaaccgcttcctctttgtcaggctgctgttgaggaaggtattgttgttggtggagggtgcactcttctgagactggcagctagagttgacgccatcaaggacaacctggagaatgatgagcagaaggtttacaaccatgatctactttattcattgtttttgttcgagtgttctataaacctcatctctcaaaagttctgtttttgtgcctgctactatgtatatgggttagaaatgaccatctcgaatttgttgtcctttctaattgacttgttgtatgtattgcttgaactttttaggttggagctgaaattgtaaggagagcgctgagctacccgcttaaattgattgctaagaatgctggtgttaatggaagcgttgttaccgagaaggttagatcttgttcactaacagaaaatcatatgttcacatgtacatctgaataacataaaagatgatgttttaccaggttctctctaacgataacttcaagtttggttacaatgctgcaactggacagtacgaggatttgatggctgctggtatcattgaccccactaaggtctgttgctccccattgatttccgatatttttgcataaaaatttagattggtggattccctatattttagctgaaataattatagcagtgtggactgtgcagttacttttgtgttcacccttcagttcttacacatacagccattgttttgtgttgatgttagtagtttctaatgaaggttctagatccaaggcttagtgttgtggtcctagaaagattgaattggatgcaccatacaatttgctaggtttgatttagttactgcaagagagtgaaattaactttgggaaacgctaaaggaaaagcatgaacacaagtaaaagaacatagaattagactgtagcccttgcacatggttgacacactacgattgttgattcccttttccctaccatgcttcatgagaactgcgatgagctaaagactatgctttcctgatgatgggcaacaggtggtgagatgttgtcttgagcatgctgcgtcggtggccaagacattcctcacatcggatgtcgtcgtcgtcgagatcaaggagcctgagcctgcgcccgtcaccaacccgatggacaactccggtaaatgatattggccaaacgcactacacttcaatttcatgtgatcaaacactccctgaactgttgctaactttaaatctgctccgtctctttctgtccaggctacgggtactgatgactaagttacagttacttgttctccgggaaggtcactggccgtcaatttttgggtagtaggcttgaatctgaattttggtgagatttgagtagtttcgagacaatttgatttgttcccatgggaagtgaaataaacagggtcactatagcaaaatttgtggtgtaactggaacggctgtcaaattacgaaggaagatatttgaaagatttcatgctctctggggtttacccgtgacattcatccatttgtggcgtaatttcctacagcattttcttggcaggcaggcaaagcagcgcagcatgggcttgcacgtcttcaactcttcatgctttgtctggtgactcgtgtgcatcagtaagaatttcatgcgagtatacgtttgtgatgacagcaatatccgatgaactcctgtattattacacggaccgatgactgataaagatgccgccggcgacctttcaccgctagtgtagggcctttttctttcaccgccggcgacctttcatcggacgtcgccggagcgagagaaggtatcgttaagagaaaaaaaatcggatgagtattctatcaaatgccatataccaaatccgttttctctaatgctgtaagaacacacgcaaattaattttagttcagtagaaaaactattgcgctccatcagttctcgtcgagagagaggttaaaaggcagtcactgaacatggggcccacatgtcagttagaacccaagaggagagctcgtcgatcgattcccccgcgaaacagaaatctcgctctcgccgccgccgccgccccgcgtctcctcctcctcctccctggccggcggcgtgaatttgaactactccgtccggccagcctccgccgctccatgccatattcatcccctcctccttaaatcctagcaccctgacacctccagtcgccttccctagccctatcaacccttgtgtttgtgaatggttggatggattccatctcggtgaatgatctcgcgggatttttttttgggcacaattgcgatccgatccgggtatcccaccgatcgaccgaagccgggagggcacgggcgatcaactggttggtttattccgcgacctccacttcattccattccacttaattcctgtacggaattgcttcgttttactcagtctggccgatcctaagcatctttcagtttgttgatcttgatttgtctatgtctactctatttcgggttatataagctgcagtttacctcccaggatttttaactgcggcttatgctttctagcaccctccgctgttagcatttggatgtgtatgtcgtacgtgtagccagtacctacaattaatttctgaggagatggattttggtgctatttttctagttaagagatggattttggtgctatttttctagttaagccgtcactagtaggttgtccttgcttcctgaaaagcaccggtagattgtttgatacttctgatgacttctcctggtcagtgtctctgaacattgtacatggtagtcatacgtctgaactttttgacacagcacatgtatttgctacttggttttgtttgtttcattctccattgcgttatctgctgtctattgcatctcctgcataatctcacttaatatattactctactgtatctcctctgtagtcaacagtataggctatagctgtattaacatggtctgtctatcttacgtaagtgatatgtcgtgttaaacatttgttcttggcggtgacagaacatcgtctttgacacttcattgtgatcccaattagagactaaaggaatgctttccaatgcaaaaggttgagcttacgaacgatcttgtttttgccactaaggagattcagctatgcttgcctacaagatgatttctgacggcgttgatatacaaggcattacatcaaatactattctgtttacaaaataaaatgaaattgattttcagtaggcggatactgctggagttaattcagtagactacttgtgatatcaccaaactgcagaagcactagtcactaaacacagatagatgtccgatcatgtagattcttatttatggtaaaccaataaatctgtacctctagttaaaggtatatttttatgccaatcgtctaacttttgctgcccaagtactcccttaattccgtgaggcaaatgtgactacttccggcatacttgatgccagcctggttttaggtctagtatgaggcttacactatgtgctgcatcagcacttaatttaagtcgatctgttccagatggctttatgcctcttctgttatcctgtgaacttatgaatgattctgttatcctgctctagtactcgtatctactttgtagaaacaaaaaattgtattcagtttatcggaatctggtggtgttgcaggtccgaaacaatgtgcttgctgatgtcacaatgtatataggattggcaacatgatcagaggctatgagcatggttatgtgctgaaaataacctctgttggtgatggtaggcagtttgattgggttattctccatagtttgtaatagttagtgaaaaatagatcagttgagcatgaaaactacgatattatcgtctaactggtattatcttccaattgcttagtcgcagatatcagtattctggaaaatggcataaaatgtgggcatccagttctgttaattgctggtaatattgatcagaacactgtttcaatccagtccttgtggccaataagattggaagtgtatcggagtatggagactgcaagaaaacctggatgatatcactttccaattgcaggtgatatgagcttcaacatctatatactgtttttttctttcaagaatacaactctatgtaatgtgaatagtcaagtggagatacactctaaccccccccccccctacactctttcagtcagattctgtatctatatttctcaatttctgatcttcctgcttgcacttattactacgattggcatgcaggctgaaagtgagctcaaaggagaagaaattttgggtggaagatgctttgaatgcaatggaagtgttatggttggtacccactatagtccatatcagaaggtgaatgttctttttagatcttcaatccatcactcgtggtgcatgtattgttcatcagccgtcaaattccctgtgtcagcatttagcagtgtcagttcatatacttctggcacttttatgaactgcattattgtcttagttgcactactttcttttgtaatccactgctaattcagttagttgtttgctttcttgctaggatgcagtggagaaagctattgctgttgctggtgtctatactcttttgaggctggcatctaaagttgacttcatcatagaatctcgagaatgattagcagaaggtgggtgaatgaagctatcatttttgcgacacatcgaaagtgattatttatgggttcatcttattttctttggtggagattattttcatggtggcatattgtagaacctttttggtc

SEQ ID NO: 30156 - DNA, 644 bp, Oryza sativa
ctggcttggccatttgaacttctcgtgcagctcaaatgatgtcacctcatatcccaaagacgctgaaaaaagaccttgaactgcaaggaatttcaatacctcagtctgcactagaaatttttcttcaatgcacttaaccatttcagaatctgtcagtgaattccctttagatgtcagcttcagattttttaaaacacaaggaattgtagtcactatccaacttttcaaaaggtcagcactcccttggccaaaaaggtccttatcttccattgaaccaacttccgaattctcatcagttgtctgactttgatcagatggttcgtctgtaacagagctttcatctacaaagagtgacatcaaactctgcacaagacacaaacaatcttgaccacttcggaacttggcaaccaaatctttaacagttctcgtttttgtcatgcagtcaaatcttccaccagtatacttctgcaagttagtaataacagcaacacgtcgatcattatcatcactcactaaacttactaactccttcagaaaatgttggccggcattgtgcaaccatgacgattcatttgacagaacatccatcaaaccatgaacaaccttgctggacagaattacttgaatcgaagatggggatagcc

SEQ ID NO: 30157 - DNA, 3194 bp, Oryza sativa
  unsure (1)..(3194): unsure at all n locations
aaaccaaacttatgtgcatcacaaggtgtgattttcaacataattgatacaaaataagagtgaaagttgccataatcacaggtcgatttcaaccaaaaggcagtaccattgatgtcagggggatatcttatctattaaacaagaagccaagtacaacatgcaaactgaaacaccaaagttttcataaaaaatgttttcaggtggtatgaaaatggttgctttgttacaccttttgagaaatttaatttaagattgtcctttttgctggtcatttttctgtaacaattttaaatgtatttgatgccaatgataacctcttatgcgatagaccttcaactaaattttaatgtccctaattagattacacgcataaaaagcatagtcataaaaagtgcagtatgtgcctgaggcgcgtacttttccagctaaatccaggatacggcaacagcgggctcagttaaatatcgtttcttgctaccaagtttgataacctcatccacaaaatccttgacaatgggagaaccttcttcatgtgcccactgtcccgagacccgtccagacctaacaattgatccataaccaaataatcgtcccaaaagattgtccttagcttcctacaaaagaaaaatgaaaaaaaatgagtaaacaaattaacatcacaataggcagaaaaaatcagcagtaactaatcatcataattaccggtcccctcattgaagctgaatactctaacaaattaggtatcaacttcatgattgcttcgacgctgattgcatgaattgattcgagcacaactgcaagacccaatgcgaatccttgccttgcaaactgcaaaccaagttcccaagcataagatacgatctaactgtagcggatgaccaatgcaatacacaaagctaaacttcgtcatggaattggaaaagcatctctaacctctctagaagaagagataccgcgaatgagccgccgaatggcgtaacgcaccgacggcgcgcagttctccaggccatcgtccttctcggcctccatcctcgacgacccatctccaccctccgcttcgctctccccctccttccgcccacccttctcgtgcgccacctgcacctgcctgagctccgccacgagcgcctccgccgcggcctccctctgcgacgcctcaggcgaagccaggtccctgaacacgttcatgtgaagcccaggccccgacaccaccggaatcacaggcggaggagccacgggcgccgccgcagccgcagccgcagcctccggcgccacctccgccggctgcttcggcttagcggcagcggcgtccgattcagcggactggcggtgcctctccttgtcaatctccttccgctgcttcttccgctccatggccagcttcttcttcttcgctggcgcctccgcagccggggccgtcttggctgcggcctcctcctcctcggcggcggcggcggcttcgggctcggagagcgcggtcggcggcctcttcttcccggccattgctgcgccccccgcgaatctcaagctcagctcgaggcggcgatggctgcggagtagaagggtttatgccgaggcggcgatggctgcgaagcttggagccaaccaagcctagggtttctcctctccctctctttctcttcttttttttttcttttgtatacgtatagtcgaggaaccagaggcccaagaagcgacccacctatgcggcccaattcagcccatgtgccaggccggcccagttaggcccacatgccgggctagtatagtgatctcgatgacacgtggggtcgggaggttgacacgtgggggtgaggctgacgtctggggcccaccgaataaagcagaggaggggggaagagaaganaagggnaggtgcagcaatggcggacaagccgagccgcgggctggtgctctacgccgcggggcacgcggcgctgctccctccggcgagcgtcgcgtcggcgtannccggagtagaaggggaaggaatccacctcgacgccttcgcgtctctcgcgtcatgtggcttcctctccctccgctcgccccctctcgagagtgggtactactgatccagcgattctctcttctgcgtcgtctctctctgtgattctactcgctgctctgaccgaatggagattttccttgttttggtcgttgtaggtggggaggagaagcgtgacagcacgattcttgagctcgcgcagctgctcgacgtgtacgatgatctcttccctgctaaggtgagatcttgcttccaccggttcgcacttaggagggttgattgtgcgagaatttagagtaggtagtgctgattgtaatttttgcgtgatagactgagaaaactggtcaagagactgcccaggtggatccactgcaactagcagttcccaagctatctgaaggttggatgtgtgtgatttttgctttgttttctgtaacattgttcatgaattaggtctaactagctttcatgtggtatttgtaatgtcaggtttatggggatcagagctgccatggtcaccaattgccccctgttagttcttttgcagcaaatcttggttttcatgtatccgggactgaagatttagttgcacaatctggatcttccgctgcttctaaggaggctggaattatttcccaggcgttaagtctgcttggattttcagaggggaatgttcaggagacatctgaatttgatctggtgtttctgcatgttgccatggagaatacaaacagcaagttgggaaaattgggaatgaagactgatctaaatcggcttgataaattagttggtgcaatcatgaaagcggcgcccataagttcagctatcgcctcccgtattcttgtatctgtgatgttgagctatgggtctgctgctgaaaataaggatgagttttccatctcaaaatcttcgactgaaatagattctgacttgaacttgcttcgcccacgccagagctatactatgaaagcaggaaatacattggatgatgttaggtaggtgttgttctttgctgcaaatgaaatccaaaaagttatttccaagtagagcatgttttgtctgtagtaatcatatttatgttacacataataagaattccattagattttgtctgctatatatgtaaggtgaatagtttcacggtcttccaaatgtaattactgttgatctttcgctgcatataatg

SEQ ID NO: 30158 - DNA, 4980 bp, Oryza sativa
  unsure (1)..(4980): unsure at all n locations
nnnnnnnnnnnnnnnnnnnnnnnnnnnnnnnnnnnnnnnnnnnnnnnnnnnnnnnnnnnncgtgcatgcgcggcccacaccagaaagtacgtctgacacctccggcgatcgaccaccgggttccgctcgccggcaaagtcgccgttccacgttcccgccgccggcgccgccaccgccggccgtaagttgaatctgcctccgaaattcatcggctcgatctgttttaactgttttagagattatctccattattattgttatttttttccgtttttgtttctgagcatttcttcctcagttcagagctaaccgtgtcacagttactagacaagctgaacgaactcaattttgaatttctagttactcgaggataatctgattaccgagtgataatccacggtatatacatcattatctctccttccgaatcgcatgttagagtagaggatagtgctaattaactagaggatgagataagccgttggacacattcctgcatgcaatgcaaacgcaaagcaagtgtgatccatccatgcgtgaggatcggagtacgtgtttatctgatggaatccgcagattcctccggaatcagcagcgatttctccctccctcccgatgaatcgccgccatactctcctcccctctatataaaccccacccgcgggactacgtcatcatcctgccactctacaaagagcttaattagctagctagtctcttcgatctgcttctctctttggtttccatggcttcttctcgggttgtcgtcgcggtggcgctgctcgtggcggcggtgctcgccgcgttcggtgcgctggcgccggcgtgcgagggcgcgagggtgatgcgcgagggcgccgccgtcgtcggcaagatgtcgagctaccagccgccggtgaggcataagcctcccgtcccgccgtcggggccgtcgcacaggcacaacaagagggcgacagtcccgaggaagaggaagcacttcccgccgtcgggcccgtcgtaccacgatccgcacagctgagctccggcgatcgtcgtgcgcggccatggaaaagacggccggccagtcagcatctctctctgcagtagcttcattaattaattgatttaattagttaggaattataataataatagcaggagagattatctagcttaattggtatttccttcttttgattagtttggtaggttaatttgaggtgtaatgcaggtattgttaattagcatttcgtatagaaatgcgcatgatacatgcatgccatttagtttattttttagatgtttctctacgaattattcattttcttaaataaaagtactttgcttattaattagttattaattgggttaaatctctactatcttaaaaatggagtcgttcttcttccattctctcatcctacatagcacatactaattacacatggaggtgagaaaaacattataggtgctgattttaactgtttcggcacctatagtgttgatctctatatatattttagtagtagtagtgacgttacacggaatactggtaatattataaaaatctcatttacgatttaattatttgccctcgtaatattgaaacactaattcatacgctaattcatgtatctttggagacgatttctgccgaccgttgctactcttaattaaaatgggttttctaattgcatctgaacaaaattcactcagcctcaagattaatttctttagtgaaatgttcacttaaataagggtttattttattttcatcactagcaaaaataatagatgaaacaaattatataacaatccgtgacaaatcttttaaaatgttagaggattaatttttatggaaactgaactaattcttatgaaaatcatataacccaaatatttctttcccaactagcaaaatacccaagctctgctacagataaaatatattatattataatatgtaatagacaaaataaaaatatcaaatatattattatcacttatatgcatgtttgaatatatggtattcacgtgttttaactaaatatttaaactattccataatattagaaaatatcaatggtaaatttgtaaaaagttataaacagtgctggcgtgacagacttttaaatgagcatagatgtgacacgatccaaacatttttttaaaaaaaataaaataaatacacccacaccgccacacgaggtcttgtgcacgtactagcctgcaagctgctatataaatataccacaaggaagcaaagagaactgaggcgcgtctcgcactcttgctcccttctccctcctcgactgatcactgatcgatcgatcgatcgccatggctcctccttgccgccgtccgtacgccgtcgttgtgccagcggtgcgggtcgccgtgcttgtcgtcgtcgtcgtcgtcgtcttgctcgtgctgctctgcggaccatgcgacggcggcgcgaggcacatgctgcaggaggagagtggtggcgcgtgggcgcggcggtcgccggagcccggcgccgccggcgtcctgcaccgccggacgtccgacttcctcccgccgtccggcccgtcggagcggcacaacgctcgcctcgacgccgacgtcgccgagcgcggccagagctcgccgccggcgtcgccctgacgatcgaccatgtgtgcaagctgctcatgaatattaatctactctctcctcttctcttctgattcagtgaaagtttggaaatatatgtgtgaattatttcagatgttttctatcccgagtgtgataattcagctggattctactctgtcatctgtccattgaaagatgtatatatatttgcagagattcagagaccaagaatgtctggctttctgaaacttcaaagatgtttattcttggcagagataagactgtatttggttgatattttgttcatctagcatgcttgcatagttgcatgaaactatggaacatttgttagtttaattctgtcctattaagttgttggcattattgtagacttgctgcacatggtggagtggttgttcagttatgtgatacatattcaagtaagctagatatcagcaggtgactaggtcttccctgtgcatcatctagtcatgctgctctaatgattctatcctgaactagatagatagatttgatatgcttaaatgatgctcaatgatgatgtaactgttgcataatgcatatatacttgcagttgtattagttaaaaaaatgctaaaatgttgtggattaggctctgcatgtagatcgtgttggtgtgtcactggccagagcttgcaacagatttacctgctcccactcaccacttttgcacttcacaccagtatgctgcatgtaacctgtatgcatgcagctagccagttccccccaactgaatgctagaaatgatatgaaattgcacatgcaattctgggataatatggcatgcattgacataatttaccaattaccattgagatctgttgattttgttctgaaacggtaatatggtactaaggtaaaaaagtgccagattgttcatatggcagatagagtcatcacacactgccaggctatgaggaaaatgcatgtacaacaagccgagttgccaaatttggcctcgaattgacaaagacaactcatttctccaagcttgatgcttttggaagatgatcaataggtgatataagctaagagcctagagtatcagctcatagatataggcaaggatccatgatactgatggtataaacagttattggaatttggaattgcatcaagatcatggccggctgaacgctggttactgatgccctaggagagcatcctggtcacattatctgacaactcatagacaacctcttccatgtcctcagagataccattctccttcagagtgaaaaaaaaaaaggcaaagtgaaacagagtaaaacttagtcagacccacaaaaacaaagatacgagggaaaaaatgcactgataatttactcataagatttaccaagtgtcaggctaaaatttaagcactgtcatcatactggcagtaggcaaataccttcgggcctttattccctctaatgatgcacgttgaagcactgatactagcactctttaaatagatcttaggattggagtttagattgattatgccatttggataagcagatgcacgattcttgcccttttcttgtgatcttgggggacttatcatagttcgggcaatagaagatatcgctctcctctcttcattgtcagagtcttgattattgctatctactgatgagcatactctttccctgtcacatgattttttttgtaaagaagcaagcagaacaagaaccacataagattctctgttcagataaaaaaaaggattttaggcaattttaagtttcaggagctagtgaattccagctatataccttggcaaagacgcatgctgtctccgcaagggggtacttctttctcctctgctgtagttctcctcaagatgagcaaactgccgtttgaaacgatcaaccccactgtaaggagttagtattagcaaaagagacatggataagggtgttggttatatcacctgccagcactatcagcatgaaaatatatacaaattatgttttttcactatcgtaaaacaatcatattccccggagagtagaaaataaagcaaaccagctaggtatgaagaaataaagcaccaccgaatgaacaatactttttttaaagcacgccagcaaactagatttaaaaactaatttgctcaccttggatagaggaagctaatttgttctccacctctgatgtactcctgaagcatttggggatggtactctaatatctgtttactttcagaaaataaaaaagtaattttgagtgagatggatttatcagccagcccataacataaaatggagcggtagctttgtacctctcgataaatcatttctcttacatcatcctttgtcagtttccttcgctcaaattcaaactcaa

SEQ ID NO: 30159 - DNA, 201 bp, Oryza sativa
ggttccaatttacccaaaccttttccaccaaaagaaaatacctcttcagcagtaggtcgatctttaggatcaaatgcaagtaaacgctctagcaggcgcaaagcgagaggatcagcattatgaaacttatgagaaaaggggataggatgtttcctctgcatgccagttaaatatcccctggcattctcattacgaatctgc

SEQ ID NO: 30160 - DNA, 750 bp, Oryza sativa
  unsure (1)..(750): unsure at all n locations
ctgtgcttaatttatatttcttatttcccaatttccttgtaaatcagatgatatatttgcttggagatatcattggtttttccttgtaaatctttttactaattcatatcattggtttttcctgactgcaaatcacagttcaggtcctctcatgttgtgatttaatgttcagaaggctattatggtttatgggtacttgctctaatataaattttgtcaaaatatatgtcgaagttaccataatattgcagattactctttcatctaatccctgaattttagattggtgcacagtgattagttaggttattttctgactaatgctgataaaatcgacgtgtacactcttgtatgaaatgaacagtttctactattctatacggacaaccatatatctttgagaatattgattttatccgcacgcggccgcccttcactncggcttgcttggcatctcccccccgcttgctggacgccggctcgctcgttttcttccaaacgccgctgctcgcgaccacaggagaaggaaccccgtgcacaacgctcttcccggacgccgcgtaggcctttcttctcagaccttaccggagaaagcggcgttggagcctgagatcaagcggtccttctagattcagtccttctcctttctcgtctccaagcagcatgtcctcccttgacctcggattctcactcggcaccctttgtgttagtgagcttctcgatctcgcctactcaacttcagcttgtttt

SEQ ID NO: 30161 - DNA, 20191 bp, Oryza sativa
  unsure (1)..(20191): unsure at all n locations
ccacgctgtacgctttatgctttcggctctgatgacgcgcgggatggctagcggtccccttctcacacaggaaacagatatgagcagggtggagcatccattgcttttgttggtacgtttctcaagttaaccctcctagacgaaatcaacatgcaggactgtcaatttgtcattgcaaaaggagggggaaaaaataatcgcaggattggtttgaaaaaggaaaatcaggatatgggagacaaacttgaaccttcgctttatgggcctagtcggccctcggcccattcgagcccaaacataaccctaacataagtcttggtccttgtccctcgcagcagaataaaaaatcgccgccgccgccgccgccgccgccgctgcccgtccccgcaacccaacgcctgattcgcttctccatctgcttgcattcaaccgggttgtggaggaggagtaggagaaatccggtggatatcgatcggatccagatgaacactcgactggattccggcggacagaagtaaatccggagtcggttttttcgtaaatcgcaggtactctacgcaatttttgatcctaattgttatactagtagtaatacagtgggagatgtgagtaataattgctggattatttctggtttttgtacaaggagaaatcgaggtacagatattcatgctgcctcgatgtgttggaatcaacaagatgaacaattaacatccgaagcacaaagaatttcggataaatccaactaatcgatcgatcgtatatgcaactagtgcatatacatatctagtagattcctgttcataatttggaggaggaagatcagttatgagttaccggcgatttgtgaatctggtgcttgataaggtccaaggcaactacacagtgcggcgcatggacatgtcacgcttcttcctcccccgtaaattggcaacgccgctggacgccggagcacacgacggcgcggcggcggtggagtacggcaatctgccatgcccggtgatgagcttccgtgcatcggtctgcccgatggagacgatggagttcatgctccttggtggaaggcataacaagatagtcggcaccgacctgacggggcgcaccctcctgtacgaccccgacgagcacgtcgtccgctccctgcccacccttcccatgcccaagttctcccccgtgtccctcaccatcggcgacgacgacctttacatcctcgacgacatccagggcccgttcaccggcggccatgatcactgcttccacgccctaacctatagtagggagagcttcaccgacgccgacggcgactggtgttgcaacactctcccgccgcctccttacatggtgaagcaacgcggcgacttccaattcgactcctacgcggtggtggatggggtggacatctggatatccaagcaaggcgtcggcacctacaggttccacacggagcgcggagagtggagcgcggtggcgagcggcggcgagtggtgcgcgatgccgttcaccggcctcgccgtgtacgtgccggagcacggcctgttctatggcctcgcgtccggcaccgacaacgtcctatctgcgtctgatctcattagcggcgggagaaagccggagcagcacagcctccttcctctggagtacacgccgcccaaggcgttgacgcaggtgtcttcccacctcgtgcacctgggctctgccaacttctgcatcgccaggttcttcgagaccggcttcttcgacgccgacgaacaacacaacccggagctgttcgctgtgttcaccgccgtcgaggtggagcgctgcgacgacactggagtgctccgcctcgtgaagcacaagtcggagatgtacaagcttatcagcgaaatatattattgggtgctttaatcagctattactccctccgtttcagattatatttattaaaatcaaatgcttaatttatattgggtccgtgaggggacagtaaagttctttgcttaatttatatttcttatttcccaatttccttgtaaatcagatgatatattttgcttggagatatcattggtttttccttgtaaatctttttactaattcatatcattggtttttcctgactgcaaatcacagttcaggtcctctcatgttgtgatttaatgttcagaaggctattatggtttatgggtacttgctctaatataaattttgtcaaaatatatgtcgaagttaccataatattgcagattactctttcatctaatccctgaattttagattggtgcacagtgattagttaggttattttctgactaatgctgataaaatcgacgtgtacactcttgtatgaaatgaacagtttctactattctatagggacaaccatatatctttgagaatattgattttatccgcgttggtcgggcnntnaccaacccttgcccggagcccatgatccttatagagactgctgttggccttgaatttatcccccaacatttgtatgcatggaaatgtggtgaaattttttccagtgattcatcaatataatctggtgagttgatcatgagctggatataatccaaaagcttctgttgatttctacctatgtcctttctgttgatcgctatagggtagattgaatgagctggatatatctttctgttgatttctacctatgtcatattgcagcatagggccataggggccatgcacatttatttgtaattcagatgaacctcatcctgtgcaaataagattgttaaatgctttctgttaatgatggacgctcaactatcaattctaaatttgggtgcaatgtgaatcaggccacataggttcagttggatctgttgagtttcataaggaagaggtgcctatgctcgctgattcatcaaacagctccatcaaagctgtagggcttgggatagactaatggtatgacggaaattaaaaatgattactatggtcaaggcattttttttttgcttatattcttcgatgcatagatatttggttgtattgttgacaaaaatatttgatataacattttattgattcacgcagattaaaaattgatttcacaagcaaacggaagcgttgtctctgctagtttactggctgaagagagtaccaactaacacaagaacagatctaagcatggcacaaaacttcttcactttccagaagaagttcagagaaagacagtctcaccgtatcatgtcagagaaaacttcagcagattcccaagtgcatgtccctgaacttccgcttgattcttcctggacctaggctttcctgggattgaaaaatggcatgcacatctcatgatcaataatatacataatttaaatcagaatcatgtacatctcatggtcaacaatatacacaatctaaatcagaatagtttgcgctctcatcgatccaaggttgccactttaattgctttataatattttaacaatgttgttttcttctccatagcaaattaataaatcaaaacgatggaacatgaggctcaattcttgtaataaatctcatactattcttgttgaacttcattagaatgatagattacatatttacagtgattaagcatatatagcattatagaaaaaaagcaataggacaagagtgcaagaccatgactaattcagacattaattcagtgactattaactattgattcaccgggtgcttagttgttcttctagctgctgttgctcgccgcctaatctgctagctgctcggctgtcagcgtcggtggtctcgttgcccagtcgccagtcgcatggtgccttgcgccctcgcctgctctaccgccatatgctgctcgccggctcgccaccgcggcgcccggctgctgttgcatgcctgcgcccgcctccacttattcgctatcgcgggctcgccgaagcacctcgttgctggcttgtgcttcacccaaccacccagccgcgagtccccaaccctaatctatggagagagacgtgtgcgtgaggtcacggctgcaccaggatcgcatgacgatgacgccctggatggatgagtggggacgacgtctttcagcgaggcgccgcagtggcgatggggaggagagcgcggaggaggcgcggtgtatgccaggagcggtggagggagcggcggagagagggatcgagccatcgagggcgagagatcgcggtggttgtgaggaacgaggagaggtcggcgactcggggggtggggaggggatgtgcgtgtctgccaatagcacgcattctgaagcgttagatatctggatccaatgggtacgattgcgtgtgtctgtcagggttggagtcaccgctaccactacagaattttaaagtaatagagatacacgctatcatttactaagaaggtgtttcttttccatcctattgtcacttgaggtgccgttgaggagggaaggtgttggaattgccaagaaggctgaactccaccaattggtctaccactcctttggcaagatcagcctcaacctgggactgtggtagtttgacatgttaatcaactaccatcctatgggctatttgacttggtgttgtaacacattctgttaacaatggttttcactaattagccccaaaagacaatagattgattttgtaaaactgaatcattattagctttcttttgtcagtgctatatatggtcatagattaatgtgatccattactttggtcaccacttgggacaaccatgctcaaaccaaatgcaagatcttcctttggatggcgcacaagcgacgtatcttcaccaatgacaggcgggtgcgacgcggacttgcaacttccgcgtgctaccccttctgccccatcgacgaagatgtggaacatctcttccttagctgctccggagtggcagccatttggcactcctatggactcgatgaacaacaagtcgcctccctagcacatctcgaagacctatggggtctccctccccctgacaatgctctcaccccacggatctggcgcaccatcttactagccacggtttggaacatctggaaacgccacaacaacaagatcttcaactccattgatgaagcccactcggtagttcttcatcgttgcgccaacgatatcgaattgtggtcaaaccgatgtatcgacgttgtaggcaaacaacaacttcactcttgggcgctaaatctttctgtaattaaccactaatttttagtttcttccctccgtccctctgtacctccccctttgtaaagtttttttttaccatatgaataaagttcaggctggtgttcaaacccgccgtagtttcccttaaaaaaaagatgacgtatgatatctaaagacaatacatacgtaatgcatatataaaattagatttttgtttttttatcggctcataagctagctcctattatttcagctattttgtcgtttcgcatatcaacgaaatttcactgcatgattttttcatctttttgtgtaccataagctacctcctgtatttttcagctattacaatgtttttggagattaacaattatcatgtttatcatcacggtttaattctcccatgtatgtgtagtagcacaaatagttaaacactatctagattttagttaagcggatatgccaatgtgtagcagaatagtttaaagcactatccacctatcgaataaggtgggcaaattgctttcttttccaatgtactcatgtaactcatcatgcatgtcgaatattcagtttgatcatttcagattccatagagaatgtatggatttttttaaaaaaattttagacatttttatttttttaattttattaatagacattttcgaaaaatattttcaaatgtcacatcctgatttttgtttcaggatttataaattatttaataaattcttaatagaatttatattaaatgttcattaatttacaagtgaagttaaatgtgggaaataaaatttcctaaatataaagcatggatggatttaattttttattaaattctccatggttaattatactctctggaatattctcggattttttggagctcaattcctaatttttaatcatacaaagagcatttcagtgattacccacatattaaattaatcattaaatggtctaattataattttgttaagtactttgagtgtccaagtatgttcaagatttttcttggaattatttgagcattggaagtatttttaacaattcaaagatcatttcattgattaatttaattggaaaaagtaataaaaatcctcctcctcagcttgggccgaatccagcccattccctcctttcccctctcccttcctctcagcccagataaagtctgtttgacctccctatcgctacagtactccatcttcctcctccagacagagccgagccagccgtgctcgtgcacagtgccgccgcctcctcccaccaatccgacctccccattgctcctctttccaaattagttgcgggaatggaatcccctcaatctcctcttccttttccccaagaaatccccaaaattttctatggaaattctttccaatttcgcggatcaaatccttcctttttccggcgagaaccctagactttcccgagtttttcccgtcgttgtgggcttgatcccgagctcccgtgcctatataaaggaccccctagtcgtcctctacccatcccctcaagtcccgtccgccgccgtcgccggaaacgctgtccccgcgctctccttctctctccaaacgccggcgcgctccagccgtccctagacgccgcctcatctgcctccttcctgcgccgccacctccatcggctccgcaaggtcgagctccaccccggccggcgttccccttgcgccgaaacttcgccggaagccgtcctcgccatgaaccattgggttgctgtcatgttccgatctccagccgtagctagcagccgccttagccgccgcttttggtcgccgctgccgccggtgggttcgcaagaaggagagggagcccagcagccatctccccgaagccgaaatccaccagagctccatcgtcgccgtcgcgttttgatctcgggcgaagccctgctgctcctcccgtcatcgccaagcttcgccgctgcctccattggattcgcagctgcgaagtgaagcccggccaccccttcgttgtcgccgcacatcgccggaaagtcgtcgcctccgtggacagtacctcgccgcccttcggagctcgtcgccggccatcttctgtcgctgcccgtcatcgtgtaagtgttggtaagaatcgccgtcaccttctctacctcccggtgccctccgtttgcattattgtaccgtggttcgccggcaaccgccgctcctatgtcgttcaccggtgtagtttatccctagagtcttaattccatctaatctaatcttgtttggccctagcgtcatcatcgtctccgtgtgttgtcgtcggaccgtagccgtcgcctcttcctctccgttcgctaccgtttctcggtgaggcctcctctccgattcctagggtagatgtttatgtaagccacgtgtgtgtcgtcgtcgctgtgtcgtagctgctgcacgccgtgcggctgcggtttgccgtcgctctaccgagcctcttagccaccgctgcttagtcgctaccgcgtcgcgccttgccacgttgccccgcagctgcttgccgtgccgctgctgcgcgtgtgccggctgagccgcttagctgcagctgcttgccgctttgccgcgctgttgccctagaggcctagacttagcgcagccgcagtccgtcaccgtgctgctatcatgcatcactaccgctgccgctgtttgccgctttgccacagccgcagccgtgccggttgcgtttttgctcgcagccctgctgctctagccgtgcatggtcgctaccggctgtgccgtcaccctaaccctagctgcgtgtttccgcctagccgccgcctagccgagtcaagttgtcttagtgccgccgtgtcgcagctgtgtgccgcttaaacctagccgctgcttttagtcgagttgtgtagccgtaggtgcaaccctaggttcctaccggcctatcgtttgtcgtaccagggctttaccgtgaatcgtgtctagccgaccggtttagccacagccgttgttgagtcgttcgctcgttcgttcgaacgaggtgttccccgtgcttcgttcattcgtccgtgttgagtcgtcctttagtttagagccgttcagagccgtcggttctgttcgccggttttggttgatcatttaggtgatctcatgtcacgtggagttgactcgttgagtcggtatctcgtgaggctcgcttgccagatcaatccaagccatccgatcttagtcgactcggtcaaggttaatctcagctgtccaaaatcaatataaatcctctcctcttttcagtggcatattatttctttttaatatatgtcatctaccaaatatgatctaatcttttccggaggttgctttaatcttttatctccgttataaatcatttgtaaatgatttaattaatttggaatagtctccgtttaataggtttaattggaattaaatcttgtaaaattcataataaattcatatgaaatcagaatgaggccgttcaagtctcataattcatctaaaattatgatctacatgtttgtttactttttatgtattgtttatttggtttttattagtcttttccttgttttgcgtgttagcttgtcgtttccgtcgttgcgaaggttcgcgagtgcgccggaagtattcaagaagattaattgaagaccgattattgcaaggcaagtcacacaaatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatataattgcttagccatgcttagaaacattagcacactattgggataacttatgactcactgttatttaatgatggcttaatggtagctcacgatggttaatcgtgttatgataattaattggtaattaaaatatgattaatggtgggttgtgagcacatggttttgaaggtcgtgctcatggcaattaaggaccggttcgcgagctacagttgtgaaacattaaccgtgccaaccacaagccagcgtgagcaacggctttaccttttgtataacatgattcattacggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaatgattaatgatgttataactggtaataatttgcttagctcctggtttggaatggataattcctggtttggagattagatctgtacagtcgggtatggttgttcaggatggtcgggcctgtgcagcatgggtgtgctgttcggtgttgattaaaatttctgattaactactctactgttttatttctcttaaatgttttgctaaacgctgcttttgcaaatgagcctatattatgccatcctttggtatccttgtgcacttgcatatttgctgtgtggcttgttgagtatgtcatatactcattcttgcaataatcaatcaacctcagttgaagaaaaaggatccagaaggagaagacgtttggcttataccccagttgagctgcctgtgggagtggagctgaagccatcgctagaccgtttttccgctgctgttttcttttcttttgtaagtgtgtaacgttattattatgatgaatctgtatattaaattgtcagtttgtgtacctcggctgattcctggacgaggattttatgcacaaataagtttggaaattacttgtgaatttccgggcgtgacatcaaatatgaaccttttagccacactagggtttcccttaccgccggtaactgcgtggttaccacggtgcttaccgcgggggtacggtaagggttaccggcggtaaggtttgggtgaaatttgagcaaattcaaaaattccaaaaaaaaacgaaaaaagcaaaaaaaaaatcatggatacagttcttggtttttaatgctagatggtgatttttttaaaaaaacaaagagtaagataaaatcaaatttgagggcaaaaccgataattgtttaggaaatggaaaaacaaaaaaaatgtattgggcttcattttttattttacatccacaagttaggtttgcaagtatcatatatattattctaattatccctactttctacacgcatttaagtgttttttttattttttagtatttttcattttttttcatgttttctgcaatatcgcggttaccgcgtcaaaccgcgaccaaaccgcgaaaccgccaattttttaattcaattttttcgagatgaaattcacacggtttttagcggttaccgttggggggtaacctccccaaaaacggtaaggtaaacctgggcgtggccaaatcactttgtcatgtcacacacagtcggcgtggcagtggcaagaggctggcgtggcaaaacaacgctaccacactagctacttggctggcgtggccaaaaatttcagttttcggaaatatttttcggaaatgtctattaataaaattttaaaataaaaaaatccgaatatttgctatgttgtcgctaatgaccccatttggacatggttaataactatgttatttacgcatgtggcaatttaattaacaaaataataactatgtctatctatcttaaattgtgtttctaaatgtcactgtagtgttaacacagacagattactagtattcaatgaaattgacacaccctgtatcggttctatctatctaccctatagttcaacaaatactttcactcattctttcattcatcactctagggttcagattattcgtatgagatccaacgctcctgatcttctcctcctcccacctctgtattcgccgctcttccaaccccatcagcgcccagatcgctccccctcccgttgccccctctccccctcctctttctcgtacccacccgaaaatcacgccgcgagatccccagcgccaaacccatcgtccaccatggcgactcctcgaaccctctagcgtcgccactcagtgccacagtttgaaggtgtttttttttgtgtgattatgatggctcatgctctgttgcaacggttgctatgagtattggacgaactgattagatctcgaggagaggatcatggccttggttgcctcatcgttatgcaggtggatcaagtgtattatttgattattcaaggccgcatgctcgccgtcgaccccaacacccctggtgacgatcctcgtcagatcaaggccaaaagctgccccccatcctctgttccacccctgcaggtacaacgaatttcctctcttccttttcatgttctctttagcgtgtcatgatagtgtatgtagagtttattcttatactccctccgttttaatatatatgacgtttccgacagcatcgagaaaattaaggatagagcgattttactattttgcccttcatcccttttcatcgcagtgttcgcgcacgccggctccctccactccggctcccttgccatctcccccgcgctgcctcgacgccggctcgctcgtcgtctcccaaacgccgctgctcgcgaccacaggagaaggaacccgctgcacaacgctcttcccggacgccgcgtcgccctttcttctcagaccttcccggtgaaagcggcgttggagcctgagatcaagcggtccttctcgattcagtcctcctcctttctcgtctccaagcagcatgtcctccctggacctcggctcctcactcgtcaccctctctgtaagtgagctcctcgatctcgccttctccaacttccagcttgttttttttttctcatttcctccaattttaattgcctcattgcctggttttgcccaatttacaatttaatcagaaggagaggagaagccctggttctggttgatctccagccgaacggcaagaacgacgatgtcatctgcagatgcagtacgttctgcttggtttcagccgagcggcaagaacaacagtggcggcagcagcaagcccgacgtccggctccctgtgcgccatgctgcctgactcttgctcgccccacaggccacagctcggggtgggttgccgccaaattggggtgcggcggcggcgcacgggaggcatgaacggcagcggcgcgtgggaggaggagacagtggcgagcgagtccggtcgcgatgaggacgaggcagcgccgtggcgatgttgagatgaagggcaacgatagaaattaacaaacgtgactaggacgaatgaactggtagcgtcaaacaaaaaaaacgattctgatttgcactgtagcgtcaaataaaaagaaacagagggagtacaatacaaagatcaaaacagacttggtggtggtgattgtattgaccatcaagcaggtaatttttcttgtgatgttcatgtttactattatgtccaaactccatagacaacttacacatttagaattacatcttgtatagacaaataagtgtatgtattaaaaatgtctgaagaaaatggactgtatgatcatagtgcctttcaaccgttgttttgtgcaatgtccatgatatctcctcgagattaatcgatttctacttttgtaccatatgcaatgtttaatttttaactgctcaggctcatgctatttcatattttggtgcttctgaagcgatctatatttcttgattctttgctatcgtcctgacagtgcaccataattgtcagaaatctcctaacctgaagctaatatatttcttgttttaacttcactgattcttcatatgtttcctttactgaatagagttttgttgaaagctactccctccgttccaaaataagtacagccatgggtatccgtatctacgtttgaccgttcgtcttatttgaaaattttatgaaaagattaaaaaaatagtcacgcataaagtaatattcatgttttatcatctaataacaataaaaatactaatcattaaaaattttcaaataagacggacggttaaacgttggacacgaatacatatagctgcacttattttgggacggatgtagtatgttctatggggtcaattggtcaaatcaatgcattttgctgggaaggtcgaaatcagcccatgtctacctgccacaatgagaaggcagccggtcagccgcctacacaacagactcttatattgccaccatcataagtttatttgttagtatgtactacgtaagaactaacacgtttatccgttaaaaaaaataaccaacaagtttgctttagtgatgttcagtgcagtgcaaaaatgccgcaagtcattgtgtaagttgtataatgcagtgaccaaattaagaagttttctagccttctgcattcctgcagttttctagccttctgcttgattccttcaacaaaaaataaacggatacacacattactaatctattgcaatctgtatttatttttcaataattctgttccgtacaagatacagcaagtttgagaagttcgagaggtacatgggatttcctccgcctttgaaaaacgtctaataggttcgagaggcgcttgacatttcctccctcttcaacaatgtcacacagcttgattggatgctctttctcattatggacagctgcttggtggagttttttacctaagaaaacatatgtttaccctgtagcaggcttgtgtataggagaaaaaggtggaattcttaaaggtaatcgtggggagttttagttcttttttgaagatttctctaactggtactccctccgttttataatgtaagactttctagtattgtccacatacatatagatatatatatgtctagattcattaacatataaatgaatgtgagcaatgttagaaagtcttatattatgaaacggaggaagtacatactaaccgtttggagttttggtctctcgttactcactgtaaaaaacataatggtaaaaaacaatttactcctaatggttctctctttatcccattgaacatttttatcgttgtctcattgattgctatcaaaatggaaaaacactggatgagatgtaggagagccgcattgatggcacattttgaaccagtggctcaggatccctgattctcttgatcgtattactctataaggtgaggaggatgaagcaggtgagttactctataagacaattatttttctttacaaaaccattatttttgtgtggatgtatattgtctcatatattggtattgaagtgatttgatatacttattgacggtattgaattaatatttttaggtaatataattattatacttcgtcataatatgtgaacctacatcaaattaaggttcaatcggacggattctaggaaatttatttttactagcatgtaattcgttaaaaaaagtattatgataccgtagcgttagcacgggcaaattactagtggaaaaaaaaatgcaccaagcggttggccagggatagcaatttgggttgccaacatgccatcttcttgcaatatttatccataagaagtcgcaacattgctctggtaggcttgtccaagccacatatatgtcatcacaagtaatgctatatctttttttttttttgcaaactactttttcctaatgtgttgagtcgttgatacaagagggagtgtgataaaagaaaacggataaaccaagacagtgcatctgcacgcacgcacttagaattagcacttagaatttttattatttctaattgtatttctatgtggactctaaactcatctttcaatattctttaatttttaatttcgaatttcagttacttttaaattgtattcctatatatgtattcctatattgacattaaactcttattcccatgtttttcttaattttgaattttagttatttgtaaattgtatttttatacggactctaaactctacttttaattttattatgtttattccaaattttagttagttttaaatttctatatggactctataatctacttctaataatccttattttttaattccgaatttctatttttttttcttaattgtatttctatatggactttatactctatttctaatattccttatttttaactccaaatttctttcatttcctaattgtatttctatatgaactatatactcctcttctaatattccttatttttaattccgaatttcagctatttcctaattgtatttctatatagactctagtctcctcttctaatattccttatattttaattccgaatttcagttatttcctaattgtatttctatatggactctagtctcctcttctaatattccttatattttaattccgaattttagttatttcctaattgtatttctatatggactcgtttattccaaattttagttagttttaaatttctatatggactctatactctacttctaataatccttattttttaattccgaatttctatttttttttcttaattgtatttctatatggactctatactctatttctaatattccttatttttaactccaaatttctttcatttcctaattgtatttctatatgaactatatactctacttctaatattccttatttttaattccgaatttcagttatttcctaattgtatttctatatggactctagtctcctcttctaatattccttatattttaattccgaatttcagttatttcctaattgtatttctatatggactctagtctcctcttctaatatcccttattttttaattccgaatttcactatttttaaattgtatttctatatggactttgctttttctttttcttctttttctccgattaatatgagaatttctaggccatgagagcgaacgtggaggctcttttttctattcctttaattatataatagatatttggaggaactaatctcgtttttgttaagacgtgacgatggttttgggtccataatagcgttcgcttcgagaagcaagtaagcaactaactctcgcgacccatattcctcataatcataaatcattttatgcctcgtctccaaccgactcgccaattcgaatcttcttctagaagccgagaggcggtttcaaacaaattcctcgagctcgagctctcgagcaccccaaccaaaaatggcgcccggccggttcgtcaccagcagcatggaggccttctccaagctggtgatgatgccgatcgcgcgccacagcccgcttcgccgccacgccatgagcgccgccagcgaaatcctcaccgtcaggcgaaggatttctgaccgctccgactccgagctggtgtgcgggcaccctccatgccgccaccgcagcaacgccccgagcgccgccgggctgcctccacctcgctgctgctgtgattccacggaggaattcgcggcggggagaggattcattcggcctcgcctcgggctcggcaacctcctcgtcgacgttcgcctcgggctcggcaacctcctcatcgacgtcgagagagaagggagcgatcgccgcgccgacacggggccgtctccacctcgccgctgcgatttcacggaattcgtagcggggagtcgcttcatgcgtcgtcgcatcgggttcggcgatcgccgcgccgacgcggggccgcctccacctcgccgctgcgattccacggcattcgtagcggggagtcgcttcatgcgtcgtcgcatcgggctcggcgatcgccacgtcgacgcggggccgactccacctcgctgctgcgattccacagaattcatcaccgggggacgcttcatccggcgtcgcgtcgggctcggcgacctcgtcgtcgagagcgccgccgtggggccgtgtccacttggctgccgcgattccacggaattggtggcggcgcggatacgctacattcggcgtcacctgggcaacctgttccttgaggcggttgggaggatgaagccgcctgacgagatcatcttcagtatttgcctggatcatcgcctcctctcctcgagtctccctcctcgccgcctccacggcatcctctcccagggctccgcgccgccgccggatctccgcggcgtcgctggtcagtaccaactcgcggcgctgaaacgcatgaagcgaatcttgtggagggcaacgccgatggcatcagaattcagagcctcagccaaatcacaccgtgtcgtagaaatccatggcgagccacccgaacaagagaggattggactgcgtgtgttgctgcggaggcaatcatcatcgccgccacgacgacaccaaccactgagagcaagcgctagccatctgcaggtcctgaggaggtggtgttcaaattcacatgtccccaatgtgccaccatcgtcgtcgtcgccgccgccgccgccgtcgccgcctcagccaactaatcctgctgatttttggtaagcttcattacccaatctattaattcaagaatggaactgaaatgcaattgaacgttgtatttgtagtcagatttgttatttttacttcaacttgtctaggatgaattcaattttgcatgttagtgcatcacacaattatctgtgctgtcattttcttttcagaatttttcattaccatttcaatcacatgcaaagaataagtgaattttccccatgttctaattccttttgaactctgtacttctgtttattaggaaaattaacactcctctgaatcctagtgctactaaaactgagaagagtacaattgatgaaacacttcttcagctgaaattcgatccaaaagagtttgctagatgcaataagttgatggagacatacaatgtgttaggtcaagaatggacattcactaagctgaaggaacagaccaaatatctctttgattcattgattgtgctggttgagtcgtttcacgaggcaggctattgtttctctcagatatccacaagcaccgttctggtaacatcatcttggaaatttgttctgctagaggggtgttttgctcttaataactggagtgttgaaggggttagaaaggactacagagatattgctgttttgttcaggaagctcctatccgagtccatgggtgaagagacagttcatccccctgattttgggatgctactcagcttgatggaaaaggatggctttcggtacaagtacttgattggtactcacgtatcattgttacctgatgataacattaacattgcttatatgaagattcatgagttcattcggaaaattttgctggctgaagagaaggataaagccaggcaactgaaactcggtataacacgttacagtacaattagcacaagaataagaagacgcattccttacaagaatatctggttgaccaaggctcgaagcaattcattcatgacagcattcttggagcaaaacgaaagaaatatggagttaggagggacatattttgaactgcttgacactattagacatttcgtatgtcacaggctggacttgctgaagctcggtttcagatataaggcaaacgaggtagaccgcatgtggtatgcagagtttcctacacttttagctgagttgcagttagctctgttcctggttggtcgacttgaagaactggaattggagaagaactttatgaacagaaaaccaatgcgacccaaagtgtcaagccatggtactttctaactttctattcatttcacttcctcctcacccccccccaacgccttcttttttttttgtacaatatgcttgcctgcagttgattaataagttcaatgaaatacccagtgaataaattcaatgaaatagtaggggacttgaattaatgcagcttggtgtgcattgggacattttgctgcacatgctaacaccctacaataactctggcagaatcttactcggagcagcactgacaaggatgaggtcacaaaggcgtgcctctggaaggatgattcatgagttgagatgcagagaaaaacaaaaactaacctggtaattttggatgcttgttcctggatatgttagtgaagttgatagctcaagccctttgagttccaggtcttagtacgttctactgtatgttccctgttcaggatgaaatgtatgttgcactttatttgccctgagttgcagtcctgttaacatgaggatgccaaatggcatgatgttgataataacttggatgctgagtgatcctccaagtacaagaaacttcttggttcggcactagttcaaagggtggtggtagttcatatctttgcaaatccttgttgctgttgtcaggattggttttgtttagctttctgaattttcaatcattgacaatctttagctattatttgcaagaaatgccatgttaccatgtccctctttgcaatttcatctgtgcagcagtctcttccacttctttataaattttgatatagttttcactaacaaatatagtttttgctgtattacttggctacgttcaataggatgggttgggcacggaaaacggatcagttcattaatgtgtgatcaattaagtattagctaatttttttttctaaaaatagattaatttgatttttttaaaacaactttcgtatagaaactttttacaaaaaatacaccgtttagtagtttgaaaagcgtacgcgcggaaaacaagagagaggttggaaaccttcatgttcgaacgcagccttaagtaggctgtagttccgaaattttactgttttgacctgtcaagcataattaattatatgcattgctatttgacacttcgttttgaggaggactgactaaacgttgctattatatcagtattatacatctcagtattaacaaggtgtttttattcttgtctgaaacaa

SEQ ID NO: 30162 - DNA, 20325 bp, Oryza sativa
  unsure (1)..(20325): unsure at all n locations
attcgttggctcgttgccccgtcgccagaaattcgtgactcgcccaaatgcccaatcccgcgaagacatctcagtatgtaatgtgcttttgccctcttttacgatgtactaaacgggtggaaatgccttttgggctttggctcagcgatggctcggcacggtggccaggcagcgcgaggaatggcccggcggcggcggaaatcgacagggcgacgatgacgaccactatccggactccgggctgccaagagaaggagtgtaacggctcaaagaccatctaaggatgctacacgagtgaggaattgcgccgaagctcacccgggatcaaggaatcgacgaccacggccagcggccggagttgaagaagaagggctcgatctcctcgatggcgacgcctcagctcgattccttcgatgggcttgctactgggatcttggcaattctcgtggcgcgaagcctcggcctgagatccaccggattgacgggaacggcgacgctatccacggcggcgctccaggcttgctccagaacagcaatagcaaggtccgtgttccggaacatcgactgcatgaaatcgactgaacttaaggggaatggaaccagcactgagaggagacaagggaacgaacaagagatcgagacaaccgcggctcaatcggcgatggcgacggtcgtcatccttgcggccggcggcaagaacttgagcggcggagaggcagaggctctccctctcgagctgctcggttttgggagggagtaggaatgaggcgatgcagnttggagaaggagaaagcgaagctcagcgtgtgacacgtcgaggccacgcgtcgagcgcgtccgagagagatcggcgccggttttccttttctccctcgtgttgagcggtgagaaaatggaaatggacagaggctgggttagctggggaggctgccaagtgggtccagagcggtgtacactaggtaggcaagaggggtataggtttgagtttgagtgaacaatgaatttagatgattttcaggattatttcttttcccatctttgttaattcatatattaatttgtggtgcagatgagttcacgtgaattttattggaggtagatgaatatacctagtttttattttctttggttacactcaaaaattataaatagattgctcatagaaattaggagatgacgagcttattggaagctagtttgaatttttatgagacctgaaatgagaagtaaaattctagaaaaattatatttagccatgataaataatctagtatttaaataatttatctctcatgtataattctatgcagttcaatacatattttggttaggtatggtaaaaactacagttaatctattttttgattagtttgattgatttatttgagatatcaaatgtagatattaaattataccaaagttacagtgaattaaatgtggtgatcatagcctacattaattttttcatgattttatcttgcacaaattattttagataattagtaagacttatctttatatatgtttcccatttctaaatgcatgtaaatgtttataaaatttatatctggactcctcttaacctgaaggggtaatattagacttctttttcatgtcttcaatattattactcatgaacgcttttaggttttgcttagtgaacttatcttttaatcatgctcatgagacctaatatgaaatgcaaacaaagatccaaatgcactagaaagactcaagttaaaccattcatatgtgagtatgcatgtctacacttgtgtttgcatttatgtcctaggttagagatgaaaaggttttaatttaccctcaaattttattcatgcaagagttagatcaacttcacctaggtttagaatggaaatttttggttcacaaaattgaagaactttttgatggaaattcctcgctcctagaattcgggtatgttacatgatcgtagagtcaccaaccaccccaacccagcaagcgttaagtcaagatgggttttgatagattaaatcggctagcggagccgatttagatagaacgatagataactacccgtctcgtaggcaaaacggaatttttcgctgcggcagtggacgatatacagcgcaaatcgacaaagatggacaaaccaaactagaactaattcaaagtacaaagcaatattgaaaaaaaacgattattttgattgattgtatgatcttttacaattgaaccagccttgtcccttatataggggttggtcttgtcctctacaggtcctcctccacgtccaacttggatagaaaccaaaggaaacccaaaacataccttcccgagtaaggaaaactcgagacccgataaaacagacttgggctcgaactctgtcggtcagatcggtcacaagccggtggtctgaccggagttcaggccgcggtctgaccagcctatacaaggcgaccggtctcctagaggaaaacacctatttgaaacttgggtgtaaacaagtgagtataaacattaatgaagaaccagttttatatttaagactgaggggtttgagacaggatgaccctccgtcaacttggtagggatgttttgtctaggattttgagctctgcaacagagaggggattttaagctctgcaacggagagggattttagagctctgcaacagagagcgggttttagaaggactggttctaaatattgtgaatgagggtttatcacacttacactaatttgctaaaaaataaagatgtgatgacactaaagttttttctctaatgttttgagtaaatgtcaagaatgaaaatccattatcagaaaagtgagttactgtgatgaggtgagtaaagagagagaaccaaattgcatatatgctaacttgtaaagtgtgggacttcccaataattttatttggggctaccataaagtggagagaagattggtaagaaagaactcatgattgtgggggtgaaaaatgtgaagatattaaactcttggaaaaccgactacttatcttatggggaagagaaatgctaataaattcatatttgtcaagcataggtctatgtatgcagtgggcttttataggctacctgagagcattcacaacaaaatggactctgtgaggggaagattttattggaaggaagtggataaagagaaaaaatatcacatggttaagtaggaggctttatgtagactaaaagtattggggacttaggtttttttgacacaagagttatgaatatatgtttattaagttaatggattattaaactggaaattgatagtaatgatttttgtttggaagttcataaacattaatggagaaccaggtccatattttaagaccgaggggtttgagacaaggtgaccctccgtcaacttgctacatgatgttttctctagaattttgaactgtgtaacaagagatggtggttgtagaggattttgagctttgcaagtaacaagagagatggtggtggtagaggattttgagctttgcaaccgagggggttttagagctatgcaacagagagcgggttttagaagtactggttccaaatcttgtgaatgaggagtttatcacacttacaatacatataattttgtttgctaaagataaagatgtgatgacactaaagttttttatcttctgttctgagtaaatgtcaggaatgaaaatcaattatcagaaaagtgagttatagagatgaggtgagtaaagagagagaaccaaattgcagatatgctaaattgtaaagtggtggacttctttataatttaataatttatttgggactaccgtcgagtggagaaaaattggtaagaaagaactcatgattgtgggggtgaaaactgagaagatactagattcttggaaaaccgactacttatcttatagggaagagaagtgctaataaattcatatttgtcaaacatatgcaatgggcttttataggctacctgagagcattcacaacaaaatggactctgtgagcggaagattttattggcaagggagggggtaaacaagaaaaaaatatcacatggttaagtgggaggctttgtgtagaccaaaagatattggagggttggtttgtttgacacaagaattataaatatatgtttattaagtaaatgaattactaaactggaaattgacaataatgatctttgtttggatgttattaaacattaatggaaaaacaggtccatatttcaagactgattggtttgagacagggtgaccatccgtcaacttgctaggggatgtttttttttttgggattttgagctctgcaacagagatggggttttagaggattttgagctctgcaacaaagggggttgagatggggttttaaaggattttgagctctgcaacagaggaggttttagagctatgtaacagagaacgggttttagaaggactagttccaaatcttgtgaatgaggttttatcacacttacaatctgcatgcatatgatacaattttgtttgctacagataaaaatgtgatgacactaaagttttttctcttctgttttgagtaaatgtcagtaatgaaaatcaattatcagaaaagtgagttatattgatggagtgagtagagagagagccaaattatagatatgctaaattgtaaattgtaaagtgggggacttcccaataatttatttaggattaccatttagtggagagaagattggtaagaaagaactcatgattgtgggggtgaaaaccgaggagagattagactcttgaaaagccaactacttatcttgtgggggaagagaagtgctaataaattcatgtttgtcaagcataactatgtgtgcaatgggcttttataggttacctgagagcactcacaacaagatggactctgtgagggagagattttatttgcaaggaggggataaactaaaaaaaatattaagtgggggctctatgaggaggagattttattggcaggcgaggtggtaaagaaaaaaatatcacatggttaagtgggaggctttgtgtagaccaacagatattggaggtttaggtttcttggacacaagagttatgaatatatgtttattaagtaaatggattactaactagaaagtgacaataatgatatttgtttggaagttcttggaaaaaaatacatgcagcaaaaggggttctttcagagttatgaggtagggggtcataattttaaaagagtttgcatgagatcaacttttgggtgaataagtttcaggaaaagaaagtcaacaatagtgaaagtacttatttttgggagatgtttggtgtgatcatgttcccttaaagaatctttttccttacctatataatgtaaaggaacaacaaagggctacagagaggtgaaagatgatgggggctggaaactctcttttagaagaaacttacaggggataatttgagagatccaaaagaactaatgataaaggtggagggggtttgtttgactgacaagagagatgagttgatttggcctctagaaaagaggaagaactttacagccaaatcactttatagagaaatattttttttttggggggtggggggtgatagatactacaatggtcaccttgtggaaaggaaaacccttgaagttaaacattttctcttccccatagccgcattcctccactgccgccgaaccatggcactctctcgttgccaccctcgtcctctcgactctcatcgccggcgtccatagttgcccatctccaccatccaagctagccaatgagttccccgtccttcactcgttcttcaaccgtttctcctacctgccaccattcatcggctcactgtcgtgcgtcgccggccatcgatctccccggtggttcaactcccgtcggtccaagatggcgtggctgccacgtcggccgaggtgaccaccactatgccacccacacgctggtctccctcggaccaggctgcggcccgcggccgcgcaccactttcgcccgcgccggtctcgcacctgggccaggccacgatgctaccaggcccaaagtgggcatcgatctcccttctctctcgtactatctaggcccaatcaaatgaagcccatttacctacctcaccaggcctcctactctcttggactgaacccaccaaccctcaaaccgaaaacagaaggtctaactttcctttagcccaaggaatattctgaatattcagttccaatttcaattcattatttcctattattccataaatcattttaaattccaaagatcatatctccatatctgtaactccgattgacccgttcaactttccaaatctttctaaaattgagataaacccaatggaactattatttattaataataatattttatttttagggttttcttgattttctctcttcgaagagttgaagatgaagagctgagataagtcaccctttgatcatattactcctagtttttaaaattttttgtttgcgaaattgcatgcaatgtgcacattaatttaacatgcctcggttcatgtaactaatcgacagatctacctagtagttgcatgaatccaataggtagttgatgacaccaatcccacgtcactccaccttgtggtatctcggtcctactcgtataacttgtttgtcaaagtgggaaaatgggttacaaaacctttttaaaacccgacaggtagtgttgtgtttgtgaaatgaaagtggttagtgaaaactcgtgatgcaaatggataccttctgtttttgcatataaggacgatttcctttgggaattgcattataataatatgtaggtcccccacgtctggctcgtcttggtctcgctcactttggaattttctacccttgagagatcgaggaaaaaaacagcagaaaggatgtctcaggctaaataaaggatgagtacgaccacaccggttgtactggttacccttggctaagtaattagctaaccaaagatgccttgtacgtcaatagttggggattgttgagatgatgtcacgtcctgataaattcatcccgaaataaaaataattctctaaaaggaataatagaattaattaaaattcgaaaagaaattggcaaacactaaaatacatacaagaaaaattcgaatgtggcctggagaatttttgttaaattctccttggtctaaaaggagtcctcaaattttactcgaattttcagagcatcggaaataattattaagcaacaacaaccattaacaaagtttattaaaaagaaaaactaaaaataatcctccttcctcctttgggcccagttcggcccaatgcccccacctctccctcgccctgcggccaaagtccctctctcctccctctcttttcctcacctctctctctcttgggccgcccctccctcctccctccctcctctccttcccggcccactccctgctctcctcctcctgggccgcctcggtttcgcccggcccaagccgagccgcgcctcccacccgtgccgcgcacgtgtgcgccgttgccacgcgttgaccgcgcctcccgcgtgggacccgcctgccaggcgcgtcgtcctcctcccgcgcggcctcctctctctctcccgtgcaaccctagcttcttcctccctcaaatccgctcgattcaaatgactaattccaaaattgattagggggattaaaccccattgattcctctctctttccccctaatttcccccttgaatagcgccattaatcgcccggaacggccgcgacaatcccggtcaccttccgtggccgccggccgccattcccgccgccgttccccgctcctcccgtggccagatccctcccctcacctataaaatggaatccccttcctccgttctctcgttttagcctcctcccgcgtctccccgtggccgcaccacctctccccgtcgccctcgtctctatcctgtgccgccggccacctccagccgcctctgccgcctcgcctgtgtgccggccagccgtgccgtcgccatcctcggcctcgcaggtgcatcctcttccccggcgtcgccttcgtttcacggggaaaccaccggaggcgcgttcctgccgtagtccaatggcgttgccgccactgtgccgcctccagctgccccggtcgtcgcgcctaagcgccggccgacgctgccgtctcctcccttggcatggtgacgtcgccctccaccccggcctgccctcggattcgtccagagaccgccgccgccgcaccagcctctccttcctcctcgtcaacgtctcctccggcagccccttccgccgtgcccgtgcaccggccgacatcgtcgtctcctcccttggcatcgcagcggcaaggtcgccctcggtctcgcctcccctcctcccgaaccccgccggtgtcaccgtcgtcgtcttcatcgttcgttctcgtcgatgtactcttccggtcggccgttcatcctcgccggctcgtcgtcccgcggcgccacctccgtcgtcggcattgtagcggcgtgttccacgccgtcctcacctctatgcaactgctgtcggctgccatcgtcgcctccttactggccctggtcgtcgtcgtcctctcgtcgttcccgatcgtcgtggcgttcgtccctccgtcaagccgtttgcgtttgccgcccgcgtttcgtcaagtgtgctgtagcctcctcgtcgtcttcgtcctcggctccgcgtcgtcaagccctgcgccggccgcgtctcgccttcgtccaagaatcgccgccgaagtcgtcccctcgctgttcgcctccgtcgtccccgagccatctccgccgcgcccgttcgtcgtcgtcattccacgccttgtcgcgtgatggtaagggtccctcctcgtcctttcggtatcgccctgtgcccattgtgcggttgtcgaccccggtacccgtgtaccggtgtcggtagtcgttcgtgtgtgcgtgtggtgtccgtgttaatgtgcccgctcggtagccgcatggtttctacgtgtgtagcccgcgtggtgtctagtggagtccgtttgcggccactcgcctcggttgacacacggggtccgctttcgtcgacccgtggaccgtctctatgtactcggtccaccgtggtcccttaggttgacatgtggggtccgcctgtcaacagcgcagccttcccgtcttttccagggtagcgcttacacatgctttatagttgcaaagcttaattataataatccgcaaatctccatataacagcattaaacttcgatgaccatgccttggtcatacgaactccgaattgacccgttcaagtctcttaatgtttgttataacctaacgaaccatgtgctttctttttatgtattgttattgcttttttatagggttgtagctttgcttgtgtatttcgcgtagcttctgtcgtttcggaggtttccgaagcatggttcgcggtcatcgccgaaggttcggaaggccgttctctctgagcaaggcaagtcgcatcacccttgagcatattgaatcctagtttataaaactattttgatttaaattattgcattatcgctttatttaaattcccacgttatcactgttttatttagcaatacctattaatccttgttatagccttatcattgatattgtttattatcaccttgcttaccctaggaaaacaaattcccagctagtgggtgctctattaatagttccactagtatgaatttaggtagatgcttcgctgattaattaggcaacactagatggtttataactttagactttggaagttctcatatcaattggacattatggaatggtttgcgtgtgatggaattaaacacacaccttccccctctattcaaaactcccaaaatggttttaggctaggctcgaggtgcgtggttttgctaggagcacctcggccaccataaggaccggtcttcgggcctctgttgcaaagcactaccgtactaaccacatatctaatgggtaaggcttaactcggtgctcaatctaatcctaaacagaaggaaacggatggagatggacgaaatcggggcccgatggacatctctagggcaaatgaaggttacacaagctgcggctcggtagtcgagatgttatggcatagggccggtgttctgctgctaggggctcaatcctgcctacctgtcccaggattccggacgtaggcgaggttgggtcggtacttttgttcacggctaggatgggtgaatggttatgtcacatgtttacgacgggttccaaggctttggaatgcggagtaaagatgtgtcttgtgggtaaagatgtacacctctgttcatagtataatctatttgaatagccgcgcccttgtttagggcaagcctagcaatgtacccaagttagtggtttaatttttaaaacttgcttaacaactaaaatgtggaatgattggcctgggttggcttgggacgagctgggacccaggtcgggttgccagttcggtctgaatcatcgtaggccttgggttaaggcaggttcgtgtgggttcacggccttgattaataacattgtgtagctctaggatcatgtttacaaaatagctttgggcaactaagtgacttttaaatgctgtttactgtaaaacctaacccctattattaccccttgtacccccttgcattaatcatgcatctcccggtgtggcttgctgagtactatggttgtactcattcttgctctatctttcccccgtctgtaagagaggctttggagaagaagttttaggtggagtcctggcttataccccagttgagcgcctgtgaagatggagtcgtaggcccgctagtccactgctgtttatttttgtttgttaggccttaagtgcctttgtaataatgtaaatattatcgatataataaagatgtgtcttttgtatcatgtttgtgtggtgtaccccggcttttcctgggacgaggattaatacactagcgtttgggaaaaggcaatttttccgggcgcaacaaatgaggagatgtgagatagtttattgcgttgggcacacattgaacattaacatgctaggcacgaatggttgaagacattccgaattcatgggtagacgagggctgaggcttgcctgatgctcggttcagagagaacccttctatgtggcatgaggtatcttcggttggctttggaaatgtcttgtcgtgaaccttgcttcaccgattgtatctaatcaatacgcgttgggcgattggagtaagctcacgtcgtgtgggtaaagtgtacccatttgcagaggttatgaaactgttcgaacaaccgtgcccatggtcaagggcggatgcgaagtgattcctcttgtgtagatttgtttgcatgtgatttgcaaaaataatttgtgggaatgaaaaccgttactaaattcagctaggtgggttgatgggtgaccgttacgtggtctaaaacaatattgtgtagatcaagatgtctaatggcatcatagattacgtttctcgagtggaagttgtgtgtatggctcttggagccaaagaaatgtgttatgagatgcgttgatgcccgatggtttgaaagtgaaaagaaactaatatttgggaaatgagttggaagttgcttgatggcagaagatcatgcaccggtttcatggtagggcaactggtagaatagttttaatcaactaaaaagttcctttgcccgcttgagttgttgcaagcaatttgcagataggattgaggcaaaagcttctttccgacacttagtgttttgaaaaatgtattctaaaagtttacaaaacaatcctagccctcctttgcatcctgcaaccccacatttccgtgacttgctaagtacgtatgtactcaatcgttgtttttcctctacaggaagagtgaagtgaagttgaagaatagagtttccttattagtcccaggccattgcatgtggattgggtctagctatgttaggtttcgttgttgcttttctgcttgccggttacactccaggagttaccccgaaggtgtgacctcttaaaggtacaatctatctatagtatgtttaattgctatgatgaatctctgttggttgcaggtacaagcaattgtatctttggactggtaccagcagcgaggttttgtgggattcggttcatgtggattttctgcgtcgtaccctctctggtgtcactattatgtgatgccaaggcagggtgtgacattcttccaagagttgttgctccaattgccattgatgcggccattgcaatcatcctccttcctcatcggcaactcggccgatgacacctccacgttgctgcttcgtacgatggcgctcatggtggtagcgtcgtcaacacgccattactgtgctctcctgcccgtgggcctcctcggacctccggggaggctggcgtcgagaagcgttgagcggttgacgacggcggactcgatttggaatcccggatctcctccatgacacgcttgtgggaagagaggaaagagagattgagaggggtgaggaggaagatgaaatgaagagaaagtcgttgacacatgggtcccaccaattgactcggcgagtcatagtcaatctgccatgtcagcggaagtcgaagaaattggtttgcaacgaatttcaaatatagaggcgacttacaaagggccacggagggacaattaggacaaaacatcctgaatttttgaagtagctaaatatttagtttcttccgaatatccgttgcaatgcacggaagctttttcaggtactaatatatgtctaagacaaactaaaaataaggttgcttagacggatggaataaactataaagttatatatatacatgtatttagcgtgtgaagcataatattgttatagctcgttgtttcttcttacttaaattttacacattttcgttgatagttccgtttcccattttcggctcttttcggtccgtttttcacgattgttgtttttctttaaaatcaatcaaagaggattactacgagtcgcctactactactacactagtagtaacattgtttatgttttcttctcccatatccaagatggcaatggcaagtccaaagcggcagtgggacacgatgataattttgtgtaatcactccccctccgattaattaacccctcccagatctaatctcctcccgcacatcctaacccaggacataatattccactcccccccccccccccgggccgcgattaaacaaggtggctacagacgttgaccagagaagcgagatttgggaagctgcggctcgacattggtcgcgccatgcagatggagatggagatggagcggtagctgccatcgattcgggtcgcatattcgcatcgtcttcttctttgtttggttggtctgcgtggtggatcggtcttggtggttgaggtggaggccgacatggagcgcgttgttggcgacttcaacctcctcctccaacgcggcggcgccgccggtgaacgtccgtgtaggcgccacgccgatgcgcttgatttgagcttcttgatctgcaagaacgcgtcgagatggtccatgagatgaaggtgtttgtttgtatgcgtgcgtgcgcaggtgggagcgaggaagggggagggggatcgccggggacggaggaggcggcggccgtcgcggtgaagcagcggatcgcgcgggcgctgcggctgtacaaggaggcggcgggcgacggcggcggcgggtggatggtccaggtgtgggcgccggcgagggacggcgcccggcgcgtgctcgccacgcgggggcagccgttcgtcctggcgtcgcagtgccaccgcctgttccagtacaggaccgtctccctcacgcgcgtcttccccgtcggcggcgccgccgccgccgacgagcaggggcttcctgccagggcgttcgacgcgacggcgccggagtggacgcccaacgtgcagtgctacggcagcggcgagtacgcccgcattagctacgcgctcatctacgacatccagggcagcctcgccctccccatccttgaccccgacgacgcgagctcccccctcgccgtgctcgagctcgtcaccaccgccccgctgctccgcgtctccggcgaggtcgccaacctctgcaacgctcttcgggtaatctctctgtctcgatcaagaaatgattagcaggagtgattagattagtgaagtgattaacatttcttgtgttcatatgcaggcagtgtcactgagaggtgcagggatttgcaaccgtgcagccgaggtgagagttgagatcacatgaaatttcacgagaaattgcatgatccgttcatctactgatccagtgttactcgcttgccgtgaaccagatagtccatcgagatgcgacccgggcggccatggccgaggtatcggagctcctgatcacggtgtgcgaagctcacaagctgccattggcacagacatgggtgagatgctggagctgcggcggcggcggcgaggacacggagaaggccgcgctgacgaccgccggcgcgccgttccacctcgccgccggcgcggacgcgcggggcttccgcgacgcctgcgtcgagcaccacctgcagcgtggccaggggctcgtcggcaccgcggcgcgcgcgccgggcggcggccgcctctgcgccgacgtcgcgcggtgctccaaggacgactaccctctcgcgcactacgctggcatgtacggcctcgccggatgcctcgtgctacgcgctgagctcagcgcggcggccatggcggacgccgccgccgccaccgccggcgacgaagaggactgcgtcgtgctggagctcttcctcccgccggactgcaccggcgtcgcggagcagaaggcggcggtggacgccgtctccgccacgatcaagcaatgctccggcaacctgaaagccattgtgatcagcaacttggatgatttgttcttggatactatggcagatggtgatcaccaactaaggcatgaaatggatgatcttggagatgatcaaagatgctcggacgaggaggatctgcagctgctggagaacacaaacattggtgagcttaacattcacaatgcagatcaaatcagaaatgaggatcctacatcacaagttggcaagaacaagacgaaaagaggaaaagctgagaaatctgtcactttggaggagctgcagaaacacttctctggtagcttgaaggatgctgcaagaagcctcggtggtaagacaacatcacacttgccaacaacctgcatataatcatcatgataattgatgagttaaatgaatcagctggatattcagtggattatcttcatcaaaatcctgatgtttatgcgcaaattaacacgcaaccactgaaagttggatcaccaggtgacagttttatcctcttgttttgcagtatgcccaacaacaatgaaacgcatctgcaggcagcatggcatcccaaggtggccatttcgcaagatcagcaaggtgaaccgctccctcgacaagatgaagcgcgtcatggaatccgtgaactgctcgccgtcgccgccggtggccatgcctgctcacccagctcttcttctccctccgccgccgccgccaccgcggccatgcctgtcaagtaccgtaggagagacctcctcccatggatcatgccaggcgccgccatctcacgccaaaactgcattgcgaaaacctccgaggtgcggcaatggcgacggcgtggtcaccatcaaggccagccacagaggtgacatcatcaggttcagggtgccgtgctcagccggcgtcgcggcggtgaaggcggtggtggccaagcggctgagcctggacgccggcgccttcgacgtcaagtacctggacgacgaccacgagtgggtgcttctgtcctgcgacgccgacttccaggagtgcctcgacgtcgtcccggcattgccgtcgatgtcggtgacggcgaggtcaggctccggagcggcggctccggtggtcgtcaggctgatggtccaggaggtagctgataacatcgggagttcctgcgctagctcagattagttgtaaaaaatgtagctgaaagtgtgaaaccagtagcaggaacatcaaacagatttctcaagtttttactactgatacacatacaagaaagttcagacctgtcaaaaatcactgtaaaaaggaacatgccttagagagtgtcaatataccatgaacattgtttcatcttgaataataaccggaaagagaaaggcacaaattgcttcagatctttttgctaggatgacagctacattagcaaataagtacagaatttgatgcatgtttgatatcattatggaacttgcttttctatatgctcagtgaaaatatagacaatactgaagagcgaaaatgtgctgatgtgcagtggcactgacttacaaggctgcctcgattttcaagcggcgacgaatcagaaaatggtatactcttgcagcagcatgaaagatccaattcaattatacattctgtaggaatatttcataattggtactttggcagaatttccacagcccaaggatccttttctgagcctgatggtgtgcaacccagtgggagtgcctgtctatcaatgtagtccctggacttcagtatatcaatttagaatgtgaaagtaactgagctaaatgtacatccaaccaggaaaaaaaggccttgcatttcatggtaaagtgaaattttgcaaatcggatgcatgatagcaatcgagtacagttcaatcttgcgctaggttttatagctgcaagttacaactatggcaaactaggagccaacagatatctacattaatttacaacaagtatattgttctgcattgaaccttcgccatcaattgggtactccagtgacagcctccactctccatcaaccaagaatttgatctcatacctttattttgcatacaaacagataagtgagattgtttagttaataaataaatcatagcaaatcagatcgctctgcagaattcacaaaacacacctcccaggtctaagattcagagttgcagagaatcttgcttggtaacctgaatactccatggacattgcctctccctgggaccagccatcgaaggagcccataatttgtacattctgatgtgcagacaaaaaaccaatgaagaacaatagaggacataaatgatagctgtagatatatgacaatagttctgttccatataacgagttaagtcaaaaaccttgttttacctcagcaatgccaacccagaagacagaaatttcttggtgctttaaagagtctacatccttaatttgttccataaccttatcatgaacagctataggaaacaaacatttcgtcagaaaatttcattgttaattcaacttggagcattgtgatagagataaccttctaatctggtgagaagatgtgactggatatattttccatttatcttcctagacccagatggaacatcaaaattagcaatctcttcagctagggcaaccagagcctgtggacataaagaaacagtgaatacatacaaaatgtaaatacatttagagtaacagtatcaacaatactgatcactgataaaagtttgaacaaaaccaagaaacaaaatatattgatttaaagccagtcctaggggagacaaagtacagaggcatacaaaatcatacaatcctttagaggaagccagacatacttcattcatgtatttacagtctgatatctttatggaaaaggaaacatgaagttatgaatgaattctcaagatgctagatgagttaaaggcatgttgatagcatcccctgtccccaaagggcttatgattgaactatgaaacaagaaaagtctgttagagctaacctgcagttcaagttccataacggcaagttcactcttgaacttcacaacgtcattatccttcatttgcaactgcaagaaatagtacatttctatctagttagcaatgattcagtgcttaataagagaaatggaattgtgcatatttgacataaccacaactctgtatggacagctatttatacaaaaaaaatgtaatctcacaaaaatattcatctgatgcaaaagaagcttcaatttagcaaactagttcatgaatgattttttaaagaaaaatatcctaagatactttcagtagttcaaagtcctggattcgttaggaatatttaaatacatttgtactacaaaatgcattatagattttttataaaaaaaatgtaatttttctggcgatatagtgcgtagcataaagtgaatcaacaacagtaatctacaagtaaaaggggagttctatattctattcgatcctgactgaacaaaattgctagttcttgctgacttgcatcatgacagcaaatacagtgcctggacagagtaattgtttttcattttacaaaacgtctaggcgctatcttcagtagaaagcataaagttcaagtcgcagataatagaaagctattcagtatgaacaattctgtattatgttatttgctgataattgtgaacagtatatatgatgcaattcaatgaacactttggaaaaaggtacaataatagaacctgtctcttgaggaaccggttgtattggtttgcttcactaagctttttcaaaagcttagatcgttctgaatcagccaaaagagatttcaactgcatgccaaaataaaaagagaagcacaacattagtcatatataaaataatgctagtgtctgtaggttgctaatcgaaaagaaaaaaaaaagaccaagttgcaacgttgttctttgtactttggaagtatcaatctttcaagtgcgatctacgaaccgaaacatcaactgttagagctacaatcaagtttgccatttctctgttgagttcatttctgaaggaggtcactctctaatacttatgattataagggttaaggagaatatctccttaagctgtcttagctgctagggaataagaccacatagatatcatacagatacatatttctcttacgcagatgctacattaaaaaccccctgttgacctaatatttgacaaatacaaacaataactcctaaaaatggactgaaagatttatgcaggaaagtataataacgtgaggtatgccttgaaagtagagatcatttatagtgaactcattggaggaattgaaatgctggctctgctaatctttgagtgacatatggtacaggaatgcagagtgataagctgcacgggtttgccaagctattgcaaatgaactccttttaaaatctaatgaatttcggacggcgtgtccttccgccgtcctggcaaagaaaaaaaactgcatgggtgaaacaatacacaattggatgatatgatacctcgtcagatttaagtttccgagaattcagattttcagaagggtcaccataaacttcaccaccatcactagtttgctctgaaggggatgatgttgagtcagaggatgcaggaccatcttccaaattcagacttgcagcaaaagatctccaatttgaacgtctgccagctattgggctaacaggatatgccatagttgtgaacttgcgacatcgtcttgagtttgtggaagctggaaaatagcatagaacccttctttgaatcctttgtttttcagacagagcttcgctcggacatatgagattatactcccttcccggattccttcaccaaaaacatcacctaaccatgttaaagtaatgataaaaggggggtaaaagaagaactatgcattctggatgtggtttcaacagggcatggggaattctgaaagtcgtacggggattaactaacttaccaagctaaaatcagattacggacaatatcaatagatcatacatacatgcttgtcatgttggagtattctatatctgaataataatattgcacaatcaagagaataacttacctagtaaaacttgtggtcagacactccatagctattttcctgaacaaaaataggaaataagatagatcaaaattacattttcatagcttccaatcgagaacattagccaaaacataagtctctcatacagtagcagataacagtatacacgaaaagaaaaaaaaacaactatgcaaaggaatcagtacagatacacggcagcaagaacctaaccccttctcttaaccacaaaccacaccagaactaacaattccctgccactccaccaatccaatccggaagagaatcccaaacctaagtgagccgcacacacgagccgagccgtatcaatcagaatcagttaggtggggggaaatcaaaccgaagacaagtgaagcgagcagcaacctcgcagcgaatgtggggggggggggggggggacaaggccaact

SEQ ID NO: 30163 - DNA, 6669 bp, Oryza sativa
atccaagtcatgagagaaatgtttttgatatctgcacggtcttgaaatgcaattttgaccactacggcttgaagaaatagctagagataccggttagtgtgccgagacaaaatcatgggatgaaggtagtaactagtaagtaaaaaatatatatataagattatttatagtgaggcttcattaagtcataaccaagactatcatagcctccaaatctccattcaataactggaacgagatatctgttcaaacaatgcatcataacagaataagaggaatggttcatctccctacacagaatgcagcaagaccagaatgtacatggtaggagcacagccttgcagcaaaactgcacgcgattgctggctcctgaacacttagctaggagaggtacagctacaccaaaagggttgcaacagatcacgcgataaactgctgggtgaaatcatcaacatgatgcagactcaaagtactgagaatagctgttccaccaggaactaaaaacccaaaacacggtctttgttgctttggctcctaaacaaggctgagttctttacagcagcaataagttgtacaccaccaaattcagtcttgattgtcaagaagaatgacttcaataacatgtagctgaagggtaattgttctgccaaggtagatgaagagcgacgccgttgctgctgctacttcgctgacacttcagcaggatgcccataatcatcaccttcacactgaagtagaaaattcaacgagagagattgtcagagatgatttcaacaacaaaaatgttagttagcatgcagtttcaaggtaaggtgtgcaaacaacaataatagcttgaaatatcgtaggcagagaatagaagtagtaatttcacataccagatcagcaagcatatcgattgtgagttctgtatcaaattcatgggccttcagtgcttcaacaatgaagtcggcagacacatctgggaacatctttgagagagattctaccacagcaagatgattatcaacaccattttgctcatactgtgatggatcaaacgcactgtttgtagcttctccttttgatgaagattctgcagaaatgttgagctttcctaggctttcagcatagtcatccaaagaaagggaatctgggagctcatattcagcagacttgtcagcattctcatccttttcagtatcacctacttgcttctcagaggcctttcttttgctcaagctttcttcaaatgaaggcctggggggaggcacaaagggagtggcgtttggattcaaccgagaagaccgctccattattggcactccagcagacctgttacatgtgcaaggaactcttggtaaaatgtgtacaaatagtgaagattcatcagatcataaactgcattttcatgtctgccaaactttgctgagaaattaacttattccacacagcatgcctactatgaggattactcaaccgaagaggcagtgcaaaaaaaaagtattactactatctaataagaaataactagctgagatatctctctgtctgcttcttctgtcacatagtagtttggtttccgtataagttaacgcacaaaagttgcagatcaccatataaaagttttccacaatactatgtccaaagtgatcaggtcctagataaagtattccaacaaccaaaaactgatctcatacttcaatcaaaaataacttgccatccagaaaactaaaccttggaattgggaacataaaacattttagctatgtacagtttaaaaaagctgtaggcaacagttcagtactattagtacttagtaaagatgacaccacagtccatatacatttttttttcttaacagtgcaatcttacataaaaatggtcaacaattagggacatgaatagtaatgaaaaacagggtaggcatagaacgacagcaaattgtaactgcaaccataataaaatagtttttaacatcctattgcctcgagctccaaatctgtcacccaacttcaaccaatagcctaatcacacatagttgcaacttgcaaggaacaagtgcaaaaatgtatttcacatccgcactccagtgcaaaaaagtgcacaaatgtattccacacccgcactccagcacaaagctaccataaggttcctagatatataatgcaacttgaacaaaacgaggatttcacttccttcctggtgacacccctacatattacacaccttcatttcagatttctcaacagacaggctgagaaattatagcaatgtctggcctacaaggcagcccgaggcacactgcaactcgatcaaccaaggcactaagcaaaggatgcgttacgcacgaaaaaacaacaggaaacatctagaaccagcaatcacgaagcatggaggagaccccaatcccccctccacagcatcaccaaccaacaacaactctaaaatactaggattcgcgcgaaatccagagcatcgaactccacccgcaaccacccaacactgcaacgtagcaggatacacccaggatcaaacaacaacaacccacaccacaaccacaggaggcggctcgcgtgggggatcgctcgcaagtgggacgaaggggagagagagagagagaggcgcgcgtgcgggcataccttgtcgtctccggcgacggccgcggcgggggaggggaggaggaaggcgcgacgaaaccctaggtcgccgcggctcgcctcgcgctcgcgcttgcctcgtcgtcggggaggatgaggaggagaggggaaagggaggaaacggggaacggaaggaggaggggggggggggggcccggccgcgaggagggaaacggtcgtggagcccgatcgacggctggagatcggcgcggttccccggatggacggtcgggatcgtctcttggtcccacaacgtgttagttacactttcaagttttttgggggcttctgctattgatggacagctttttctgggaaataggccgctttttggccgaatttaaatagtaaaaacctattttgctcttattacaatgatgatgagaaaagaaattacaaaagctactccctccatttctttcttttttgcgatgaaccaacgccaaatatttttgaacgaatggaataataaacaggtcaaatatgagtcaaacagaggataaacacatgtttgtattcgtaaaattttacgacttgattacactatccggatacatcgacttcttttgaaaaaaaaaatagtccgtcctatccaaaataaagttgttttagactcacgtagaagcaaagtaagaaattgataacggaagattccaaacaagctttttcccactcttatatgcatcgtttaatttcatgttccgtgcacgaagctgcaatggatgaacacctaccagaccacactgacagggattaaaaacttcggctaccaaacttctcaatcaagatctaaagattcttgctttcgttgctaagaatgatgacatatcataatcgcttacgggcagcattaaacagtcgcaggatagcgaaaaatctgcactcagaagtgccataaataatggtaaacagaaggcacacaagggaacacataatacatgaaagagttgcgacacaaagggttttctactctatccaagcaaattacttgcgccttgctaattgctgagcagaagcaaaattactagagccacattgtaagcagagagccattggccagcctgaaggctacacatatgttataattggcagccaggggaagaacaactcaaaacacctaagcctcaacagtggtcacttgctgccattcgccatcgacggcttctttccatagggtcacattatcattaccatcagacactgccagaatattcccagtcaatgaccaggataacctccacacaggtgtctggaaatcatagagaaccctgccttcccactgctcgccttctttcggtgctgtccagattacaaccgttccatcctgggaggcacttgcaattgttgactttgggaggcctagatttggagcccaggcaacatctctcacccagtccctgtgcatctgaagagccggaaagcaatccatcctccaactcccgttgtacagtttccataccttgactgtattgtcacaaccaccagaggcaagtttctgaacatattcaaactgaccggaaggccctgtattgattagagcacccggcgccattgcaggagcccaagaaacagaggtgacacccactgggtgagcctgatcgatgcgtgttgtgtcccacccaccatcagaacgagcagtgaagactgaaatgttgccatcagatgagccacaagccaagcacagcccaagctcatgaggtgcccaagcaatggaattgacagaggacttgtgctcaatgaaagtgtgcgcctgcgcccattcatcaggcttgctcccttccttccatatgataaccctcccatcatagctgcaggatgccagcaaggaaccatacttaggatgagcccatgcaacttgccagacagggccctgatgtccactcagagtagcaagctgctggtgagagttgccacttacaccaatgatctttattgtgttatcagaagaggctgtagcgatgcgcttcccatagtaatccatggcaatgtcatgcacaacatcctggtggcctgtctctatcttatggggaggcattgttccaatttataatctcctcaaatcagaagtatcccagccaactccaatgtattcacctcaggtaacctatttgataggaatagagaagctaagatcagatggggtacagatcaagtagatgaaaaatataaacggcgtgtctttcacatgtgcagctacggtgccacgcaacagacgcatcaaacagagaagcacattataaggaactaatatgttgtgcagcaaataaagtagcaggagttgatatgctagccagagttagaaaaatactgaaaaaccaacatgattagtatttttttatgagcattgcaaggcagaccttaattccccaaaatgctatcagctgtttacacaagcaggatgattcatctccgaataacccaagcgcaacgcacatcacgagcagattcaaaaagtaataataatttatttgacgaaatatgaacaaatctcgattgctcgtttatcccaacagcaaaacatcccacagaaacgcgaggattaagaggcgtcactgcgtaaatctcctattgctagttttgctacgctaaccacgcaaactctccccccaaaccgaatcctgactaaccctagcgcgcggcgtacgagggcgggagggaagaagaggaggatccgcacagagaccttgcggagaggagggagggcacctcaccgtgggccgagacgcaggggcggaggagagggagcgcgtcgacggcgagcgcggggatccggaggggagggaggcggagatcggaaggcggcggcggcggcggcggcggagatcggggggaggaggggagcgaaacgaaaggacgcgtcgcggcgtcggcgtactcgcgtttcgtgtgtctctagtcgcacgccttattttttccttcttttttttttacgcatggctcgtagtactagctagatcctttgacgtggctcgagcgcagctgcgtcgtccgatcttcatcgcacgagcgtgactgcttcgttccgttgtgtgcattctgagaaacttccaaccacacgatcacaatctaacggttcagattacatcgctacagtagcgtgtgctacaatatgtcggaggctagacaaatctgtcaccgttgctaggctattactgttggcattggagctctctcccgtattgcagactctgcattctattttcatttatcatgtttagaaattattatgtgtaaatatctttagtgataaactaagtcacaagaaaataaataataattatatactccatttgtttttaatagataacgccgttcacttttaatcacattttttaccatttatatttttaaaaattttatgtaaatgtataaaatataaatcatacttaaagtactttgagtgataaaacaagtcacaacaacataaattatgtaattacataaattttttgaataagacgaatgatcaaatgtgtgactaaaagttaacagtgacatttatttaaaaaaagaaggcagtatatttttaaattaatgaatagttaaatatagagtaaattttataaaactacatatactttgcatgatctatcacaaaactgcatatttaagaacttgtttcacaaaactacagatttagtgtctttgtttatcacaaaactacatgtattttgcataatatatcacataactacatatttaagaacttgtttcacagaactacatatttaatatcttcatttatcacaaaactataggtttagtgtcttcattatcacaaaactatatgttttagtattgttaaaacctattgtcggtgacatggggccgggggtatcatgactagaggcttaggtagccgcggtcacccacgtagcctgaccccctcaggggggggggtcgggcccgagggtgacgtggccacccctccctctgtctccccgagggctggggcgcccccgtttcggccccgagggctggggcgccccgaccccctgtggttttggcgccacgtgtgtgggttaggtga

SEQ ID NO: 30164 - DNA, 14725 bp, Oryza sativa
agttggtatgtcagtcccggtcaaatccattccaagcttcagcgcaagcatggcaaggaagtcgctggccattgaatgaaggttgaaatgggcgtccaccggaaaagctggcgagcggggcagaaggcgtgggctctgcttgtcagaggtcacttccggctgtagactagccctcattgtaaaaagcatgtttcctttcttaggcagctggaggcccatgtggtgacccctgaccagataaaaaggaggcccaggcctaggaggaaggaaaaagggggagaaagaggaaaaaaagaggaagaggagttgggactctggcgaatgggtgctagagcctgaactctctctcgctctccggctctctgtattccttcacacacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcatctggcgcgccaggtaggggcgcgcgtgtctttctaagccctcgtcctctttcgtgtgcgccaagcttctcccgctcagcccaatggccgaacgggcagtggcgcacagcctctctccgagcgctagcggtgacgacggggagcggaacccgcgccgtcgggctcgcaccccaccgtccccctctcgccgaaatcttgggcggggggaggcgctcggggaggtcgaaggatccgcgacttcgccgcccgcgggcgacgggggaggacggcgagacggggcgcgtcgccgcctcgtctaccgcgatggcggcacgccccagggcgcgctccaggctgcgggcgcgctcctgcgtcacccgcccgtcgtccccgatccagagactccagcccgacgttggctggatgacgtggccgacttggtcatgacggcgcagcagcgcctaggcgccggcggtaggcgccggcgggcggtcctccgccaccgaggcctctggcgctgccgccgccggctccatgtcgtcgaggaggagggcgcggcgagcggcggccgttacccgccgttcgtccgccattccctcgtcaacgcctccgacccaagaagatgtgcgtggggggccggatgcccgcctcgatatcgagcaccggcgcgacgctcgtcgcgccgcccacgcaacggagggcgcttcctcgtccggagcgccacttcggtccggacacgggggccggccccccgtgtccccggttggcggtgccggctgtcgagcctttgtggagagccttcggaacgtccgttggcccccaaggttccggcccaccatcaccgaaaaatacgacggaagcgtcaaccccgccgagtttctccagatctacacgaccgggatcgaggctgccgggggtgacgacagggtcatggcgaatttcttccccatggccctgaagggtcaggcgcggggttggctaatgaacttgccacccgcgtcggtccactcttgggaggatttgtgccagcagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggttcgcaaggaggaggcctggacctggaactcctccggttctggtgtggcagctctggccgcccccgggtccgccgcacggtcagggcggcgggacaggaggaggaagaagaggtcggcccgttccaacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaaggccccggcggctcccgccggcaaccggcgaagtgaggccaagcagaaggccaccgccgaggacatcgaagatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctaaaacacggtcctagggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcagcacctccgtcccggccgccccaaggcagcggaggtcacgtgcgacgaggtcccggtcaaggaggttgccctaggcgacggcccgtccaagaccacacgaatcggtggtcttctggacgacaaataggaagacgcgctcgtctccttcctgcgggcaaacgccgacgtcttcgcctagagaccggcggacatgcccggggtccccagggaggtgattgagcaccgtctcgccgtgcggccgggcgcaaggacggtccggcagaaagtgcggcggcaggccccggaacgtcaagccttcatccgcgaggaggtggcgcgacttctggaggccggattcatccgtgaggtcatccatccggagtggctagcgaacccggtcgtcgttcccaaggcgaatggcaagcttcggatgtgcatcgactacaccgaccttaacaaggcatgtcctaaggacccttaccccctgccacgcatagattagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatcttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcgggccttcactcagttgaaggcgtacctcagttctcccccagtcctggtcgccccggagccagatgagccgttgctactctacctggcggcaaccccgcaggtggtcaacgcggtgttggtcgtggagcacgacgaggacaaccctcactccgcgcatccccaccctgtgtcgactcgacccgggagacagcagggaggagaggcccccgagccgaacggcggcccaaggcccccgacggccggagctggccctccgcctgcttgtccgacggtgccaggcgcccccgacccccaggatggccccggggccactgcgggaaggccgcgcctgtcgccctctgaccccaaggtcttcggcacagaagccgagtgcgccccgcgcggcctgtcggacgaagagcgccctggagatgcggcccctggcgaagacgatcggccccgccgaaaggtgcagcgggcccgtctacttcgttagcgaggccctccgggacgccaagacccgataccctcaggcccagaagatgctttacgctattctgatggcttcgaggaagttgcgccattatttccaagcgcatcgggtcacggtggttacgtcttaccccctcggccaaatcttgcataaccgagagggtactggacgggtggcgagatgggcaatcgaactctctgaattcgatttgctctttgaaccacaccacgcgatcaagagccaggccctcgccgactttgtggcgaagtggaccccagcttccgagcccgtctccgcccccgaggccagctcgggcccctcgcagctgcctcacaccgcctactggctgatgcagttcgacggctccctgtctcttcagggcgccggtgcgggggtcacgttgacctcgccgagcggagacgtcctcaggtacctggtccgcctcgactttcgggcgaccaacaatatggcggagtacgagggactccttgcgggactcagagtggcagctggactagggatccgccgcctcctggtgttaggcgactcccagttggtcgttaaccaggtctgtaaggagtaccagtgctctgacccgcagatggacgcttacgtgcgccaggtgcggcgtatggagcgccatttcgacgggatagagcttcggcacgtgcccagacgggataacacggtcgccgacgaactctcaaggctcgcttcctcgcgagcccggaccccaccgggcgcctttgaagaaaggcttgcccagccgtcggcgcgacccgaccccctaggggagacggacgcgcctgaacggcccccgaggcccgtcggagtccaggcctcaggacccgaggggagcgctcccagctcccctagattgattgcttggatcactgagatccaggcgtaccttgcagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtcgccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggtgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcacgctaccagcagagcctgcggcgctaccatcagcgctacgtccgggcccgatcactctgcgtcgacgacctcgtcctacactgcgtccaaacacgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcatgtctcgggctcgggccaaccccgcaccccccccccccggggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacgggcccagaaccgagccgtgccccggggcgtggtgaactccgggggggaatcggcaaaggcccacaatcgggtcatccataaccctcggtcaccgcgctcccggcctggccagtctcgacacgaggatctccccaggcactagccccgacccgcgccgtttgaggctgggacctgggcaagagcccttgttcaagccaagacacagaaggaccgcggcacagaccatcctcgtctcatacacacaacaaacagaactgacgcagaaatttcctctttacttgattgcagattaaatcagtctatacaagaagggggcccgaaggcctcagaagaagaaggaaaagttattaagattggcgggggcttgggggctcactccgacgcgcccgggtcgccggcctcgtcgtcgctgtcgtccgcagcatcgtcaccgccctcctcgtcggagtcgagcgcgaacgcgagccgaggggccgtaccctcgaagctgtggacgatgtggttggcggcgtcccagacctgcgcgcgcgcgccgtcctcggttccgggagggaactcttccagcgctgcccacggggagaagtcagggtccctggcctggtagcttgccagtacgagctccaccgcccccccgggtgaggtccctcgaggatgacttgatcgtctcctcgagctcctcggggagccgcttgagggccccggccatctctgagaggcgctgggcgaggcccccctggttggcggcgtacttcgcgtaccgcccgccccagaggcccgcctgccgcccggcgcggtctagacgggagacggcgtcccgaagcatgccgggccctacctcgctcgccaagcggagggcctcgacctccccggcggacgagtccagcacgccctgcatctcggcgatggtgtgttcggcggcagcgaggcgggcggctaggtcgccgtggcccgcggccgccccgccgctgtgcactctcgcgtccagctccttcgcccgcgcctcgagttcagcggcccgctcatccagtaaggccctctcggcgcgggcgccttccagattgcggcgcgcctgctcctcccgcgctgcctcgcggaggaacaagctgtccgccagccgctgcgccgcggcctcggcctcctcaagagctcgcccccgctcggtgagcgcgtcctcgcggaggcggagtgcggacccttctttggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcacgggcagcggcggcgtcaaggacaccccgggcagcgtcgagcttctcctctagctccgccgcccggcttccgtattggaggcggaggtcatcccgtgcctcgtcgagaacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccggccctcctcgacgcgcgcccacgccgcgtcgagctccgcccgctccgcctgcagggcctccatctgggcacttaacccgtccagcaccgtcctgttcgcggcggccaaggcctgcaggaggggctccgcgctcagtggggcagcggaaggcataggggagagccgcctcggtgtgggtgccgcgcggctcggcccgccgatcgacgtgccggactcgggggcgtcccccgaagctggctcgtcccaagcgtcgcccgaggggtcgggcccgagcagcgcgcccgcggcctcgtcgtgggtggcctcggaagtcgtcgtcgcctcgggcggagtcgggtcgggggcttggcaggccgcctggcgtgcgcgcgccgcctctgcctcccggacggactccccggcccggcggagtctagcctcctcccgagcggcctcctcagcctggcgaacccggacggcctcctgggcagcctcctcggcttcccggaggcggtctgcggcttctcgccggtcagcttcccgcctccgggcctccgcggtcgccgtctcctcggcctcagaccggccggacttggaatggcggggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggctcggtccccccatcttgcggggccgtttcttctttcgctccccctcgggctgcggcgtcggcacggcaccctccgggcgcctactgctggcacgcaccaccccgccccctcggggaggagatgggggaggggtaccctcctgcttcctcttcccccgggcgtcggcagggcggctgccccccgggcccccgtcgcggggcccagaagcacgaccccctcccggggtagattgttcccccctgcggctcccgcccgcgccatcgtggcctcggggggcccgctcccccgacgccccgaccacctgcatggtggccaggatgctggcgcgctctggatcgcagcaaagggggaggaccccttgggggatgagggatgcctccacggagctgagattcagcacccgttggaccaccatcctgaagtcctcagggtcccagtcccatttgcgcccctgatgggtcctcacgtagtcctcgggcccggtgtactcccaggcgccccgggtgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgacgggggctggctcggaagtcggaggcgcgcttcgtcggcgagaggggtgtagaaccaatcgctcttccagtcgtcccactttttgcggaggacgcaaggaatgtagcggttcagcacctgcccccgcggctggaagtagcagccaccgactaccgtcggcggcgacgccggttgtacggtgaagaaccaccggaacagccggagagatgggcgcacctcgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccagtggcagattccggcatgaatcggcgcggcagcccagcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaggaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggctgtggcggttgagatgggacagatcgtgcgcgcattaactacgctcgccaaccgcgaaaagcgccatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgctgggttttctgcccgcctgtagggacctgccccacctatcaccgggcctaaggagtggcgtcacgcccgagcgcttccctcgaggggggcgatcgccctggcgtaacgccgggggctactgtcggtgacatggggccgggggtatcatgactagaggcttgggtagccgcggtcacccacgtggcctgaccccctcgggggggtcgggcccgagggtgacgtggccacccctccctctgtctccccgagggctggggcgcccccgtttcggccccgagggctggggcgccccgaccccctgtggttttggcgccacgtgtgtgggttagatgagcacagcggggctcacctaaccgcatttatagcgggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcaaatccattccaagcttcagcgcaagcatggcaaggaagtcgctggccattgaatgaaggttgaaatgggcgtccaccggaaaagctggcgagcggggcaggaggcgtgggctctgcttgtcagaggtcacttccggctgtagactagccctcattgtaaaaagcatgtttcctttcttaggcagctggaggcccatgtggtgacccctgaccagataaaaaggaggcccaggcctaggaggaaggaaaaagggggagaaagaggaaaaaaagaggaagaggagttgggactctggcgaatgggtgctagagcctgaactctctctcgctctccggctctctgtattccttcacacacagatccaccagaacacaggagtagggtgttacgcttctcagcggcccgaacctgtctacgtcgcccgtgtcttgtgcacttcctctctcgctgacgttcatcagatcgagggcgaagaacctcacttagcgcccccggccgaaccggcaaaggggggcctgcgcggtctcccggtgaggagccccacgctccgtcacctatagttttgtgataatgaagactttcacaaaactacatgtttaatatcttcatttatcacaaaactgcaggtttagtgtcttcattatcacaaaactaagttttagtattgttaaaccctatagttttgtgataatagagacactgaatctataatcttatgataaatgaagatactaaatgtgtagttctatgatgaacgaatacactaaatatatagttttgtgaaagaagttcttaaatctatagttttatgatagattgtacaaaatatctatagttttgtgaaacaagctcataaatatgtagttttgtgataaattgtgtaaaatacctattgttttatgaaatttactcttaaatataaatatatgttcaaaatttgagtgcatcatctattagaaacataaaaaccggaaatagcatgtgtccgaatacagggtcgtgaacctactacacaaggtatccatgtacaggcgtacagcaaatatttgcatggttcaagtgagacaattcgtgacagaatcatcaaacaaactctgcaggcaaagaattcatgagcaaattgcatggcagctgtgctgcgcgcgtctataccaattagtattgctaacataacagtgaatatcttttcctttcagatactgtcacaaaaaccgatacagcttaatttgatagaatctactcatgtagctgaaatgaggaacaaaacttagctcagctcaaaatatttctagtgactatcattttcgaaagggaacaaatacagtctcctcataaatgtaatgtcatttttgaaagcgaacaaaagcagctcctagctgtgcctcacaaagggagagcgtttcaggattcaatttcttctgaaaccggtctttgaggttaagctttgtcactgtctgcaatactcgggtgcaaaatctccggacttcttgacgacgtgacttgttttctgggatctttgtaagaacttcttgtatcagctcgcacaactgagaaaggtgcttcttcaacaccttcgatgcactcgaatcatcaccagcccaagatttgagtatgcagtctaccaattctagcgtttgaactcttcgatattcagcttttgtgcatccaatcttctgcagaacaaatccaaagagctcctctcctacccaaggattcctccggacagcctccttcacaaacccaagcttcaaccgcgatttcttgttgttgaagtagtcggtcaatatatattggaacttttcgacaacactcgcaagctcctgtttcgaatgactctttgaattgatgatcttcagaagccaaaatgcagcattttgggctacagaagcaaccgtggtgtatcgtgaccgcgatgccaattttagagctttctccagcaaactttcaagagtactaatctctacaccatcacccttaggataatccttggctttgaatatccttttctgcaatataccacctatacgttgcttgaattgctcactgccatcagcactatgtgacttcacaaaagcttgcattaagaaagaatagacctccagcaccagattatttcctgtggagtttagggcatagaaggttacacaacatataacaaatgtaaatactacagttaaaactgaatgaaagctggaccatttcctaataaaaaaccttgcagtaacaattaattccctgatgtgattttggaggcagattttcggcaatgatcaatttttagagtatcctttgactattatatgcatgtatacaacttaaaatgaatgaaaatatgaaggaatatttgaaatgtacctgtattcctctgaagatatatctcaagtaatgtaaggacacggagcttgacccgcataagttgagattgcttagtttcactgccaggaaggttgcgctccttgaaaatcctcgcaatgtaaggatcaatgcggaacatagcatcatcatccataccatctgatcatctgagtcatccccatctttggtaacttctgcaccatctccatcctttgactcatgggcaactgattctttcaaatcatcttgaccttcatctacttcatcagctgaatcatcatccatttcctcatccagtccgtctgcagtagaatcagtgtccccaacctccgcgtcctccacaatggtttcatcatcatcttcaatgtcaacacatgcatcatcttcatcatcatcactacctgactggcgacgagaacctttcaaatctatcttcacaactctcaacatgtcaagaagccctgtttctgtaatttcatcacagaccacacggaagacctgttgattcaaataaaagaccaagttagcgcagccaagtcaaatgtttagcaagaaaagcaacaaataaccgccattaaacagaaacaagaaaggaaaatgagggcagcacaatctatatgtactggtgattttactatgtttgttatttcgactagtatgatagaaaatggctatttactaggattaaatttctgctagtacaattgaaaatggctgtttagaaaggagtgtatactagataatttaaaactgcatgcccctaatttatttcctattatcatcaacatacgattcttcaaaaatgga

SEQ ID NO: 30165 - DNA, 5157 bp, Oryza sativa
atcattattaagagtgcatcaaaacctttaaagaacatcaaggctaaattgaaattaattgctcaatctgggttttctaatacatctatataaggattttatgcaatatcctcgatactaatattagaattttgaactttgctaatccaaacagttagcatgagtatgcaatttatcactagcccactgtaccgcccaaaaattatgcttttcttcacaattttcattcatggtccaaaattctcgtggttattttggcgaattcaaagttataatagacagatacttgcactcaagtggacaagcactacgccactacctactattgcatcatccccctgaaaagtcatgtgttgccttttcatttatcttagatatctactatgaactaaggggcaaacatccattcttgatgcaaagaaactggcaggtgcattattcctaactatcgtcctttccttatttacatccaactctgcaaccatatctcacctatcatgaacaaatatctcatctttcatgaagctcctaagttcccaggtcctaaccccctacacggagacacaacagcaaatgctgtttcttgttgctgccaaagcagagaacactacaccctgattaccaactaagcaatagtcatccaatcagattgcagcagagagtcaccacccccttccacaaagcttcgatgtggcatatgaacaattgaaacaggatgcattcctcatccacaggaagggagatgatttgagcatgttaagctccacagcttagaaggttgtgagcataaaaatcaaaacacatttgatgcagtgatttataaggtaaccaatttacatatatgtaaggaaatggagatcagagttgcttaaaaagaacaaattaactagtcgaaatagcgtgaaggcaataacacaagagaagtaactagtatataccttgctcaataacaaatgagccccacatgaaggatcattagagaaaggaagtacacgattagagttttgaactgcatcgatcaaaagtaatacaactgcccaagcatttcaggaaagtggctgaggtaccttctgaatgctcatggtatcaacagaaagataaacagcagagcaagtaaaaatagcaaaggccagcatctatgctcttctccttataattatcatgggcagagtgattaagtcagattttagaccaacaaaaatgctataccctcaaggtcaaacttaataaattaagaagttggatccaaggtgcaatcaagatttgctatcagtagaatctgtcactgccaacgacatcagaaagacacggacaccagagcttctgacgactatacaagccaaaaactaaatggacgtgtcggaaggaacttagaacacatgagataaatttgacctaatgaattaatataataaaaagggacacaaaggtttgagctccaaacacgaaataggagaagtgcaccttcgtgaagcaagcaacagctaaaacctatcctgtgaaattgcatggtcagaatagccatagcccaccacaattgacaattctacagaataattcttttgccatggcacggtaagaatatattcaagcacttggaaagcacaagcagagcgggagaaaagatcatcctgttgcaaaataccaacaccagaagccacctaacagacagaaccaccaggaagcaaaattggaataaagcatcaaccaaatccacttgaaggcgagtgtttttatataaaaaataagagcaattctacggtccttgaggaccatgagatactaaaattttagtgtaaaatttggtatctcatggtaccttatagtacctaggtaccaagaggtaccaaatttacaatagaaaaaaggtacctcatggtatctcttcaaggaccgtaaaattgctcataaaataaacaaagagaaattttggataagaatagagctgcgcgatccttgtatccaagaatgaaaaacagtgtggcttttagcgaagaaacacacaagacaactattcttcgaaccaagaacccatcaaaatcataccggaaataagctttgcacattgtgaatgggaaagtgcatattttccctacaaggcccactaccacatcatgctacaaattgctcgagctagaaggggttgctccaattgctaatagcatcaaagaaaagctaaggttcttacttgctaccactgaatttgaaggaattgttctgctgtgccaccaccaccacctagaccaagggaggacacatggtaggaactaaaacaagcagacagattgccgtggaacttgaccaacggaagaaacatggctggcactaaatcaaacagtcagattgccttggaacttggaggcaatgccacacgtcatttttttaccgaaatttcagagcaaaagcggggaagctttagaccgagtaaactcccggcgcgaccaactgaacacacaccctacaagtcaaattcgatcgagttcacacccttcaaccactcaatcgcatcgaattctcgtgaaaaaaaaggccagaagaatccatgaaaatggcagagacgtgagcttccacccatcgtacagcctgtcaattgatcaacccggaatccgagaaacacgcgagggttaacagcatcaccagttcaccaccacacaactgacacgaggcgggcaggtgtgaacacgaacctcgttcctgagctgggcgtcgggcggcggcggcgagttgcgcgcagggacgcggatggcggcggggagcgcgaaggggcccgggaccacctcgagcccaccgtcgccgccagggtggcgcgccagggaagacgagcgcaagggctgataggcggaggcggtgcggccgcggcggcggcggagccatctgcggacgccgtcgacgacccctcccccggccatggtggtggcgctgctccggcgacgccaagcggcattgcggaggcggcggcggctgctcctcccccggggttttgtacgccgccgcggcggggaggaccgcgccggcgtctcgcgccctcgtcgtcgtgagaatcgactgattgactgacgagtcgtcgctgcggaaaaaatcggacggttttgggcgagtattaggctcatggacggatgcgattgacggagatgcctttctattatttttcttttttttaagaattatacggtataacgagacactcataacacacgcacactcgttcctatgaacgcacgcatgtaaactctaccactatgagtatctacgaatactagaccggtaaatccttaagattaacgaagtaaccacagacacttgctagatcaaagaaaaaaacatatttctaaaattaaacacaatttatgaatatagacatgcaaatgtgcaattgcaagcatgaaagacgtataatgatgtcatttacttctacatagataaataaatagacaacataatagcatctacttctgcacacaacgaacggacatacaaaatcctctggttaaacgaacagacaacggttagacgatcatcaatttgataatacctcaaaaatctcaagggataatcaaattggaatggagggaatttttttttctccatcacacaaaagaggtatggcacacttaccactagacatataacaccgcaccctttttttaaccaagcatgcaacattattagtttttattttgtatatgaaaagaaaatgattccctcgtttttatacgaagttaaatatttttgttttcaccaccaacttttagaaatttgtgcattaaaaaacatttcttatggccttatgatattaaactatatgattttctaaaatggatagtcaaatatataaatatttgacacgaaacaaatttagaatgacaagtaatttatagcaaggggaagtacatttttacttttttcttttacattcttattatgatccgcacaagttttaaatttgataggttatcttcgtaaacaaaaggttgtcaaatcttgagttagacttgatctaaagacaaatatcatccactgaaacttgattagcagacacaccactcagtaattctccataacaaatcgcattcaagcagactagcacgcacaaatccaaaggaaaataagccacgactaggagtcgggcgtgcatagaacggcagatgcccccatccttcaatcacaaactcagaacacgccaaaaacgtcaggggagccaaagccacttgggcacttggcttgacaatatccataacttacaaacattgctcgaattcctggcaaagaaatcgaatcaatgcttggtgttcatattgcctatacaaaatcagatcagggcaaaagcactagtgcacggaatctgcctatctggagacaagtagttcacccttggggagtttctcttggtggatgtacaaaattggcagcagctgattgggttgacacagcttcacgctgccgggatctgatgggtgcagcggtctatttcttcgctggggccttgtgaagcttatcaaagatgggatgtctcaggacttctttcgcagatggccgcctcactggatcaggatccatcatggactgaagacaagcagaaagagaatgttaagttgcatgtcggattgcctgttataggagagcagatgcttctgagaaacattatttgaatttgcaccttcagcctaccagctagtagctcatgtactcaaaggttggtacctcagtacgcaagatatttttgcataaaatgcatatgagagcacattatgcttaaatgcttagttgaaccaaaataacagttagtatcacacatgctacgagtgtgactagacgtgttgggaaaaagaacatgataacaaaacagaaagatttaaccaaagataaagttaactggaactaaaaggcagaacaaagtagtgacagaaatgataatcatacccaacaaaagaacatttcttgtcttaaccaactatatgctaaaaatagcaaattgtactagagcagattcagcaaatgactatttaggtgttgttgattttagaaagagatacagaaaggccaaaacaggccactaccatattctatagaaatcactttagtgtatcaaaagtgaccaattaatacttcctccgtttcataatgtaagtcattctagcattgcccacattcatatgg

SEQ ID NO: 30166 - DNA, 2331 bp, Oryza sativa
  unsure (1)..(2331): unsure at all n locations
atgtatggagaatttggaatgcaaacaacacatgattacaaaagctggtctataatgagcttcagagaaagacaaacactaccagcacaaagtatatgccctttcccacttctacaagaattctctccaacactaaaacttgtgcaggtaaatagtatttgtgaactgcctcacgcaattagaatacaccctatattgtggctatctgtataccatagtaccatacctccattatggagattaggcttcagtatttgtttgaactggatgacgcccatcaacatcaagttgaaatatgttacactcaccaagttaaaatagaagatctaagacctgtttgtttactctagcatgatgataagtgttccattttactttccaactgcatgtgttgtataccgtgtttgtaagaactaagaacccaaaaacttgcatgttttactcccaaagaccagaacatgcaccttacaaacatcatggtcaaataagagcaatcaattgctaatgtaagtggataacagcagagaataaacattatccatgaataatttgagccttcagaaagtatttaatatatgttgcagaaacttgtttggatgaattacgacataatattgttattatatcataactgcaacataacttagctacgcgtactgatccaatgacaaagaagaaacaaaatgaaccagtaaacaataagagtaactattgcgtacctggtacagcagttccagggcttccccacatttcagcggctgatttctatccatggacaggcagcggtcacacagttccatttgaataaaaagctgtttgttctcaaaccaagaagtgaaatatccaacaatgttctcatggcaccctgctaagacatgtaacagatgttataaccatgtaagaaatatagctgaaaatgaggaggttatagttaattttgctacctaaggctgccaaagcttgaacttccttcactgcttgcctcctgcaatgagagagacaacatacaagtatgcaacattagtttttcatggttaataattaagcataacgactgctgcaaggctacctttccctgtcattatgcagttgcctgatactccgttttactgcatataagcagccatctatcctcttcagaactttgaacacaacactgaagtttcacgtccaatttgctgaaaatcaagtgtgctcataagcaaaaccaacataaaatggaagtgtataacctgacacagataaccaatacatattcaaactttcaaagcaaacctcaatctcatggaaatcagttcgatagcgtgaaaggccatcaccatcaacagaaggagaaaaccctgcatataaaaaatgtgtattgggagatgtaaggctacacggtactgacaaacagataaatgatagttttgaggggatgtatcgagatgattatgatacaatagcatacaatgcatcaaaatgctacctgatgatttgcattgtctcccaccaaaaacattatcatctatttgatgatctgtattgaggtatggattcctgatgcatggtggaggcatcacccggcagcgaagagccactgccgattgggagacataactacctctcttgtgcgaactagattccttcagctgttcctcctctgaatcatctagaccttcaaactgaactggagcaatccactggctatcaaaaatgtcattggagccaaggcctttgggggaacaatctgtaagcattggcacacatccaattatacagagaataaataaacaaagggagcatatcaaactagtataagtgaagtctcacctctcttgtatctcttgctcctacagactgatttctctggagaaatggggcaagggatattctnctgcagatgaaccacagaacggacaaaaaaaatcagcaaaaattaaagtaaagctcaatatccatttctaatcgatcaatctcgcatcccagaaactaaagcgccgcctttcccccaatacccccaaccttattggcgtcgaagccgctcccgagctgcggcgcatctggcgtgatgtaatccggggtactgcagaacagcaagcaaatagatgaagaaatagggttaatccaaccgcactccaccccctcaagcacacgaaagcacagctcggagccggatcgggaaccctaccagaagaaatcctggctgaggatgccactatccttctcctccacgacctcgtcggcgtccattggcgtggcctgcggctgcagcggaggtaggggcggaggcggggtcgggtccgggtcgcaggacccctcgagcagctcctcgaagggcgtgaagggggt

SEQ ID NO: 30167 - DNA, 14900 bp, Oryza sativa
  unsure (1)..(14900): unsure at all n locations
tttttctttctcgatttgggcgttggtcgcatgggccaaaatggcgccctttgtcacatttgtaaggcctgcgaaacgaaaaataattgggccacaatcccgggcccttctagggctttttcgggttaatccaaccccaagaaaattaagaaggattttgagagatataattctacacctatcatgtgtagaattatttcccctcaatcatttttccttaaggattaatccaacaaaggctatgaaaaaagagctagagtttcgcctgtcataaacaagggctaaccgtccgaagcattgttcggttatttagggattgcagggtttaaattatctctttaaatcccctaaattcttttgtggtttggattaaccgaataagatcttatgggtatttaggcccacatatcagggtcattatgagagcccaaacccatgatgtcgtcttatcgttttgagtacgtatcaaagataactaaggtgtgtttcatttttacatacgtaattgttatagaagtattatttaggccatagttctaaaaggattatctctaaaattttttatatcatactttctctgtctaaaatatactcccttcgttttacaatgtaagtcattctagtattttacatattcatattaatgttaataaatatgggaaatgctagaatgacttatattgtgaaacggatgaagtatatagtagcttaatagtaggtggggcatcatcaagtcctacgagtctagatagcatcctgcccggattgataacatttggaaagggtgaatagataacttttttaaagttatttattgtttgataacaattaatttatttgtatgagcaagctttgtctatctataatctacccaattatctggttagaacaccgttatcttctagtgtaactattttcaattactacataggatacgcatatgtagctattgggaaatcatgccataatcaggttttgcaaagtcgcacgattatcatgtgcggtaatcttctcagttcttaaaaccgtggtaatcctcacgacaaccacacggttttcacagtaatcgcggtaaccgtcttatcgtgggggtgacattaaccccatccaaaatagtttggtgaactccgatcgtaacgtaatttgtctgttcaaagagtaaagttttttttccttcatagaagatatactacttagctaccgtatgaatcaggttaaaaatccctgtttgggaaacatgggtttattccaagtccctgttacatcggatgtttgatactaatttggagtattaaacatgcattaattacaaaacccatttcataaccttgaactaattcgcgagacgaatcttttgagtctaattacgcaatgatttgacaatgtgatgctacaataaacttttcataattatagattaattaggcttaaaaaattcgtctcacagattagctctcatttatgaaattagttttttattagtctatacttaatactctaaattagcatctaaacatccgatgtgacatggaagttttaacccccatctacacaccaaccttcgtggggcaacatcgcagtgactctgcgtcaacgtagtaccggggtagaaacaaacacgtccgccgccgggcgccggccagaaaaccggtagaaaagggaaccgacgagacgagacgagacgacatccatccgcgcgtcggcacttgacattacacgcggacaccgacaccgcacccaccaaactgcccccagaattcgtcgtcaacctcaactctgcacacgtttatacgcccaaacacctgtattctgatgtattttaagcctcaatttaaaatagattattgactaaattattgttacgtattagtatctgctaaattgtagtgatagattatatattttggtaaacaaagttaaaaattaattcaggacaagtggcctaagcggaagaaagttaaaaaaaaagagtgtttgttgacttgtaaaaaaattagtccgtttcaataattcgataaatagtatgagaaaacaatacgcataaatttctaaacagccagctcccaaatactagttaggtagttgaagattatattagttgtagttgttaggtacatgcagcaacgtgctctcgaggaaaaagaatacatgcccgatcacatgaggaagcgtattattgtagtggtatctgtgattccatggcctgtacgttttctttttcctcctttctgtaatgcaaaaactcgcaggggcatgtgaacctgtcggtgatcactgctggtggatttttttttttagataatgtagcggtgatcactgctgatgatggatggatactatgactctataagcctcataggttacccattattattcctaacaagtcaagacgtcttattaataaataaaagctaacttgtaaataaaacttttatatatttgtccgtagcgatttagaaaccaacgctaaaaattatacattgaatcttaaaatcatgttcgaaaatttaaaaatttactcttgttctgacttattagaccgaccgatgtttcaagcacgatagaagaggggaatggatgatggatcattagccaattaacaacgttctatcagtcgccttaaatacctagcttagctctcaccatatctcgtgtacagtagtacgatcagacttatcagaattaatgctcaagactcttgacgacgatgtagcagtacaccatcattgttgttgttcttgacagcttaagctaccattaggttgaactgttgaagtactgaaccatcagatctgactaaagcagagtgaagcggcagacgcgtgtgtacgtaccatcccgtatacaagatcgtgtgtgtttatgtacttgattagtatcatctatctaaccttcgtttgttctgatgcacttatcctcttttaattctgatcaaatgcacggcaccaaatgtggcaggcaagcaactagagtacatcgactgtgcagatctaaaaggacggataagtggataaccttgtactgtacaatatataagatatatagaaaaagtttcagctaaacatctgggcctcctttgaatggaacgaacagataaatggaaaaaatatataaaattttgacagtaaatgcaaagcagatgattaaaaacacacggaaaaaaataatcgttcgaagaaaaccgtagaaatcgaatgagacgggaaattcaaatgaaatttgccaacacattagagattttgctagtttttctttcaaaatattaatataattgtctattacatagaatttttaaagtaatcgataggactcaatccgtgcgtttcaaatgtcctcgtagaaattttttacaggaatgaaatactcaaaaatatcatttattttttacaaatcaagcttgtctgaacattataggggacgaaggaacgcacaaattccgccattttattctgtcatgtctgatgattgatgaatgatgaagatcgaaacaagtgtgaaacagaagacaatctttcatacatccttcctattttgttccatacttccactcggtttgaatgaaaaggcactttttaaaagaaaaatatcctcccaaaatagtgccctctggtagcaactttattgactcgttattatctcccctaaattaatcacatgttaatcaccaaagtactggagtactttacttctattttgagatgactgatgcgatgcgaccaggtccgggatcatcacatccgatccgaccccaaccacaaagcatgttggttaacaactgaaacaaaactactttgccctatcattaacccttaattaatcatccccttttgtggccccgagaatttagattatttaccatcaaatttacatgactcaacttttttaccacccaatccgtatgtcttctataatatatcattaggagtactaattagtataattggtaccactttctcagtttttcaagtatttatcatttcttttctcaatttgtattctttttcaagttttgtggactgttttgcccctgggcccacctgtcaggtgaaagggtgatttttcctcctcaggatcgatcgatccctccagcctccaggcgtcgttcgccaccaaaccccgtcgccgagcgccgttcgccgtcaatcccgccgccgggcgccgacaaccccgccgttcgccaccacctggacgagcgccgccaaccaaccgccggcgggttctaggccatgcgccgagcgccaccagcgacgaccaccgtgcgccgagtgccgctcccagctcaacgcccccaacgccgagcgccggccgcaacgtcgagtgccgcgccacgaccccaacgccaagcgccaccacaccgttgccgcccccgccgacactgtgcaagatggaggcgatgagcagagctggatttgtgcaaagttgtagttttcagcaactggaagatcagatagttttcagcacctggatagtggcaagtctgtagttttttcttcagtgtttcttcagtagttttcggtggggatgctgcagttgaaattgaaattaacgaggtcagagtgtctaaagtcagaggcattgcaggcaaagtttctgggacatatgttcttatactgttagattccttttctatggacaatagagaatctgatgacaatgcagtgacactggaagctctagaaaattcaggtggaaacttctcaagattttcacataggaaggttcttgagatttaaccagctcttcatttcttgctagagcaagtggagaggctgatgattctgaaggttgtgaaggggagggcatgatcgatgtaagggaaacgctgatcatagccacctctccctctctcccttcaaaccctaggcagcacgggggagacgtgttcggccggggtggcggcgccaggttgcggtggccggcggcaatgctcagcagtggggtggcagcgctcggcggcggggtggtggtgcccggcggcggagtggtttctcgctctagttgacgcgctcagcgagacgtgtgttaacagtgaaatttggtaagcccggagtagtcatcggcttagagccaacatcggcttcaaagtccagagattagccgatgagaattgtcaagtcgtcagttgtcggattcttgctatatttggttaaggaaattgatctactaaaggaagcttatccagaagagaccgaggtcaaagagaatgcggcatggaaagttatttattaattaggaatagtttgttagtttccttttatgtttaggaaaatgtgtttagtgtcctataaggactttatcttttccttttatctttaggaaagtttctttcttgtccggcaaagacttgtatcaacccatgggtataaatatgtacacccagggtccatgtaatctatcaattacgatcaatagaattcggcgcatcgccaccttttaccttttctgctttattttatcgtccagcgggacttggcacctgacgcggggttgcatcggtgttcgatctccggcgaagggataagtccaatgttccgtcggtccaggcaattgtattgtctacgtcggcgtcgttcaaggctgcatcagtacattcgacctcttggattgctctggtttggatgatatatttgcctacctatttatcatatgtctatgttaatctagtcttagcatatcaatttagctctatcggctgcttctcgttttagggtttctgccggtattggctaaatcgtgttgctatattagattagccaagacatctaccaccctgaaaatcagtcaacggcttgattgtctagatattgtgcttctttttatacttagtgctgcatcagttgagcttgatctactaagtcgtgcttagaaccataatctctagcctgctttttgactgccaataagggtttcatcggggtttcagctgatgagttatttggacgttgcatcggctcataaggattgcatatacatatgagttgcatctagccgatgacaacaaaggtttcacttattaatctaatcttgtggatttcatgacatcggacctccagccgatatgtgctttagtcttcggatcaatgcttattccatcatatcattatagccgattggtttatactggactatattattgttatattttattatcaacaaccgattgcctttacatcatcatctacattggacatatagccgattgcttacaccttatcgctatcggctggtatcggcatcggctattatcggctatcggctggaactactccatcggcttatcagccgatcggctgttttgatctactatttgcatatattgtcagttgcaggatcaaactgactggcacgcccgcatctcattaatctttggacctgcacaggagctaagcagatctcccagaccggtgtgttcgattttttcatcaacaacgacgagacagagagattgatcgatccagactcagagatatatctcaccctttcacctgataggtgggcccagggggcaaaacagtccacaaaatttgaaaaagaatacaaattgagaaaagaaatgataattacttgaaaaactgagaaagtggtaccaattagactaattagcacttctaatgacatattataaaaaaacatgcggattaggtggtaaaaaagttgaggagtacgaatttgatggtaaatagtataaattctcgtgggccccacaacccagcttcctccgcctcctcggccggagcgagccggccggccggccggcgagccgccgctcgtctccgccgtcggtggtaggtagccaagccaagccacgctgtcaccgaggcggtcaacgagacgacgtggccaccaacgcgcttccccccactgcctctgctgacacatgcggcggctgctaattactgggattattacttggtaaaccctgctactgcctccgtcacacaatataaaagattatgtttttttcttaataaattaacaaagtagtaaaagaacatgttatagtataaattgtgatggatgagagaataaaatatataagatttgatagatgaagaacaaattagcgcaccttccgtaaaaaaagaaaaatctagaattagatattagggtacgaatctaaacatgtgtatatctaggccctgtttagatgggactaaaacttttaagtctctatcacatcggatgtttggacactaattataaatattaaacgtagactattaataaaacccatccataatcttagactaattcgcgagacgaatcttttgagcctaattaatacatgattagcctatgtgatgctacagtaaacattctctaattatggattaattaggcttaaaaaaattgtatcgcgaattagctttcatttatgtaattagttttgtaagtagtctatatttaatactctaaattagtgtttaaatacagggactaaagttaagtccctggatccaaacaccaccccaaattcgtagtattagaatgtgtcacattcggtacagattgattttttatggggtaaatattattgaatcgtactaccaatttcctaccacggtatagatgaagtacaaagttgatatttcctcccacgaaaaacaaactatattttctaatacaacgaatctagatagtgtactagaaaatatcatatctaatattatattattttttttatagtacagaacgagaacgagtatgtgtgataaatgggaaataaagtatcgtcttaggatcagaaatctctttaggagtattatgaatggagtactaacctcgccgttaattgcataataatctggacaagtgatgcctaattaagccatagtttaatcggcaatttgcttcagatccagctcggcatgagactatcagaggcataagtgtcaaagcatctctcgagtctcgagtcttcccttctcagccagcttcgcctcgctcgctagctatccatctcttcctcctcttcttctcccttcccttgtttgcttggaaggagagggggaagaaaagtaggaggacgcggttgcgggttggtccagatctagggcaaggcggtggccggagtttgagctgggcccgccggcggcgagatgaagcagtcgatgcggagccggcaggagccgcggcgggtgagcaacggcgtcatcatcgccgccatgctgctctccctctgcgtcctcagcatcgtcaaggccagatactgctccacccccttcggtacgctccgcctccgccgtggcggcgcggcgctcttcttcctcctcctcctcttgatttgtgagttgggagtgtgaaatttggttgggtgatgtgcagttaagcccgacgaccagctacaggagcagatgaactccagcatcaggatggagaccgacgagccggcgaccatggcggcgggaggttcgtcctcgccctcgctagctctccggattgtgtgtgatttgtgctcaacgagtgcgttcttgaatttgcagagcaagaggaggacgaggaggaggagagctctggcggtggcggcgctgagcctgaggtcagcgccacccctgccgtcgtggtcaccgccgcagccggcggcggcggcggcaagaggaagccgacctgccgcatgacgagcaagcggtcggagcggtgcgaggcgagaggggacattcgtgtggaggggaacgcgtccaccatctacatcggcgggatcgacaaggagtggaagacgaagccgtacgcgcggtaccacgaccccgtcgccatggccgtcgtccgcgagttcaccctcaagccggtcaccgagtcgtcgccggcgtgcaccaggaaccactcggtcccggccttcgtcttctccaacggcggcttctccggcaacctgtaccacgactacaccgacgtgctcgtgccgctgttcctcagcacccaccagttcaagggccaggtgcagttcttgctcagtgggctcaagccatggtgggtgaacaagttcaacctcttcttcaggcagctcaccaagtacgacatcctcgacatcgacaacgacaaggacgtgcactgcttcccccggatcgtggtcggcgccaccttccacaaggacatgggcgtggaccccaagcgctcgccggggcacgtctcggtggtggacttcaagcgcgcgctccgccgcgccttcgggctggagcgcgtcgcggcgtcccgaggcggcgccacggggaacggcaagccacggttgctaatcatttcccgcaagaactcgcggcggttcctcaatgagcgggagatggcgcaggccgctgccgctgtgggcttcgaggtgcgcattgccgagcccgatcagcacaccgacatgtccacattcgcccagctcgtcaattccgccgatgtcatgatcggtgtccatggtgctgggctcaccaacatggtgttcctcccccgcggcgccgtcctcatccaggtggtgccattcggcggcctagagtggctcaccactgtcaccttcaagaatccggcgaaagacatggaggtcacctacatggattacaatgtgcagctggaggagagctcgctgatcgatcagtacccgcgcaatcaccaggtgctcactgatccctacgccgtgcacaagcaaggctgggacgcgctcaagacggcgtacctggacaagcagaacatcaagatggacatggacaggttcaagaagacattgcaggaggcgctcgacaggttgccgccagcatgagagcttgatgaactgatgaaagctcaagcccacgaggtggtggtggtggtggtggtagatagataggttggtgtatctatctgtgccttctcttgcttaacttatttttccttttgaaattctttttacgccttcttcttcctttagcaacattcatttgatctgttgttttggaaaagaaaaaaagaggatgaacaagaacatcatgttacatatgcctagctgatgagtaatttataccctttgtgattattaattggttgtttatttacaagtaaatgtcaagatacaaaattgtggattactagtaagtatcaaatgtgagtgtacctccctctaatgccaggggggcaaactgtattctcctatgccttcttcattgtatcaattcaattcatttcatccagtacattgcctctaccaaaccatgccaaaattgacctttcctctgcaaatgaaccacgattttcaacatataaacgaactacatttgatcttccattgtctcattagtcattgcacaacaaattagtagagtgatcagtcattgatgctagaacagtggatcaaaggttccatgttcagtttggcagatgattagtgccataattgggggataaataggccatgaacaggaccaggattctccctggattcaactaacacaatgagaatgaaatggaccaccattggccattgcctaccacaactacctgtcatggtggcattgcataagcaatggaaatatttcaactttgtcagttcctttctcttgtgaatcctttggtttgggaagagatgagcttccttcctgctctgaccggatcacagcaagccaaattcatagtctgattggcatgatgatatatcagaaaaagagagaattttttggccaacgaaggtttggctgatctgctcggccttagtcaaatctgtctctttcgacgaactgcgttgcgttgctaatttgtcactgatgacaactacttctacctgccatctcatatgtgagcctgtcagaaacatggagtgatatgctagtaggaacactagaagcttccttctgtttcctgtagggaagaactgaagaatggtcagcacatcgtcgaccgtcggatcttgatcagatggtatccgcgacgcgggacccagccatcagtggttgggactaggaattttgcccaattgcaatttggcatgatgaatgtgttgtcctttgtgaaattttctaaaggcaagcagggtttgtacttgtgtgagatgtgaaattgattgggtaataattgacttgttcatggatgattgagttttaatgggagagtgattgcaggatgaattacaagttatcggtcatatgtgatggtaggtaaattgacagggacaacacaagctgaagctgaagaaagaagaagagaacttgttcaggtcagcaactagcttgtacttgacactgaattatgaatgtgctggagcttgctgatggctaaggtgatggcattgtgaaattaaccagctggccagttgatttgcagctgaaataatcaatctctctcgtcagcatttgttgcttgtaagcaaaaatcaaccaccgacaaacaatatggaggcactgttcttgcaaaatccttttggcacaggccgggctttggagcttacccttggccggttttgaatcaacatgaattccagtcgaatttattcggaattggattagttagttccgacgttttttttttataaaaggaatcgagtagaattcagatagccatcctatattgattctcgggataatggagccatggactatactcccttcctgtcaaaataaattcactcttatacacaaatctgattagattcgtacataagagttgatttattttagtacataaaggatttccttttgaatgtgtgaaccatttgtcggtgtctgcttgagtacgaatagtgagtggctcatcatactcaagcacgatgacctcttaaacaaaagagcacgacgagacgatgcttgggatggcgttgaattgatgaattatacatccggaatggaaatgccgtcgtcggagaagcacacgaaagatgacatcagcattcccggccggtttccgccgccgccgtctcgccggcggcaagccgtcgtccgtccatacgccaccaacctcaatgactcgccgtcgtcaatccatcgcgtcgctttcacaacccaaccagtccaaaaaatccaaatgtccagaactgtacggccgcgttaaggcagaaacggatgattagccacacatacaacgaaagatatgattagcatataattaattgtgtactcctattaattattaaaaagtaaaaaaaataagtttatttttaagcgattttttatatagataaaacttgcacaaaatgtataaaatatatcatttagtaatcccttcgatccaaaagaatcaatccagattcatagccagagtttaattctttttaaaatgagtgaagtaatttaaaaaacatgctaatgaaaattgaggaagtagtcaatccgatcttcactgtaaaacggggcctactggttaggcaactacccaccaccatcatccatccaggactgcaatttctcaaattttcccacgtaatttatttaaagaccatagaaaagtttgtttaaagaagtttagtaagtactgtttagtaatgttgatgaagagagtttttgcaaaaaatgagctttgtaagggtgataacggtaatccgtaatctgacagctaaaagtaacacatccttatcagagaaattaaagatgttttcttttgtttggtcaagatgaagtttcgttagatgaaaaaggaggcagcatgcaacacaagttgaaagttcatccgaggaatcaagccaaataaataaataaaataaaataaaagcatcaaagcaaagtgaaaactgatgcgtgacttgtgaactgatcaaggcaggagcccaaggaggaaagggaagacacaaggaagtgcagccagggtggttcgacttcaactggtttccatatcccaggacaatgaccaggcaacaacctaaccatgctatccagctaattactccctctgtcttaaaatataagaagttttagagttgaatacgattattaagaaaagtaggtataaatgagtggtggaggattgtgattggataaatagtgnaggtagatgagaaaagtgaatgatgtagggttgtgattggttggaaagagaatgctagtgaaaaagttgttatattttgagacaaattctgatggttaaaaattgttatattttgggacggagggagtatttccttcatgctatttccatttttcctttttcgcgcaaacatcatcacacatgcacacacatcggtttacacacgctcaatagaataactttaataacagaattattgatccccttgattttatagaaaaacatgtatccataactcagtggagtcgtatatctaggagaatgattctctaacctcatacaaagtctgagaaatctcattcaccctttttgctctctcctcgctcccaatagaggtctttttttttttgggggggggggtgttgtctagatatacccataactccctttatcgcacatatacgagatgtatctctcgttccaagaatatattttctataattgatgatctcccattcttgtatatactatcagagcacagttatgtcaattaatatgcatagcccatgcatatattaagcaagatctgtatgcatcccatgaataatacaacccatatgtgtacctcataatacctccaacacagctattatcacaaaagacatgccaatgtgatggcttattaaacccaataattttgtgatggcatgttaacaattaagattccatccatccatccatccatccatccatcaaaatcaatgagtcggttcgttggtagatggtgatctaatgacaagccccatactaccgaccacctctgcgtcctcatatgcctaacaactgatgatgcttcgaattggttatggctaaagatgaccaatggcatagcatggaccgttctttttgcatcctatggattctggagacgatgacactcacaataccaaataccaaatgcaggttaaccatattaaactacgcttattgcgacgtgcaaacaactctggttgcatcagcagttttgcccctactgcttggaacacatatggttcttgcagggttaagaattataatacaaaggaatatactgcttttaaagattgttgaaatttatgtttgaacctgataaacatttgtcattttcatagagatttctacatttgaaacacaagaaaaaaaaagccttgtgctttcatgcttccagcacacgaagaacatcattcagattactcccttgatttcaccacttttgtaatgcttttgctatctatgcgtacatgacaaacacaaccttgcaaatcaaagcagacaaaagcaacgatcagaagctgcaaagcagctagtgatagggagctggatggctgccttttattattctctagaatcaattctattagtagtactgttcttattaaaagaaaaaagaggctccagccacacgatttttaggaccagctagctagcatcaagaattaaattacaatgatctagggatggcatcagtcagatactgatatcagtgctgaaacagctcccaagttagaaagtttcaagtaaatggattctacacaaacagcaacggcgtttcacataagctcaggaaagttcctccgttcaaaagcatcggataagcgcagtacaattctcccatcaattcagtaaaaaccgtactagttttcagtttatcagcatctcttttatcaattctgtaaccttgggagagtacgtctcctccaaaactcatctatttgcaatatctgcagttcccattactagaaggaacccaacagatcattctctttttattattttcgcgccttatttagagaggatcttctcaggcagatttaagctccatatttaggagctttccagagcttaaatgccacctcatgtagaaagcgttcagcaagcatagcaagatttccaccacgctgttgattaaatagcagaatgaaattagttatacagttatactcctccgagacaaccatattaaacgg

SEQ ID NO: 30168 - DNA, 573 bp, Oryza sativa
gctagaatgacttacattataaaacggagggagtatcatattctacaatgacttcatcagttggaaacttgaaaatatatatccaacgtcagggtgcttcactgcttatgtatcataaactgaagcagtatatcaacaaatcagtcttttagttgtggaaacagaaagtctaacacaggatgagaggaagactttcccttcaaacaaattaaataaaagaaatgaaaagataagaaattcctggaaatggagcttctactccaacatggggaagatactgggatcgtggcaattaaatgtgtttcctctgatataaatagaggcaaatcaaaataagcagggacagacaagttacacggtgttgtacctttattaaactctgaaattgcattgggcatcctggaagcaacgcaatttttccctcccggagacttgtgaactgaggtccagaatcaggaagctgggtacctcttataagttcatagatagctgccccaagagaaaagatatccaccttgtcaagatgctcatacttgtcgttcagcatctctggaggcatataacgtgaatctc

SEQ ID NO: 30169 - DNA, 1109 bp, Oryza sativa
accccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttgtagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcatgcgcgacgatcgtctccatgttgtcctcctctggggcaacaaacagcaggccgagttggctctggccggaaaggtggccaaata

SEQ ID NO: 30170 - DNA, 927 bp, Oryza sativa
cggaccgggtccacgggggtggggcccacgcggcagccccacggcccacggtggaccgggcgcacccgggctcacaccggccggcaccgtgggtcccacgcgtcagccgcacccgagggcgcgggcgcctgacagccgggccccacgcgacagccgcacggtgcgcccgaaggcagccacgccggcgcagcggcgggaggcggcgcgcccgcgcccctatggtcgccggcggcggccataggcacggcggagcggcggccgagagagggagagggaagggggaaaagaagaggcggtccacggctcaccctaggtcgacggcgacgacggaaaggcagctggagcggaggaaggcggcggcgcggctcgggttgacggggacggtggcgttccggcggtcggcgagtgaaacggaggggtggacgaggtcgccgaggacgcggcgaagccgaaggaggcggcgccgagggggaaggtggtccggggcgacgacggcggcggaccggagctcggcggagagagagaacgacggcgtgagctcgattctggcgaggagagagagcggcgagaggcggaaacgaacggaggaggtgcggggagggtttatatagggttggaagggggagagagcgaccggacgagggggaaatgggcgcggaagatccggccgccattgatggcgccggcgaggttaggggagaggtttccaaacgaatccgagggagagagggagggaaaaatggggggaaagagggagggaatcacagggaatatttccccccactttattgcgtgcgtggaccgcgggaggcggcgggattcgcggcggcgcgcgcggcgctagggcacgggcgagcgcgcgggagccgcgggaggacagggatgacaggtgggccccacccgtcagcgagggtggcgggcgggccc

SEQ ID NO: 30171 - DNA, 692 bp, Oryza sativa
ggacttcgccttttgctgcttcttggcgatcagcagacatcttgcgtagcttctgtttccttagcttggcatccggcttgaccgctaggtgatgcatgatgagatctgtcgattcccccagcctctggagaatgccgagtaaatgctgctgcgtcttcggctcctcgtaggtgcctcgaaagttaaggacaaagacatcacgcaattgctcccatgagtaattgttgttagctagtaaattgaagtaccaagaacgggcgatgccgtctagagcgagatgtattaccttcgccttggtattttcgtctccatgagcagcttcgatcgcggactcgtagatggagtggaactcctttgggtcagtttcgcctgaatagcatgggatgggtgcgaacttgaactggggtgggattggacggatcttgattcccccgctcagtggtacccccttttcgccccctgccctgttcacggcaccttgatgcggatacggcatggcgaaaggtgaagtcatggcttgcgcgtgaggcttggccacggtgttcggctgccccgctccgattgtgatgcatggtgagccacaatggatgggtcgaacatcggctggggccatgccatggcgacctgggttggtgctttggtttgctccgaagcctggcgttggggccttgccgccgaacttgttgcctgag

SEQ ID NO: 30172 - DNA, 6767 bp, Oryza sativa
ttttaattaaagttaattctcattccatcgtattaaaatttaattgttgttaatatggttgcgataacattttatttatttccaaacccacctaatctttattttaatttatattttaattatttatttagcccacttgatttttagggtttattcctagttaatttcctcccatttgtgatcgatgaaatccgaaatcaaaatccaataaaatcttcgaataaaattggcatgatgcaatttatttaaaaagttttttttttgaagatcagaatttttttttggagtctttgattttgttggtcgaattttcagaatgttacaaacctaccccccttaaataaatctcgtcccgagatttcttaccggttttcgaatagatgtgggtactctgtcctcaagaattcttcgctttcccatgtggcttcatcctcagtgtgattgctccattgtaccttgtacatacgccacactttgctcctagtcctcttttcggcttcatccaatatccggatcgggtgttctggatatgtgagatcattgctgatgtgaatttcttccagcggagcttgctcttctggcactcgtaaacatttctttagctgagatacatggaagactgggtgtacatccgcgatattctctggcaactgtaactgataggcaacttctcctcgcctggcaatgatctggaatggtcccacatatcttggtgccagttttcctttgaccttaaacctttttggtcccctcatcggagaaacctttagataaacgtaatctccttccttaaattccaggtctcttcttcgagtgtcggcgtaattcttttgtcgtgactgtgctactttcagacggtcacggatcaaacgaaccttttcttcggcttcttgaataatgtcaggtccaaataccgcccgttccccagtctcggaccacattagcggggtacgacatcgtcgaccaaacaatgcctcattgggtgacatctttaggcttgcttgaaagctgttgttgtaggagaattcggcgtagggcaaacatctctcccaatccttgctaaaatccagagcacaagccctcagcatgtcttccaggatctggttggttctctctgtctggccatctgtctgtggatgataggccgtgctaaatgcgaggtaactccctagggcttcatggactttctcccagaaatgtgaggtaaactgggtgcctcgatcagatataatcctcttaggtataccatgaagacacactatcctggtcatgtacaactcggctagcttagcactgctatagtttgtcttaacgggaatgaatctcgccgtcttggtaagtcgatccccgatcacccaaatggaatcatatcctgttgcggttttgggcaatccaacaataaaatccatacctatctcatcccatttccattcgggaatcctgagaggttgcaacaaacctgccggcctctggtgttcagccttcaccttctggcatacgtcgcagagtgctacgtattcggccacatctctcttcatgttgggccactagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgcagctaagcgttccttcacctctcggacttccttgttgtccttctggacttcttctatttgggttctcagaagaggttgaatgtccagggtgtttatctgtccacggggtactatatgtaggttcagctgagctatttcctccctaagcttagggaccatcccttccattctcagatgattgcaatggctcttacgactcagagcatcggctacaacgtttgctttgcctgggtgatagtgaacctctaaatcatagtccttgattaattctaaccatcgcctttgcctcaagttgagatctgactgggtgaagatatactttagactcttgtggtcagtgtagatatcacaatggtttccaatcagataatgtctccaaatctttagcgcatgaaccacagctgcgagttctaggtcatgggtagggtagttttcctcatgtggtcgtaattgtcgcgacgcataggccacaacttttccgtcctgcatcagtactcctcctagtccttgcctcgacgcatcacaatatataacaaagtctttcctgatgtcgggaagaactaaaataggcgctgaggtcagcttttccttgagttgctcaaagctttcctgacactgttctgaccacacaaacttcttttccttcttgagtagttgtgtcattggtcgggctatcttagagaacccttcaatgaaccttcggtagtatccagccaagcctagaaaactccgaatttcagtcacagatttgggtgctttccattccgtgacagcctccactttagcaggatccactgctactccaccggccgagattacgtggcctagaaaagcgacttcttttaaccagaactcgcacttgctgaattttgcatataacttatgcttccgaagtttctggaaaaccaatcgtaagtgttccgcatgttcttcctcatctttggagtagatcagaatgtcatcgatgaataccaccacaaacttatccaagtaatccatgaatactttgttcataagattcatgaagtatgccggggcattggttagaccaaacgacattactgtgaattcatacaacccatagcgtgttgaaaacgcggttttgggaatatcctcggtcctaatcttcagttggtggtatcctgatcgaaggtcgatctttgagaacaccttagctcccttaagttggtcgaagaggtcatcaatccgtggtagtggatacttgtttttgatagttacttcgttcagtgatcggtagtctacacacattctcatgctaccatctttctttttaacaaacaacactggggctccccaaggtgacgaactggggcgtacaaatcccttctcttgcaactctttgatttgctttttaagttcttctaactcattgaccggcatccgatatggtctcttggatatgggggcagttccgggtatcaggtcaataatgaactctatgtcacgatctggtggcattccaggtaaatcttctgggaacacatcaggaaatcgctgtactacgggcattccctttaggggtagcatggtaaatatacccccagcacgttcggttagcctaggatcttgatccatggttgctctcatatccgatccccagggtgtggtcagggtaacctctctacgtctacagtcaattactcctctatgctttgctaaccaatccatacccagaatgacatcaagagtttggggtattagcaccataagattggagggaaataccacatccctaaggcgaattggtacgtctatgcaagcatgactcacagttatctcgcccccaggtgagtgtactatcataggctttctaagtcccacgagggtcaagttgtgcttttgactagccttcagagatataaatgaatgcgatgcaccagaatcgaagagaactttaaccggggtggaattgatagagaacatacccattagtacgccctgatcttcctgggcctcttcagctcggacatggttcacttgtccgcgcccaaatccagtggtggtcctgttcgattgcggagtcttgaataggcctcgcccgacagcaggggtagtagtgctgcgaacagtcattgcattcgcgccagttcggacaggggttttgcgtggatgagggcagttgttagcgtagtgcccgtattccccacagttgaagcagtccacattcttcttggctccaggggcagccaaagttggcgtaggggtgcggttctgaagtgcaactggcctgttgaagttgctaagtgcagcgggacggttggtcaccatgacagggggcttccatccggacggagtggcttccttaagtcgctgaggcactgtctgaggtgggcgactcatagcaagcctcctcttgcggttgtgttccaccgtcctttgatcgttctctagcctgacgaccttgttgatcaggctctggaaactctcgtgatcctgcccgatcataggtccacgcaattcatcattcagcccttctatgaacttgtcgatcttttcttcttcatctgccaggtctccaattgcgtagcgagccaactgagtgaacttgtttagatactcctgcactgttgtattcccttgccgcagtcttctaaactcgttcttcttcatgcgcatcactgcagcaggtacgaaattctcgcgaaacgctgcagtgaactcctcccaggtgggttctccagcaccgtcttctcgggcccccttgtaggtatcccaccaatcaccagcgggtccttccagctggttcactgcgaagatcaccttgtcggcttcgcgtaccctgactagagtcagtttcttttctatgatgcgtagccagtcttctgcttccatgggctcatcggccgtagcgaacgtgggcggcttggtcctcatgaactctccaaagcttgaccctccgcggttgccttggttgctcgcgatagcttgcagaagttgagtttgggtggccataattccggccagagcgtttaagtcgggtgtctgagtttcgtcattgctggttgttgcacgacgtcggcttgccatctgtgtaggttgatggagtaagcatcctaattttctaactagctcctatggctttatcccattaaggggggttgtgttgatatgaactttgtttcgcaagcatggtggaataaactcatttataatacaacaacaatagataccataaataacctcacagagtttcacaaacagtacataaatcatgatgcaatcgactgcatacatacgcagtccaaataaggttcatccaaacgatacatcaaaccaatcatcaaactactcgtcaatctaggtaagggaagagggtgtctcgcatactatccaaaaaccatctgatacgagatcgaagctgcaaggagtccgtcagtctagtcctccagccatccgcaggatcccggggcaggtagagggtggtcgctggctcgcgcaaaccggagtccccacggctcagaggtagtggcctctggatctggcttgggcctcttgcccgggggtcgtgtgctcttgcgagcagtgctgagggtgcgagggcctccgaggaaggtgatacagggaacaggagcctcatcctctgaaggatcagtgatgtctggctcgatctctggctcggtgtcggtcccctctgtctcggagtcgacctggatcggagtctccaaattggaacccagctgcggagaaggtgtagggatcagtggagtgtgaaccaactccggaacaggtggctgtgtcgctgtagggtccactaggtagggcgctgactcagtagctagcatactagcctctcccagaagagcgtggaacgccggtgggtacggcggggtgaggaagaagtagcggtcacggcctaccgctgtggaagtagaagcccctgtagtgctgatcttggctgctcgaagctgctcctccagctggctgacgtgctcctgactctctctcagctgctcctcaagagtatccatcatcccgcggcgatcgttgtactggtcggataactgctggaactgatcgccgtggacctggagctgtgccttcagtgagtctatctcactgccccaagcctggtgctcctcctccaactgaagctgctgtgccgtgaggtcggtcacctcagtctctaactcccccacacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgccctcctcccggaacgggtgatgagcaaactcggtactcgctaactcagctcggtggatagagctgagtcggaggaaggcctcccgggcagcatcctgcatcgcggtctctggcaggtctcggtggtgacgtgtctgaaagctgtagtccaactcggaagggactcgggggtgaatctcgacccgagcctcccaaactgagccacactgcctcactcggtaagacgggaacccagggtatcgcagacgcctcaacatccgatgcagctcaatgacatacccctctgattgaggtaagctcaactcccaggtagcgggtgaatccgaatctgccatctaattttaagaaaaacccaaggtcagtcgagagtaaaacttgctttgtaaaggaaatagttaagagtaagatgaaaagtgtaccgagttttgtaaacatagagtttttatttttgaaagtattgctaaatgggaatttctcccttggccaacttagaaaaggtgtggggcgccttttggtcttttcctacagtcgtatggctctgataccagctctgtggacccccgtttttataacaggaatcaatcgtgtaaacagtaccatttccctggatcaagtagtttggtacacacgaattcatagctggaatatcaagtgcacatacacgagtgtttaatacgaattattacatcataggcccgcaggcatagccttaaatcatcggaccgagaggtccggaatacatccaaaagc

SEQ ID NO: 30173 - DNA, 5926 bp, Oryza sativa
aattcatttgaaaattttcctcaaaattcaaaaatcctgaatgcaattttgaaattcaaacatgtgataatgcaaaaaattcaaattattgaaagcaaatatgcggatacataccaattttcctgttggtgaaggtcgcgtcatttaaagtccgacgtgcaagactgtacctcgttccgatttagttcgcggattttccacctgtctccggtggtgatggagcgggcgtctttggcttctccctccacaccttctttggttttggtgcggacggcggcttcttctgagccggctgctctagcttcttggccggtatgggtggttttactgtcgtcttccaataacggttcctgggcatcgttgtttccatctccagaaaattctgcatggatttcaccaggctatccgttttgggtggctctacttcgaccactcaaatattctgtgggttcggcccgtacttgattctgaccatggagcattgctccgtcctcggttaaaactcaaacttttcttccttgccattgatgtggaaaccgatactccccgttccaacgtcaatgttggcttatgcagtgctaaggaatggacgccccaggatgagtggcgtctccttccctgtgtccatgtccagcacaatgaagtcaaccgggatgaagaaatcccgtatcttcactggaacatcctccactatccctgccgggtaacggattgacgaatcagccagctgaaggcgcattggtgttggtgtcaatacgtgaagttaagcttgtcgaagacgtgttttggcatgacgctgacactgattccaaggtcgcacaaggcctggtcgaattgttgtgccccgatcgagcaggtgatcgtaggacactccggatctttctacttctctgggagcttgtggagtatcaggttgctgcattgttccgtcagtttgaccacctccattgtcgggagcggtctcttgttgctgagtatgtctttgagataacgggcgtatgttggcacttgcatggcgtcaaacaacggcacgttgatgtggatcttctggattacttcaacaaaacgagtgaatcgctcgtccactgacggtttcttgctccgttggggaaatggtagcaaacgtgtgtcacagtactcctgcggcactgtcctttctggctgaacttccttgtcagctgagtcattagatggcgcttcttttgatatcccactcgttcctgcagggttaggatacggcggatcacgagtggacttacctcccctcgtcgtgatcgccttgacattttcaatgaaggagtcgggttgccctggaatcctcccagtttcatttgcagggactaaggatgccaactgagctagctgggtttctatcattttgttaaagctcagttgattttgaaaagcggaagcaaagccatctaatttgacatttatgttttctaggaccttgtcattggccgcaagctttttgcttaatgcatcagtggttttagcttgcgcaaaaacaagatcattcaaggagggctggttagaaaaattaccgttgttgttacctccttgttaatatgggcgtggttccacccttgacctccttgtggatgatacccgttgttgttgcccatgtacatcgcctcctcacgggtttccgggcagtcattcccagaatgacccgtgttgccgcagacctcacacgtaacgtgtgagtccaaggccttgacgatgccttgtggccgtttctcgtgctcgtccaacctcttcatgaggaggtctagcttggcagcaagtaactccgtctccttgatggtgtgcatgcctcgctgacgggtctggagtcgttcctcgctccaacccatgttggagaccatcttctctattaaattaacggctccttgaaccgttttagagaagaaagctcctctagctgctgcgtcgaggtgatcgcgggacatctggttgagtctattctaaaagttctgcagaatcagccagtcatccatcccatgatgaggacaggcggccacgtattgccgaagacgttcccatgcttcaggaatggactcatctcttgtctgttggaaactagaaatccgtccacgaagggcattggttttgcccatcaggaagaatttcgagaggaatgccgtcgagcacttatcccaggtattgatagcagcacggttggcatagaaccactgcttcactctcccaagaagggagaacggaaacagttgtatcctgacgacatcgggactgacgcccttgatggtgtacgtgctacagatctccaagaactattgcagatgagcattggcatcctcattaggcttgccactgaacgggctagcctgcgccatcgtgatgaggctggacttcaagtcgaaatccacgtcccctatgttgacctgcggcccaatggccacgttgtcagcagagggagcagcaaactcgcggagagccttgttagccacaatcttgaaggtctgtggggctagtacggctagtttctctgtcggtagagttttttgcggagcagcgactcgcggcgtgacgctctggaagaaagcttctggattttctttgaagttttccggcaagttgaaaccagtcatgcactaccctattttcacaacaaaagtgaaaacaactaaggttagcctgcaaagaaaaatgattatacagaggtaaatataaagtattagttcaagtaatctctattatgaatcttccccgacaacggcgctagaaatgcttgttgatatttcttaatgacattactagaaatataattaccagcaatggcacagaaatacttctggtatattatggttacaaagtttatccgcaagcgcacggatataccattgtagcatttcacccgagagtattccaagggtatcgtatttattttaacccgtgggaagatcatgtagagagaacattgactaataatttatatattacttgtgataatcatattctaagcagggatgacacacaagcattattactcattctcataatatattatttaggctaagtggaaagaaaagataaagaaaatatattcctatacttctaatatacatagtatacatacattctagttaaccaattgtggacccccgtttttataacaggaatcaatcgtgtaaacagtaccatttccctggatcaagtagtttggtacacacgaattcatagctggaatatcaagtgcacatacacgagtgtttaatacgaattattacatcataggcccgcaggcatagccttaaatcatcggaccgagaggtccggaatacatccaaaagcagaaatagataaggcagcggaattcaggcagcggcatgccattgccacaggcaacgaccgtgctaagacctactggacgccatcgtcttcatctccttcctgataataggcatagggatcctccgaggcttcatctcccacttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaatttttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccatcccacacaagttaagaatttagagtctagccaagtgtaatacatgtcccggtgctcaataaccgcgagcacggctattcgaataggtttggtttactcacactgcagtggatgtacactttacccgcactccgcgactgcccaactcatgagcctcgtcccaacacatgagacgcgtcacggcaaagcttttcgataacctcgcattggcagtacccgctccatgaacttaaatcctcatgcactctaggcgtacacggtttctagcagtgagaggagttctggcgcacccgggaaggaaagactcacacatgcattaagttgtaattatgtttaaattctcacatggtagtcctactgatggcgacaccactgtagacacccgcctcgcggttctaccaatggctgccccaccgtagagcccctacctcacacatcaagaaaccactatgcatggatactgcctccgctcagctatctattccgctaggtctatacccatacgagaagtgcggttgtacgggggtcgtttcatgcttaacttcatggctcggtccttaattgaccagggacggcactagccttttccggacaccacccaagtcctccagccgccccagtcgaaaacagttgttttactttattttcctttcacaaattatgtcatcaatagcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactagggactcgtacgtatctatggttacaaagatttaaaggtgaacaataatcaaggcatggcataatcacaagtaggaggttcataattgcatgcaattttatttataaacaaaacaatttcgcaattgggatcaacatgttcaaggaatagtgatgacttgccttgctcgaggtcttgcgggtcttggccttcacctggatccgcggctccctcggtctctatagttacgtgcgaaaattgatttgaattcggttagaattcaaataaaaatccaagtaaatccgaatggaagtcgaacgcgaaagtcaattcctttttattaattttactatccgcgaactatggcaaaccccaattttggtttaaattattttgcggttacaatattttgttgtcgtatgtttttaatttaatctaccctagcattatatccatatattaggttagaaatttcttatcgcgagctaaatgtcgggcggaatcctaaaattatcttataatattatacgacttaatttagtctatgattaaatataatacacggttaacaccctagtaattaaatccgaatcgctaccgttgatcgattatttatagagattacccagaaataatccacaataatttacgagaattcatacatttgtttaattattaattacatctaaattaataccgcgaattgatttcttatggagagtactaaaagttatctataatctataggaatttatcccattatattttcattaatcctatatttaaatgctagtattttaggtatttaattagtaagagtttatctaactatattttcattaatcctacaattaaattctaatatttgcaaatattttaaatttccccctaaatttttctttctctttttctttccctttttcctctcctctcttttcttttctttttctttctctccctttcttttcttttctctcctggcttcctcctcccttcctctccttctctttctcggctctccctctctttctctcggctctctctttttcccacccgagcggtggcggcggcggactcgagggaaacggagggcgactcaccggcggcggcagcggcgatgacggcggcagcgacggcgacgcacggtggcgcgagaacggcggtgcgggcacggaaacggtcggcgcggcagcacgacggcggcggtgcggcggcactacgatggcggcgcgacggcgtggaggagtgggtggtggagacggggagaaggggggggaatagtgaggcttttataggggaagggagagagataagggggaaggaggaggagggaagagg

SEQ ID NO: 30174 - DNA, 18437 bp, Oryza sativa
gcaacggctagtgggcccccatatcagttttgaccattgtgggtgcactactttagccaaccagccgggagagggaactccaccccatttcaacacattttcattccctctccaaagtttgctctcaagttcattcaagctttgatagtttccctcaaattcaaacacttagttgcatatacacaagttgctttggtgaaactaaccggcgggtgaaattcttgttattcctaaccccggccgagctagtccgttcttgctccattgtgcagaatgaggaggcgactgtctcgtctgttcaaggggtatgggtcttcatcaagtcgccatgatgggtctagtagtcattcatcagcagacgtctcgatggaagatgccgaagctctgcgacgactcctgaacgacaccgacctcaaccttgtcagtgatcgggagagacaagcctactacatgctgagcgaccgggagtatactcacacgcgagaatactcaccagagcttcccaaaacgataggtatggttgttgaatttcgttctatttggaaagctgttggttggcagagatttgctgtagtagatgagcctggttctcgtctgcttactttcaaagaaatagaagatggtatttcctttcgctttttccatgaggagttcacacttacatggaaaggcttaagtacacttcttggttttcacgattcctgtaaaatcgatctccagaaaggaattcctggattcgagaaaaataggttttggaaagacatttttggtgctccaatttgcaagaaacctaggacaaatgatatccatagtcctacacttaggctcatgcacaaatggattcttatgactttgtttcctagaggtgatcttagacccatcaggggagatgaattgattatcatgtttgccatgcttagaaagatcaaaattgctcctgtgaaatgtatgataaggcaatggttagaaagtgtaaagttctctgctcttgttaagtgcacttctctgattacctggatagcaaaaggggtaggggtcgttagcgaccaaattgctttttgctcagctgctcgtccatgtattgatgaggcttatctagtgcaagggcatattttgaaacatggagcagatgaatctttgatttactttttcctcgattgtgcaaatgaaatcccgttgccaaatgcggggtatcatttgtacaactgccatgaactaaccattcccctgcagactatagaagaatctcgtgcaggtggaacatacagggagacgcgcaacatgacaaggaacgaatgagaaagttcatcatcctcaacacccgtgcagatgtatgaggcaggttgggcaccgactggggatgcacccggatggacccaagctccacgccacagcatcggagtctcaacctgggcgagtgccagtgaggacctgtggtgtgcgtctcatgacatccaatggggggacaaccaacctctcagatcaagtggtgtgcctccagctccaagtgaatggcgctcaagttcctctcgttgggacttaggtgaaatcactaggagaatggacacccttgatgtgcagacgggggagatccagtacaagctcacagaacacatagctcaaatgcaagaatggcaacaatctgctgatgctcagttcacgtagctcaaatgtatgtatactatgtatattagaagtataggaatatattttggttctcttttctttccacttagcctagataatatattatgggaatgagtagtaatgcttgtgtgtcactctacccttacccttagattatcttaacccctacttagaatttgattatcacaagtaatatataaattattagttaatgttctctctacatgatattcccacgggataaaataaatacgatacccttggaatactctcgggtgaaatgctacaatggtatatccgtgcgcttgcggacaaactctgtaaccataatataccagaagtatttctgcgtcattgctgggaattatatttctagtaatgtcgttaagaaatacaaacacttgaggtgtgtgagtgaagtgagaaggtgaggggtttatatagcctcccaatgacggttgtgatggttggaatggttggaaataccctgcaaccgtcattgggagccaatctaaaccatccagaagaagccctgcatccaacggcggcgaggaaggttcggctgaacccactggttcggccgaaccaggggccggcccatctagcccataatttggctggtggcctcctgggcttctccactccatagacttgtgaattttggcccaattcatcgtgtcaattctgagttcttggcccattcatgcataagtctgattctcgacatcgtccgattgatttatcgtctgagttgatatcgattctccttcactttatagttattctctgcaaaaggttagtaaacctaatactaatggaatattattattctaacatatttatgcattgtaagaatcactagtgatgggcggagcagtttttatttttctctgggccgaaatggacagtgatgggcttccctttgtgggcttatcactgtgcctacccttgtgacacgtggcggcttacgattgggtggggaggcgaaccggcgcctgggtgtgctatatattcccctttttcaccgccttacactcgtcattttcaccacgagtgctctctctttctccgtcctttcctttcacggcacactttttgccatggctcctcgcaagctgaacccagcctccacgacgggccccgatcccggtcggatcgacgatgacaccaccggctttttaggggcttcgcttgtggatgatgacgagctggcgaagttggtcacctccagcgcggtggtggaggggcaggaatttgccccggggaaggccgtggtgccgaaacccggcgacaaccggaaggtggtattcgccgtgttctttgaggcggggcttcgatttccgtgcagcatgttgttgccggaaatccttcgccttttccaggtggagctcccccagctgagcccatcggcactcgtccggatcgccatcttcgactgggcgtgccggaccaccgggttcgaaccgagcgccgagcttttcggcaccgtgttctacgccactgtaaactcaaagacggtggtcactccggccgggacttagaagacggcattcgggagtgtgaactttaacgttcgccccgagtgttccgatctctagacagtgaacgccgccatgttgaagtgggatcgccattggatggcgatgtggttctactactccatccccttcgaggctgggtccgatgcggcgaaagccctccggtggcggcgcagggcgatttcactgaacaggaagcccaagatcgccgtcgatggagccatggaggcccggttcgccctgctgcgaaaggtctgctcccgccttagctgccgcgacttggtggaggagttctgtatgcttcgcattttccccctctcccagtcgtggcaagtcgaggtcgatcaagataaggaggtcgacggtttgccaaagctcgtcatgcctgtgggggcgaacggtgagtctatgcttttcctatgtgcatccgtgtttcgctcgtcatgcctgcgggggcgaaaggttgcagtcgaaagtgatgaggaggaggaggaagaagaagatgtggaggctggttctgaggatgatggctctcatggctatacccccagtcctactactgtgaaatccgcggcgggctctcatgtttcgcctacgcggtcgcaagatatcgtcgtggcgaacaccctcctggcgatttccagcacagtcgcgaaaccggtgatgaccgctaggaggaagaagaagaaagggaaggttgcgcaggtcggccgtggctttttggacagcgatgggtccgacgggactcttacttcaccggttttacgacgcgcatcttcccgtggtaggcgcatgtctctgccacctgctagcgataccgaagcggcgacgggtggaagtgcctcagccccagccgctaaggcgaatgttgctgaggatgaacgggttgaggcagttccttcgcctgttcgtcaacgagagggaaaggctccggcggttgaagcgagcgtttcggacgtgacgcttaccgccccacatttcgtccctgctgatttcgccacatgtccagagatcactccgttcgtggacggggtgtgctaggtcatagcaccgaccgatggccttgggctcttcaccgagctaaatgagttcgccgaaagctacgtggccgtggaaagcctatttgtgcaggtatgagttttctgtgcgccaaactttgccctttcgctagttccctgtcgtaatgtttttttttaccagggccttgccgcgcatctaagtgccaagaagtctgccttagagcgactagatgggtatggccttcgcctccgcatgatcgaagaagatcttcaccacaaggaaaacgaaagacgtgttttggcggagactttgaagaaggcgaatgctgaaaataggtctctctgctctgaccttgaaacagcactcaaacgggatgccgaacgagaccgacaacttgcttcggccgaggagaagattaaatccctcgaagcccgtcttgtgtcagccgaagctgtcgccacgaccgtggtaccagccacagagtctgccaagcaggcctattacactctccggctggcccttaacgaccttggggcatgggcggaaggtgctccgggtgaaggcgggacaacattcaatttttccgattggatgcaggaggcggccggctcagttgtcgaagtggcaggtgcctacggggactgctgcactcgtgtttcggcgggattcgtccttagcctcatgcacgcgcacggctgcgaccacatcgggagttttcccgatttcgtgaaggatgaatggcctagcaatacgcagtgctctggggctgcgttaagggcctttcgaaaggggttttgggaggatggcggccgggactgtgcgaagacttgactccgcgagaaccatgaaagattcgcgaggaacgaggaggccgctgctgtcaacgccgaaagggatcccgggccgtcggaacgagcccccgggcacgagggcgaaggcgacggaggccaagaccaccctgaggtgtgaggcccttcgccctcgtgttttttattttatttttttcctttggtcctttcgggctttctggtagcctaagttttgtatataggctttttgcatgttcggctttaagccgctttcgccttgtaatcaacatgatctttgttctactggcgaagtataatccttttgcttatctaattgttctgtttgaaagtggaactgatcttcgtctatatttccctcgttttttgcacccccctttttttgtgctttgctagcaggcttgtggccgaaatatatgcgttcgacctcccgctaaaaaatggcggaacaaaaacgaaaagttcatggcgataaaaagcctgtcgaagatcaagtgtcattttcggcccatttaccgcgagatgttgattaatggcaacagctataaggttgtaagtgttgctgaacggatgcgcgtgcatccaggccgaaccttagaggactacgatcgctatcgtgtatcgcgtcgcgaagatagttcgagcttttggtgaaactttaggagatcggctcgccaagaagcgatcgcccatcgccgttatagtttagcttgtgtttgtcctccatcccctttgagggttgtttatgatattagtagtgacgatgaacttgattcgtagagccatcccctaaagggtgaggacctttgtgttggcgaagatgtaatttatctttaagcttggctgtaaagccgttgcttcgttcgtctgtatcatatttgtaggacgtgtattctttgattattcttctttaagttaataaagatgtgttttacttcttttttgctatttctcgcattgtcacttttcgtgcttttgttaggtcgaaacatgtcggcccctttgtgtatattagcgaaataggcttgctgacttttcagctttcggcttccgttttcgacctgttgtgttccgcgtttgaaaggagcgcttatgttttcactttggtcgaatataacggtgttcggttaattgtttcccgaaacaagctgttgcggtttcaacgttcagcgagcgatgcttcggctaattcgtttcgcccccctgatttttttgctgatcaggcgtttgccttggggtttttccacaaattatcaatcacacacataaatgggcgaaagacaccaagattttatactggttcgggcctctgggatggataatagacctacatctggttttttttgtcttttttcattttcctctttttttttgcatttttgtgccgaagggcttacataatgccaaaggcttacataatagtatgtacatttttacaagttggcgatttgggtgccacccgttctacacatagaaacgcttgagggaggcagcgttctaggaatggacgagctcttcgccctctagtgtcgctaagcgaaaggagcctgtcctggacttgtgcttgatgaggtacggcccttcccacttcgattcaagcttgccgaccgccaccgagtttgctttcttccttaggacaagatggccgggcaacagcttcgttggtcggacttttttcttgtaagttgccgaagtgcctgtagcgtacttgcgcatgtgttccagtgctttgactctcaccccctccaggagttcgagcgacacctcgcacccttcttcgcccccagagaacatcacctttggtgaattagcccctagctctgttggggtcattgcttcgtcgccatagagaagcatgaacgggctgaacttggttggccttgtggggtgtaacatcctgaaaattcccaataataaaaatcactaaaatttcaaactttttaaaactttttgatcatgctggttgttacgatcgctattgcttgccaaaccataaataatcacaaagaaagtaaaggaaagatctacatttaagcaatagatataatttacgagaatatgttatttattattaaccctagaaatattagtacacatgaaataatgatcacagcaatggccccatctataatagagtatctcactagaatatataattaatatgtgaaacaccttatcaagctcctcataacatgaaaatcactcatataaaataatggtcatataaataaattaagctttatatataaataagattatgtgagttttaattaaacaattagattaatatcgtaccgagtctcaatttactctttacagaataaatggattaagtctatccgtttaaactatattgctatacaaataaattcgaccaatctaccattgtattattaagaacacatcgctatattaaattgaatattaccccaaaagtcttcaaagatatataagttcactttagggccaataatttaaattaatctaaaaagaatttatttgtgtgataaataaataaatatgggtggtaataatttttgataaattttcatgaggatttagtgcttaaatttagttaacatttatctaagtaaaattagagcttataggattaaaattgtacaggagataggctaagagatgattaataggaaaggacactgttcattgcacatgaggtgtttgatggagttcctagccaccctagccctctttcctccccgctgccacgtgccaactcgcgcccggcgccgccgcgtcatgtcacgtcgccatcgccgcaccatctccaacccgccccgtgctgtcgccgtcgccgtcggatgcgccgcgccgagccccgcgccgctcgtgtcaccgtgggcgtcacccgtgccgcgccgagccccgcgccactcgtgtcgccatcgccgtcacatcagtgcctcgcgccccgtgagccgatgcagccgtcgcgtcgcgcatgcgtccccgtcgttgccgcgccatcgcgtcgccgcgtatcgccatggccgccttgagtcccatgacgcagtgcgccatcacgtcgctctcgagccccgtgcgccgccatcatgttgtcctcgagccccgtgcgccgtccgtcgcgttgaccattaagccacccttcccacaccctataaataccccctcccatctcccttcctcccccacacaccatgttggctgccatatcacaaggccccaagagcccccacgagctcgtccacccctctctgcctcttctactccctcaaaaacatttcgtcgaacaccttgtgggcgtgcttcaccttcttctccgctccaccaccgtgacaccgatcttcatcgttcctccatccctcggtaagtcctcgctcctctagcctcccctagttccatagaaactagagccccctttaatttcgccaattagcaaccgaagccgtgcctgttcgggcaccgttttgccgccggtgagctcgccgtggacaagccatcccggagctcctcctctccttctagtgagtaaaatggaacccccatgcgccgtagatgctcatgcccccatcaaattggtcggaaaccctctctcttgacctagccacttgcagcctgagcttggccatggcgttgccatgccgcaacgctcgcccctgctctcgcttgcgccgccgccgaaattggagggtcgcggaagcctcgcgcaccttccccggccgctacagtgccggtctcgcgccgtctcgggtgcgcccagccacgccatgcgcgttggctctgcccgggttgaagaagatgacgccggtaaaagaaagaatgagagagagagagagcagccgggcccacctgtcaatggttcataggatttgctttagaaaaataatccggtaggaaagcaaatacaatcctaaaccccacatgtcagtcacttggagttttggataaagtttaggaataaaaataatgaattaggaacagtaccatttcgcaattattagaattaattcaaatttgaatctttacactagcataacttattcattttaactcggatttgagtgaaacttgaacctaaattcatctaaattcataagctttccaatgatatataattcactatttaataaaatatatttataaatattaaataattaatatcaagatgatgcataatagttaacttaaaaatgtgctaataaataaaattgatattgtactgtaaagtagatgtcaaataattgtccttaacacgctttctcactgtaaaacctatgtaaactaattaggagcattgtttcaaattaattaaagcataggaaatactagtgccatttattaatatatgtcaatatataattatactcatgacgtccaaattgtataaataatgtttagccgcatactttgtgactaaaagtggaacacacgtagatgagtctttaacttgtttatgagagataataacagagctactgtgactaaaatcacctgcacgaaattaattaacggcatttcctatacagtagtatatgtttaggttggaaatcgacccttaagttgtatagacggtaactcactcataaatccacttaaaatcacatgtactgtgtagctcgtagtaaatagcaactattcaaataaatgattcaatattaagatattgtgcacacacctatactgtacatcccattataactgtacggtatagtattaatttgcttgttgcatatattaaattagagggactatatgacaaacatgtatattagataaatactagttataaatcttgacctcatataattataattatagttcaactgtaaattaggattattcattgtaaaattatgtgatgggataatctgtaaccataatatgattaacctaaacaactctaacatacaaagcatggataattattaaccttttataatttattgtgacaagtaaaatatgttcataattaaagtaaagcctccatcaattaaataataatacaaatgattcattatttgattgatcctaaatccatctaacaatagaacctctggtatgtatccgtgctatttagatagatgcatatatagccataatccttccataaccatttgatagactaaaccaccgattagccaaatatatatgtataccataaatgctatgttggttaactcctaaatagaccacaatgacaacagaaagattaagaaactttagcccttagcatgattggaatccattagcaaacacgaatagtacattttgttgtgcatatttgattgttgttgaatactggtttttctcgcgtattatagaccttgtgtatcggttagtcgtgagacaacgtctgcaacttccaagaggtgaaggttgatcaagaattatatcaagaataaggattatcctgagcaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgattacgtatgagtccctagtcaactatgaccattgcttagaaatgctattttagaatcatgcatactcatatttatcaaatgctatatgcttgggcaattacctttgagaaagtaattgagatgcggcatgtggaggcatgagcgccacattgccatgatattgatgacatgatttgtgaaaggaaaataaagtgaaacaactattttcgactggggcggctggacgatttgggtggtgtccggaaaaggctagtgccgtccctggtcagttaaggaccgagccatgaagttaagcatgaaacgacccccgtacaaccgcacttctcgtatgggtattgacctagcggagtagatagctgagcggaggcagtatccatgcgtagtggtcttcttttaggtgtgtgatgcggcaagcagtctgctggcggatgtccggttcggatggccaggtggatggcggatgcccgttccggatggtcagaggctggcttggcaatactacatgaggatacccataagagaacaatcatgatggactgggttcaacgacaagaagcaacgtaggaatgtgtgtgtttttcccttcccgggagcgccagaactcctcttactgctagaaacgtatgacgcctagagtgcatgagggataaagttcatggagcgggtactgccaatgcgaggttatcgaaaggctttgccgtgacgcgtcttatgtgttgggacgaggctcatgtgttgggcagtcgcggagtgcgggtaaagtgtacatccactgcagtgtgagtaaaccaaatctattcgaatagccgtgctcacggttattgaacaccgggacgtgtattacacttggctagactctaaattcttaacttgtgtgggatgggttattgcatgacgatttttatgctgatggagccacttcctgagaggagggaaggtggacgtcctcagaaaaccatgacgactcaatggcgggaagctatccttgggatcacaatggatggtggacagaaccgtcgttgtttaatgtgaatactggtactaaaatttgatcagtctatgctaggtcttaggcttgtgaaaagaattacaaaacttgctttgcgcaaaagaaccatagccatcctttgaatacccctatcatgtgcattgttgctgtggtggcttgctgagtacggttggtactcacccttgctatttatatatcttttaggagagtgttgaagagaagcccttgtcggtacgcttgcgtatccaacaagatgatcagagtgcggtcttgttctaggtctcgttccccagtcgactgcctgtggcatgttaaccgggcccttatattattttgttttccgctgttgttctcggatagttgttggcctacctggccctaatgtaagtatttaactcttttagcctgaattcattcatgatacgttgtgatccaactatgtatgtgtgtaccaactactgatccagggattggtacggataaacacagaagatttccgatttccaaaatcgggggtctacatgggggttgttcaaagggcccagagaacagatagcatttcatctcgccatttacccttcgccgccccctcaagcctttttttgagcgcctcaagaatcttgtcgttcatgactgaagcgaacctaatttccaggtttagcccttcgcgcatttctctgaatctgtcagagtcgaactggttgccgttgtcagtgatgaattcttttggtattccgaaacgacaaacgatgttcttccatacgaacttctatactgctgccgaagtgatcgtcctgagtggttcggtttcgatccatcgggagaagtattcgatgactacgattgcgaacttgtaaccgtttcgcgccactgggaataggccgatgatgtccagcccccacctggcgaatggccagattggtgcgataggctgcaactcgtattggggcgcggtttggcttctgccatggcgctgacagctttcgcatttcctgacttgctcgacacagactctcagcacggtgggccagtatacaccttgtcgaaacactttggaggcgactgttctcgcggcctggtgtgcaccacaaagcccctggtgtatttctttcgccacttcttcgccttcggctaaggagatacagcgaagcaagggttggagcaccccggagcgatatagctgtcctgagaccagcttgtactttgccgctctgagcttgaggcgttttgcttctgcatcatcctctgggagccagccgttcttgaggtactttacaaacggggtccggcaatcctctgggtcttcgcccagcttcgcctggtcgattgccatgatgtccaggctctctatgggcacacttggtgtgtacaagacctcaaaaaagatgccaggcgactgcgggcccccacaagcagcagatttcaccaaggcgtccgcttcctcattctggcctctaggtaagtgttcgaccgttatgccggcgaagcactttttccatagatcgaacagcctccagatacctctgcattccttcttcctttgcctcaaaggacttgtcaatatgacttgccaccaacttagaatcagttcggatgagcaagcgtcgaacccccaatgctttcgccatttttaggcctagcagaatagcttcgtattctgccgcgttgttggttgtgtcgaactgcagccttgcggtgtaccgaatcggcacgccccctggcgaagtaagcactgccgcagcgcctgcccccttgtgcgaccatgagccgtcggagtacatcacccagggttgttcgacaggctcgggttcaggggcgaatgccggtgtccattcggctatgaagtcagccaggacttgggacttcatagcaatgcgggcaacaaaatgcaagtcgaagggagatagctccgccgcccacttgctgagcctgccggtaacttccttaccccggaggacttcacccaaggggtactgtgatggcaccgtgactttctgggcctagaagtagtgtttaagcctgcgcgaagccatcactagggcgtaagcaagcttctccatttcgatgtatcttatcttcgctccttgcaaggctttggagatgaaataaactggtttctggcccgactctgtttcctggacaagggctgcactgcccgccactggcgaagctgccaggtagagtagcagtttgcttcttggtgttgggctgatcaaagcgggcgggctttgcagatattgcttcagctcgtcgaacgctgcttggcattcgggtgtccaggtaaactttcccgctcgccgaagggtcttgaagaagggcaagcctctttaagctgcctttgaagcgaatcgactgagtgccgtaattcggcctgcgagcttttgtacttcgcgtacgctcgacgggggcttcatttgctgaatggcatcgattttctctgggttcgcctcgatacccctttcagaaataaggaaacccaacaacttgcctgcgcgaacaccgaaaacacacttctaaggatttagtttcatacccgccgcgcgtaagttgtcgaaggtctcctgtaggtgggacgcatggtcgaaagccttgcggctttttacgatgatatcgtcgacataagcctccacatttcgccccaactgcttgtaaaggaccttgtacaccagcctggcgaaggttgccccggcattcctcaggccgaaaggcatcctgaggtggtagaaggtgtcgaatggtgtgatgaaggctgtcttggggatgtcggacaggttcatgtggatctggtgctagccggaatacgcatccaaaaagctcatgagttcgcagccagctgtcgaatccatgagttggtcaatccgtggcaaagggaaatcatccttcggacatgccctgtttaggtctgtgaaatcgacacacatgcgccatttgccgttcgatttccgcaccagtactggatttgccagccactcggggtggtcgatctcttgaatgaccccagccttgagcaatgtttggacttcgccttttgctgcttcttggcgatcagcagacatcttgcgtagcttctgtttccttagcttggcatccggcttgaccgctaggtgatgcatgatgagatctgtcgattcccccagcctctggagaatgccgagtaaatgctgctgcgtcttcggctcctcgtaggtgcctcgaaagttaaggacaaagacatcacgcaattgctcccatgagtaattgttgttagctagtaaattgaagtaccaagaacgggcgatgccgtctagagcgagatgtattaccttcgccttggtattttcgtctccatgagcagcttcgatcgcggactcgtagatggagtggaactcctttgggtcagtttcgcctgaatagcatgggatgggtgcgaacttgaactggggtgggattggacggatcttgattcccccgctcagtggtacccccttttcgccccctgccctgttcacggcaccttgatgcggatacggcatggcgaaaggtgaagtcatggcttgcgcgtgaggctgggccacggtgttcggctgcccggctccgattggtgatgcatggtgagccacaatggatgggtcgaacatcggctggggccatgccatggcgacctggtttggtgcttggtttgctcaaagcctggcgttggggcttgcggccgaacttggtgcctgagcagcattgatgaagtcgaactgcggtccttgactccaaggcgacgcccccagacccaggtgattcgacggcaaccaactaggcacaccttggcttgtattcctctccggctggccgaaggggttctacctgaaatgatgtggggttggctgagttgttgaaggaaagcttggagcagcgcctgtagagtcgaagccccttttgccattgtttgtgacacttggccaggcggttgagggtgtacttgggtagcgaccggctgagcttgcagctgcacgtgaggggccagatgcatagctgcggtcgaaggctgcccgatgaagtatactggcgcttgcgtggcttgtggctgaaggggctggatcggtgcttgtggacagacttggggtgggacatagcctgccgaatactggaggattggggccgaagcggccttggcccgcctcaccgcctcgtacgcctgctgttgttcttgcatctggcgaagcatgtcttggagtcgtgtcatgttctgtcgcatggccttcatgtcagcttcggcttgtgttccgaggtcagggttgacttgtgcggcggcgagcacagtcgaaaccgttgccggctgtgacgaagtggcttggggcaacagcagttggcttgtcgaaaggatctccgccctggtttggagtgcccttgccgccgcgtcagccgtgttcggcacctgccccatcgaggtggcaggagccgaaggcggtagtggtggcgcgggtgctgaagccgatggcgctcccccatcttcggcgatgggcgccgagggttctgctccctctttggcggccatctcccctccgacttcgctttcctttcgccttgtaaacttctccttcatgaccctcttcggtggcatttgctctcagtggtttcgctcggaggtccctacggtcggcgcaagctgttgttgaaacgacaactgcatacgtcgaaagacgtggttactcaacagtggttggaaaagaagtaaagtgtattaaattgaggatttttcttcggatccccctattacatggccctagggggctatttatagccccattacacgttcccactactagggttcaggttatacaggggaatttacatagttacccttatgatagggacattatgaagggcacattgtgtcctttacccacacacgagcccccactgggcctaaatagctcggcccaccggcggacgaaatcccccgtgggcgtagcggcccgccgattctcccgtcaacagggtttggtgccatggcgaaacccgtgctcgtgtgccgaggctttcgccacatcatcttcgcctgttctgccttctgccaggaactccacttgacgaaggtggtgttacccaccgtcacggctttcgcccgtatggcttcgctcttgtctctcggtgtgagcctgatacttgtacttttcggtttcggcaggttcggccgaaggccttccatggcaagcctccaacacatacatatacatatacatagatatacatatacatatacatatatatgtatatatatatatacacacacacatatacatatacatatatatacatatacatatacatacatatacatatacatatacatataagacactcatatggggcaccattgtgcccgggcaccattgtatgaaatacacaaattcacccaattttttaaaaatttttaaattgtgagtatatacctagttataagtattcaattcatacctatacctagcaacaaaacaactcaattttaactttatttcacaatccaatattacatacctaattaattatatgtttggatgctatatacctagaatcaaattctaataaaaacatgtttaaattcagtgcaaacttgttttgaactagtaaagttgttaatgttaatacctaaacagttaaaaaaattttatactcatttcgaattgagtatatattcgatttaaatcatggagcctgggcatcatggagcaccaaacaaatctactatatacgctcggatggggctccatggagtatgggctccatggttgtgagacgtcggattgctgatgatcagagttaccatttcagtatattagcttaatgggtatacacccgtttagaatttattagtggaaagtgaatgaatgggagaatgccatataatccacgatacttatgaacagtaaatagtacgtttctatgcatgcatgcaatgcgcatgaaagactttccatatattatgtgcgtgtaaaggtcagaatggaaacattgaatgtccatgtaattggaaataatatcatggaaatatggaaactcactttaaatatgatgtttgaataaatggtaatatatctatgaaatcatgggtactgcatattttggaacatggaaactaagtatatggaaaacaaaagcatttttttaaaactaaatattgaaccgcggtatttgcgcgctttgatatatgagttgcttacgtataccatatattacggctgggtatatggtaatgtacccgtatctctttttgccatttacggtgttattaatttcgctattgctgcactacggctcactttccaattttagacacaaaatatacatgtatggtgtttggattatgagatgagatttgcacaaatttcgggcgcatatagtatgacattacttttatattttttagggtatatctgtacgtacatataatttttactagtgttcaaggaaattttaggaaaattgaatatttagatctaatagagaatagctatatacatgatgagtttggtctgcattacgtaggtacctacagtgtggtcgatgggtatatggggccatagtgaattctcagaaaaaaaaatagtgaatttgggtatgaacccaatttgcatgtaaatacatgaaaaatttaggtatgtgcccaatttatgtgtaaacgtattcatgaacatatacccaaatattgggtatgaacgccaaaaaaccctgcttattttccatactcgtttaagctaagtatatacccatttaaattgttatgctcgtttatattggacatatgcctaatttaattttttatggcccaaaattaggtacatacaattttttaaaacctgtttaaattgagtatgtgtct

SEQ ID NO: 30175 - DNA, 23492 bp, Oryza sativa
agatacgcagtttgcatatatcagtttttctgacagatattctggtagtgtgccctgcattgggttaaaaaaaatatagttcatggaatcaattcctactgatctagaactgaatataccaccaacagttctcatgcatccacattccattagtactgaatataccaattccatttaattacaaatgccatgtacataggttagttgtacaaaaagagattctcctatacaatctacaaaatgagacaaaacgatggcaaatctacaacaggcaaggcatttcccttgtagagaaatgccactccaaaatatcttgtgaccgccatgataagttgagcatctaaaaacttgaatcagattatcagaaagacaaaagtattaagggtcagatatatagattataataatactccattcaatgttaagtaatctatgcaacacctactatttcaatacagaattgaagatcagtgtcaaatgtgcaggataagtgtcaataacataactgatgtagttccatttaattcaatctgtagcatagcttcgatattctcacaatccaccaatattaaattaccagttccattttatgagaaatttatgttgaagcagtataattgcaatcgtaacagattcaattacaatttacaagcagcaaggattgcaatttatctcacaaactatgggaacaaactgattttagcttacatgatgtatgagcctttaagttagtgttgatcttctgttccttcaggtacccttctctgacacttcagcaagaagttgattgctcacccacaggtcgcaaatcatagctagtaaataaataaaaagaagataagtgctgaagtacagtttaattggctcccacttgcaaatgttaacttatattagaattgagatgtatgtaggtgacattttcataattaatgtagatggaaaatctgaagcccgaagactgtttcaaatttgtactacgacaactcactgcaaggacagctagccacctaatttgcagagatcaactaagggagttttatttaaaataattatactaggatggtacattctacaagtaaaaactcagtaaacacacaatgtacatgcatatttctaataaatggattgatataagttggaaatggcttcactagtaaatagaacttggcttgagtagttgctgtactatgtggtgcatgcaaagttctcaattagcatttcaattattccaactggtcctgatagctgatgcatgtctgtgtgaaatcaataatagatcaaatcttaaaaaaaaatgttcaccactctttctagtacatatataataatgtctgccatgaaatgaaaaggaaatggagcaaacataatctccaatttattgaatagtgcatcatatagaagattagcacttaattgttaataccattgaagttcttgtaatggaaaagtaagcggaaatctaaaaatatgaacaattatccgtttttcaatttgatacattagatcagacagaaaatgtccataatgtggtacactacatgagaaatagtgcattttcttagtactaccacatttctgtaaacattacagctaacttcatgagaaatataaagcagaactggagcattagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactagccgaatgtgcgctctttctcttttggcaaccatgattggacaatcaataaatgagaattctataaaagctcctaatcaacaccactcccgaatacggtatgctcgatcctaacagaagacacgagagtagccactgctcgattaaccgctcgtgagggggaatcgagtgcccctcgcaggcaattcgtcgaacaggagccgtgcaggctgtgatgagagagagagaggggggggaccttgggtgcccagaggcggtcgtcggcggcgacccagcgccaggtgctgcgtgcgtccaggagctccatcacccgccccatcacctcctccccgagcacatccacggggtcctctcgtctctgccgcctcctcctcctccccctcttccgcctctcccactcctccgcctcccgcttccgccgccgccgccgcccgcgccttggttgccgatgacgtcgcctgcaccttgctcgccgccgccgccgtcgcccgcaccttgctcgccgccgccgcccgcgccttggccgccgatgccgtcgccttgccgccgccggaggaagcgtgagtgcgtgacggctgggtagggaagaaaaggataaggttgtggggaaattagggtttggtttatatatgataggctagatgggctttttgggcttgcaatatagtattattaatagtctaatatacacccactaagttttgctgacatataattagctcgtactcttacaattactgacagatattttgaccaaaaatatatttagaattactgacatataccatgtctcattatgcactattgctgacatatagtttgccaaaaacctttaccgacagatatgttatcactaattgtttatttttgccaacagatgtctgttggtaattccatgtcatggtgtagtgccaaatttatgtgtaaacgtattcacgaacatatacccaaatattgggtatgaacgccaaaaaaccctgtttatttcccatactcgtttaagctaagtgtatacccatttaaattgttatgctcgtttatattggacatgtgcctaatttaactttttatggcccaaaattaggtatataaaatctttttgaacctgtttaaattgggtatgtgtctatttaattctaaaaaaatagtgaatttgggtgtgaacccaatttgcacgtaaatacatgaaaattttgggtatgtgctgttccttttgacttaatcagcaattatgctagagatttagagaaaacgatccaatgacacattgactaatcaacattttttaactaatttctgggtatcccatcggtaatacactcataaatatacattattcggattggatacggaaataacaaaaatggggcactaattaaagtatagtaaacactgtttcaagctaaatgccactaattattacactgtaacacgtaaatatcaaactctacaagtgatgcttagttctctgatggcttgcatttcttgtgtaccctccgagatgcggctttcggctgttagtgggttgctctggtttgtttacacttaatatagcggctatgtgcagtagacatgctctcatgattttgatgatgaattttgccataattgtgtgatcttcaaattggttggtaggaggatgaacaagcaacttattaggacgatccactcccatcttgaggtcttcaccatcaagggaaattgtttacacttaacctggaaaacggtagaactcgtacgcgtacgtaaggaaggatataagaatagattgaaacaaattacccatgaaccatgccggcgaccgccggtggtgcaacggacgtacctgacggacaaccggcagcggtgaccacgaacctcatggacggcggatgatgacatcgtggtgacgaagcttgcggatggcttgcgacgggcgacgaattgaagctcacagatgcacaaccagcagcagccgcagcgactaacctcgtggacgaccggcggcgtaacgacatcgcgacggagctcgcagcatcacggctgcgacggatgtacgtatatacctgggcatctaatctgaattctaaaatttagaataccctcggatggtatatatatacatatataaaaggaaacgtctaaattcatatacacggagcaatcaatccaatgtaattaacatgcttgattttctgaacgtatttatatgtaatcatattcaaaattcataattcatttggaaatgcatgcatgcaaaataaaaaatggaaaggtacaagataccctgatgcaaatatacatggaaagcaatcaatccaacgtaattaacaagcttgattttctaaatgtgattatatataatcacattcaaaatccgtaattcatttggaaatgcatgcatgcaagataaaaaatggaaaggtacaagataccctgatgcaaatctttcttattgggttaaacccgctaatttcattaatacccagtttttggtttgcacgaatcctaaagcagttgcacggtggatgacgttggagcatgggctccatggagcaccagttaatttacctatacatatacatatacatacatacatacatacatacatacatacatatgggctccaatgttgggagcctttggatggttgctgatcggttgatcatttgagtgtatgagcttaatgggtataaacccgtttagagtgcatgatttaatagtgaacggattccatatatttgaatacattaaaaaaggaattggatgagagaattatcataattgcatgtacattttaaaaatagaaacattaaatgagcgtgaaattggaaataatatcttgtaaatatggaaacttacgtgattgcatggtgaggtttgaataatgataatataatggtgaaaaatggaaactgactatatggaaaaacgaacttttttttttgcaaactaggtatgtaatattaaatactgatccttctcatatttggaaacatgaaaactaattatttgaaaacatgcatactatatatcgcagcacatttttatggcaatgtatctgtaccaaattattccattcatgatgccattaatttagctatttaagtcacaaagtatgcattgcggatcactttccaagttttaggtgcaaagcttgacatatactcaaaaattgggtatgaaagggaaaaaaatcccatgtaggtatatacattgtaccgatgtacatatgtaatatagtttgatgcgcgtgtggcattcgtgtaggtatatactaaaaaattgggtatgaaagggaaataaatcccttgtaggtatatacatagtaccgatgtacatatatacgtaatatagtttgatacgcgggtgacattcatgtaggtatatacatagtactgatttatatatgtaatatatacactccttattagtttgcatgagcttggaagaaattaaagtttgcatgaccatcgaataaactatcacctttttttttctggctatgtaccattatgtatctaagtataatatacctactgtgtctgggtatagaaaaatagtggtttatagaaaaatatagcaatattttcaagtacctattatgcgtactgtaattatatatattcgagttatatagcaacattattagggtattcgtactatatttatatttttaagtctaatgtaccatatatatacctattagtacctacccaaaattacggggtgcttacccaaaaatttgaagttatgggtatgtggatatgcatagtgttttagttaggcacttatataccttgtttattaatttaaactgaactcaaaactatagatgtccctttttttaattattttttatcatagatacatgccattgggtatatacctgattttaagtagggtgtatatccgtttaaattgggtatatgcctgacttttatattcttttaaattaggtatatatctaatttaaaatacggtatttagctgggtatatagcattgggtatgtgccattgggtatgaggcgaaagcagtaaagcactaattagcgggtactgtctccatttggaatatacacagcagtcacaatattgattcaatgaattcatgataaagaacctcttgtcacaatatatttttgatgaaaaatacaccaaaagttattcagatataaaataaaagaataaactagttctgaattaatctatacactgttctcggaggataacagcaaagcttgcgaacgatttcgccacgaggcaacgacgaaaggacatatacagcaagaataaaaaaaatgataacctgtagctggtcgatcctaacgtacatggaaactgcaaaagtcatattccctcccttcttccttttttatatgaatcaaataattcaaattgaaagtaacggagtgaacgacgaacatcatatcatggacgaccggcgccgacagtggtgacgaacctcaccgacgactggtgatggcggtgcatggcgacgaagcacacaatgacacggctgcgcgatcgtggatgaccgatgccggcggccgtgacgacgaatctcaaagacgacctgtgcggcggcgagcagcgcgtggcgacgaagctacgtacaacatggaagcgcgacagaacatgtgttacgctcccagatcagtaaaatacttttgaaaacgaaaaatcatcgatacatatataaggtaccttaaaaaatttccatggcgaggaacgagcttgagagtcatggacgatcgacggcgcaaaaaaaagcaactgattggcgtcggagacctggttgtgcgttgacgaatctcgcgaacgaccagtagcccactacgaattaagaagctctctcccacgtccggccggtggcgcaatagcttggcgatgaataagctcgccgacgtccggccatcggtgtatgtagcattgagtcgagagtggagtgtgtcatctctatcattttacatgtacacaaagaatggaaagtattaattggtatgatggaaataattaaatcaattacaacgtaattagtggatttacatcgaaatttgtggatccaattcaatgtcatctcaaatatgaaaataaattatcacacaatcatatggaaataaattatcatgcaatcaccagaaaattagtacatgcatgtttgctctatggaaagggaatcgcatcatgtcgtgcacacgctgcatgcaaatcatgaggatacaacaaaaatagaaaggtctaatcgggtttaacccgttactatatgtctaacactctggttttaagtagcacggatctcaaagcatagtacacggtggattctcttggagcccatactccatgtagcaccagctaatttacctctatatatatacacatgcatacatacatgcatgcatacatatacatatacatatacatatacatatacatatacatatacatatatatatatatatatatatatatatatatatatatatatatatatatatatatatatagatatatatatatatatatattgatgtgtgattccttttagcattctttttttaataacaaataaaatgcccgtgcatctgtgtgaaattcttttccgaattatattctagaattgtactccagtttatatcatgtcattatagcatttgaaacacaaactataatacatacccatgtgaatgtgcgggctatctttcttaaaaaaagcctggtgtacaactggggccactgcttttctcaaaaaaatgtgtattccaaatacatattgttatatcaaatagtaaccatgatacagaccaataaccatatacgataaggaagagcttgtcagtaaatccactcaagaagaccaccttccaacttcccaatgtttactggtgtgtagtcccagcagaggcacaaaatcatatgattttagccttttgagcagcagaggcgagagatgtggcagatgcctttcctcctctacttgtaccacctaaagggcacaaaacaaccccaaataaatattagcacagggtttgcattaatacaggaaacaaaaatcattgaagcatcacctaagctaaaaattgaatctgacatataattacattgtcagaaatatctatagtaaattgagaatcaaatacacgtgatcatattgacatgccatcaccaaagtaatttatcctcaccacttaatttattgtacataccagtatttgcaatgttctgctgcacacatatcgtgttggttgtgcaatggacatgatgatgaaatcaacactgcctaacaaacatagaatcatttctcagagtttagttcatcaagcaaaatcaattttagagtttgtttagttcaggatagcaaaatgatttcagatttactttcacatctttgttatccatatttttatatacaaatacaagtaaattgttgctctgatcttgaggtcacaccgtcacagactcatatcctgagaggatttacaaggaatcaacagacttacaacataaatgcatgagcatatggtttacgagcaaccagctatgatcacaaacatctgcttcttttctgtttttttagtagataagctccacccatttaaaacccatcctttgtaccttcagaggagcagctacccattccttttaccacaaactgaaaaaattgtttagtcatctcagaaatccaggtagcaaataagattcattcgggcatgtcatatgctgatggcctcctagcacttacaaatagaaaatgtccataaccaactaattcggggagagaccaattataattactagttgcccacccatgcattgcacgggttgaaaaaattagtaaaaatctaattaattagtttgagaacttaaaaactcaacaattcatcatcaatgtaaatcataaaaaaagtatcaccatgagcattgtgcgaaatcttaaataataaaacatcatttttttcttattgtattgaagagtttttttttttacatttgcaccatatgtccataatttgtctgatttaagggtcagcatctcaaaatccaaatttatgataagtgatgatgttagtactggagactggaaagctcccgtgtgacaaaaacacacggtaactagccaaaaacgccccggaacagcgttaccgtgtgccatcacacggtaacgaacacacggcggcttcaccactttaccgtgcgcagttcccatggggatatgcaaaaagcgcacggtaacactagggaccataccgggtgtccagaaactcacgggaacacctgtccctaccacgtggcaaattttaacgtaacggagttcaccgtcaaatgaacggtaggttcccgggtgaaccaaaaacacggtaacataccgtgcgctgacggaaactctcggtatgctccggtgtgttaccgtgcgttatagtataataaacacacgggaagcaatcgttactgggtttgtacagtggatataattattttttatttctgattttcatttagtttcttttttattgtcacttattgcatcaaaaaagaaacaccacatgctacatgcaccacagctcacatccatataaggtgaaaccacataattcaccaaataaatttaggtttcaacatacacatgttaattaaagaaatatcaaagctttaagacaagctagcttgcctactctacaaattcagacagtcatgtgacatctcaacagatgaagcagctgcatatatttcatcttaatatatctatcagccgaccaaagcaacaaattcttccatagatcaataattcaatatcgaatcagtcaagatgatgggtggctgctgtttgtcaccttgagttgatacatgagtgtagatccttgcaattgttagatactggtaaggagacaagatagcaacacatgtgtaaaaccactgtgcgattggtagaaacagaatggatatgaaattctagatttgacatatgtttccaataattggtaaataagaaagcttactgagcagtgctgaaagaaaaataatctagcacaagataaagttccatgggcataccgtttactttaactaaaaacaatttaaaatgatagaaaggcaaggaaatgtaaacttgtttatcgacatgaatcctattaataaactattagaatgtgataatgataaattaatctacagttgctcactgaagtctaaaattacttactcagcttattgcaggaaacacccgagtggaatactagaatccgcacatgaaaagaaaaacagccagcatgaacagtagatgtcatggacaggatatgagaagtgagtattgtttcagtcagttaccaataccaatttacactacctattagtaccaaagcaattactgcaattcattcagttacaaatttacagttgcactatgggagtgaatttctgggcttcagtatttaattcatactaccctgtttttacaacaaggcaacatacatgttgagtgaatgactacgatacaaaatcaaaagcagtactcatactattgtgtttcaaaaatgagatatatagtgcgatagtcagcatagcattttattgggaaaaaatgttgatcacaaattggtgaggcactttggagaactactgagagattgtataaagagcataccacatcatgagataacatgagctttaaatttttgcatcatatagtgagataatataataatcagggaaaataactgcacaaatctaccaactggtgatgagcacgagctagcatgcatagaacacgaccttttatagttataaatgcaaaggacatgctgtgaagtgtcaacttgcagccattaagacaaacaccttgtaagcataattcactgtatcttgtggactgcagttttgctgatttcttcactgacccaaccaacccaacccctgaatcatgtactgagaaaggaatgcagtatcatttgcaatcacatggatctactacttccccattgcccagttgccgaagagacgattataccgttcgaaaaaaaaaagtttcctacttgacacacaccaaaccaaagaataataaacattaactgacgattgatccaatgtcgaaccctaaccatcgccgcaaacaagtagcagcaatacagcattgcatatgcgatttcagaaaatatatataatggattggtaaatgccacgctcaagaacaaaatcaagaatttgccaaaaatgccttgatgctcttttcattcccttctggatggatgcaatctcgtggacaggacaggtgtaacaatccgatgcaaaacctacttttgaggtttcgaataaacatgattacagacattgatgtaactgcaaagggaagcaaagcatgatgatatatatagtgtgtcatggtttacctgatatatgaacgtaagaaagaagatacacaaaggtaaaacatatgagtttggttgatttaaattaactgatatgttttattacccttgaaaactacaagcatacgaaataaaattattttgattttattgtctgatttgttgaacaaataaaccaatattcggacggctaagcctgcccgatcgagtggttaaatcacctatcgacttttttaattgataacatatatagcatttgtcttttccttccagcatacaatcaggtgatgctcaactctgccaatgattactcactgagacactggttcttgcaatatcgtctaaagaaatctgtagctgtttggcactagacaccactcatgaagatgcagtacaggtttatatatattttttcttacagaccgaaaactgcactatgcatgcataatcctttttgctacacaagctaaatcacatgaaaccttattatgctcaggtgttacagagacgccagtttattacgtctatcagaaagatctgaagaaaaaatactaaaagatgtggtgcattcagttcagcttctggaactgaagcaatttttttccctggataaagattcagacatggagatgtttggttctatcaagaagctgaagaaaccagactaaatgaaaagcaaaagaaggggctagaagtgatgaatggatttgatactgagaagttggaatcatgccaatgctcttgatttgcacctaacgaaatggattttcctcctcgagttgaactcctgtttttttaacttgaattcctgatgcttctccttcttattgtgccatttgctaagatttgttattgaatctttcatcaggctagatatggaattttcattgttatcgccctgaacttccctacagttcttctcaaagcagagaactgccttatttggttctgaaggttcatgctatatatcacttgtgtgtagtgtgatgatttttgttgcatgtaaataagctgcatgctctttacttaggctgaggcagttaaactgtgtgcagtcgtgcagagatgcctatcatttatgattgagattacgacgtataaatttagacaaactttacaacataaatattttttcaacattctggagactgaagtaatcaagattaattaacacggatttaccatcacaactttgttgcaagataggaggatggccctagttgtcattgatgactcaaccaagctatcaaagatatttcctggcaataaaatcaaccaaatcatctaattaatactattaatgtttgctttcatctaaatacataatatttcctagcaaacaaatcaacccaatcatctaaaaagtgctctgctaatatcttcagctcagaacgaacagtcttgaaaacggctatatatgccaggcgttgctcagagggttgtcacaacatcaggctagcttctgtcacttaggtatgtagtgaatacgtaagaccacaaaaaccagagggggggtgaatggttgtagtaccaaaaaccaaaacttttagcggaattaaaagttaccctcaattcgatgtcacacggtcagaccggagtagatgcgctggtctaaccgcatggaaaccaccggtctaaccgctgtagtcgctccggtctgaccgccgaaatctgctactgtcgtctgtagccgccgccagtctgactctgactgccgttagtccgtcggtcagaccaatccgatgtcgtcggtctaaccggtggtgtcttgccggttggaccgccgaacccgagcaaatacaaatcgaagaactctcaaagtatatgacaactttattacttctctttgtgtttataaagtgcaacaacagcacttctcacgaaaatctcgagtactaaacttgaaaccctaactattctcccaactcaatgctctctaaaacgataccgggaggccacacccttcttctctatatatacccgaggtaggcagcctaaagccacgaaccaaacttgtacaagaagtcctaatcccctaggaaacctttctgtataagaaactaactttacaaataacaattgtaccaaatttggactccctccaaattcgactccgcaccccatacgcacacaataccttcatcgtatgccatatagaatcttcaccaaccatgtgcattgatctttagcctaagtatctgtcacgcccagaatttctatccaaaactccaaacgcttacatacgtgtaaaccctcgtccaggaatcagctgagacacacaataacaaattgataatagagtgcaattattattctatttaataggcgaatataaagtcattacagaggtagatagttcctctcaaacaataaagatctaagcagcggaaaataaaataaaaagcgtaggcgactccatcccacaagtagctagaccagggctacgcctaatcctccacaccttcagcatcactgtagaactcctcctatgatgaatgattgcaaggtgagtatatgacatactcaacaagccacgcagcaaatatgcaagtgcaggggataacaaaggattgcataatatagtcttatttgcataaatggcattcaataaatacttaagaatatagaaaaaacagtaaagtatttaattaaacaatattaatccaacgctatacaacatacccgttgtataggtccaaccattctgaacaaccattcccggctgcacagttctatctccaaaccaggaatataccattccaaaccaggagctaaacaagttattaccaattacagcatcatttattatggtgagaggtatgagactaatcacgaaagacattgttagacccgcccataacagcggtgtggagattatggataccccatatctacatggcatgtatagtacgactaggtacagggtgccatatatagatagaatatctttatgaggactcgggttaagtttaaacttgtatgtcaaagaaatatacgagatcctagtcggtgacgattgtattttatctgtaattgcatattccgttagggatatggactgtattttgtaatactgaccccttcccctatataaggaggggtccgggtccctctagggacacgattttctcccagatcatacgatcaataatacactcggcggatcaatccctggacaggagtagggtattacttcttgattaagcaggcctgaacctgtataaaattatttgtctccaaacccatccacttttctagcttggtagccacccccttttagtattgccgaaatcttgtttcgacagttggcgcgccaggtaggggtagcgtcaagttcttcgccgattaagtgcgatgggttccgtctccggcatcgacgacttcgtcttccctcccgggcaagcgttctggttcagcagcctcgacttcatcaccaacgacttcggcaagatttctctcctcgactcggattcaaatcagtcagggagagaccaggtcccagccccgttcggtattccgaactcggccgagatctaccccaagcttatctcgatcaagtcggctccaaaccacttggacgagatcccatctacttcaacaccaccagatcaagatgatggggcctacccgccaatcctgatgaaactccccgacgatctggctgtcgtcttcactacaaggacgtcttctccccgtaggcctaagcgggatccggctttagcatggatccggcctagctccagggaagtcggcgtcatactccagccactcggcacgatttcgacggatcaattggaaggctacttcagctcccccggcgtcgactcacgaccaacagagatcgtagagtatgattaattcggctacctctatgacaaccgtgacctcgacgacttcaacgaaagctttgaagataactacacccctctctatttcggcgtcttcatggccgataacgagacggaagaacaacgccaagcccgagaagcagaagcacgacgcgtacaataggaggccgagcgacgccgactggaagaggagcgccaagcacaagagcaagaacagctgcagcgtgagcaacaggaacgtgaacgggttgcaaaggaggctgaggaccgatgacaacgagccttggatgtagggcgacgagcgcgagatcttatcaggcagcaaggcgttgaggggacagcggtcttctgcacccctcaacagaacgcggttgcggcgatcactctcctcgacaccctcctcaaggaagacgcactcaaccaagctgatcacgttatcaacatcttgaaccagaccaagaccatgattgccgcctcggtcccggttaactccgcaagcgtccgcacgccgactggtagccgagttccccatcttcggtctcaagattatcaccagccaagcctcagcattgctggcgcgggatacaattgcaggagcaggggccacaacgagcgatctgtccactcgcctcccgaacgacacagggagcgccgagttgaacggcctcgctccccacctcgtaggcgccccgtcaatcttcgtgatacaatcaatcagcgccgcgtagcacgaggctacgcgcaccgccattctccggatcgctatgacgacgacgtggatggagttgctgcctttactaacgacctgcgtcgagtggattggccagccggcttcaagccgactagaatcgagaagtatgacggcaccactaatccggagtcttggctcaccgtctatggtctcgcaatccgtgcagcaggaggagacagcaaagccatggcaaactacttgcctgtggccctagcggattctgctcggtcctggcttcatgggttaccccgtggcacgattggatcatgggcggagcttcgcgaccacttcatcgccaacttccagggcacctttgaacgcccttccacacagtttgatctctacaacgtcattcagaagtctggagaatcccttcgagattatatccggcgcttttctgaacaacgcaacaagatctccgacattaccgatgacgtcatcactgccgctttcaccaaggggattcgtcacgaagatctagtcggcaagttcgggcgcaagcctcccaggacggtcaagcagatgttcgagaaagccaacgagtatgccaaagccgaagatgccatcatcgcgtccaagcagtcgggtcccacttggaagccaaagaaagatacgccgactatgggagggggtggaagtaccaatcacaaggaccgtaagcgtaagcccgaggaacttgttgcaactacttttgacaatcacattcctcccgacaacgttcgcgcgtcaatacttttgacaaggtcatgaactcccaatgtccgcatcatcctaactccaatcacgcagccaaagattgcttcgtctacaagcagtttgcagaacaatacgccaagaatgcatggaaggcctccgacggagatcaaagcacgtcaaaaaagaaggacgatgacgacgatgccccgacaggttttcaagaccatcgcaaggagctcaaccacatctttggcagacctctagcttatgaatctaaaagaaaacaaaagctgaccgaacgggagattaacgctgttcaacccgacatgccccaatatcttcggtggtcagagacaacaatcaagttcaaccgctcggatcatccagaccgagtggtccacccggggcggtaccccctagtactagacccagtggttcgcagtgtcaagcttcggagatccctcatcgatggcggcattgcactcaacatccgcttcgccaagaccctggacgacatgcagatacctcgcacataattgaaaccgagtaatgcgcccttccacggagtcattccagggctatccgctacaccactcggccagatcactcttccagtcaccttcggtactcgggagaacttctgcacagaaaacgtctgcttcgaagttactgatttcgagacagcgtatcacgccatactggggtgcccggcgttagccaaatttatggctgtcccgcactatacctacatgatgatgaagatgcctggtcctcgaggagtcatatccctgcggagcgacatcaaacaaaccgtcacatgcgacaaggaaagctacgagatggcccaaacccgagagatcgcgatcgcccgagaagacatccgactggctgcaaccacggtaagcgaaggagaagtgcctgcaaccaagatctcaaagagtggagaaagcgaagccaagaccaagaaaattcttttagatccttctgatcctactaagactgctgtaataggcgctgagttagattgtaaataggaaagcgcactcaccacctttcttcaaaataataaagatatctttgcgtggaaaccatccgatatgcctgatattcctagagaggtgattgagcactctttacatgataaggaagacgctaaacccatcaaacaacgactccaccgctttgcacaagataggaaggacacgatcaaggaggaattgaccaagctgttagcagcgggcttcattaaagaagtccttcatcccgactggctggctaacccagtcttggttcagaagaagaccgggcaatggcgcatgtgcgtcgattacaccgacctcaacaagtcttgccccaaagaaccttttgggttgcctcgcattgaccaggtagttgactcgaccgccgactgcgagctactcagttttctagattgctactcaggatatcaccagatccgactgaaggaatccgactgcttgaagacttcattcatcacgccctttggggcctactgctatatcaccatgccttttggattgaagaatgcaggagcaacttaccaacgcatgatccagagatatttttcgactcagatcggccgcaacgtcgaagcttatgtggatgacgtagtcgtcaagaccaagcagaaggatgatttgattacagatctagaagaaacctttgcgagcatccgcgctttcaggatgaaactaaaccctgaaaagtgcatcttcggagtaccgtcagggaagctgcttagatttgtggtgtcccatagaggcatacaggccaacccggagaaaatcaacgccatcctcaacatgaaaccgccgagctcccagaaagatgtccaaaagctgactggttgcatggcggcgctcagctggttcgtttcacgactcggcgagcgggggatgccattcttcaagctgttaaagaaagcagacaatttccagtagggacccgaagtacataaagcctttgaagacttgaagaaacttctcacctctccaccagttttggcctcaccacatccgcaagagccgctattgttatacgtgtcggcaacttcccaggttgtgagcacggtcctggttgttgagcgtgaagaagaatgccatgttcaaaaagtccaacaaccaatttacttcgttagcgaggttttggtcgactccaagacaagatatcctcaggtccagaagctattatatggtgttttaattaccgtcaggaaattatctcactacttccaaggtcactcggtcacggtggttacatcgtttccactcggggatatacttcataatcgtgaagcaaatggacgaatctcaaagtgggccttagaattgatgtccttggatatatccttcaagccgcgaacttcgatcaagtcctaagctttggccgactttgtcgccgagtggaccgagtgccaagaagacatacccgaggagaagatggagtattggaccatgcattttgacgggtcgaagaggctttcaggcactagagccggggttgttttgatctccctgactggagaaagattgagctacatattgtggatacatttttctgcatctcaaaacgtggcagaatacgaggcgcttcttcacgaactaaggattgcaatctctttgggaattcggcatctgatagttcgtggagattctcagttggtcgttaatcgagttatgaaagagtggtcctgccttgataataacatgaccgcttatcggcaagaggtacgcaagttgaaagacaagttcgatgggctcgaactcacccacgttcttcggcacaataacgaagcagactcactaacttcggttcaaaatgagaagcaggtccttccaaagtgtttgttaaacatctttatgaaccaaccgtaccaaggaaaaacaatcgaggccatggacactcaagacgtaggtatgatcgaagccgactggagagagccccttataagatttctgaccaaacaagaactcccccaagataaggatgaagccaagcggatctccaggcgtagcaggctctatatcattcacgaggccgagctgtacaagaaaagtccatcaggaattctgcaacactgtgtgtctttggaggaagggagacaattgttaaaggatatacattctggtatctgtggcaatcacgctgctgcatggaccattgtcggcaaggcttaccggcaaggttttttctggcctacagctgtgtccgacgctgataagattgtgcggacatgtgaaggttgtcaatttttcgccagacaaactcatctacaagcccaagagttgcaaaccatcccgttgtcctggccgtttgcggtttgggggcttgacatggtcggcccattcaaaaaggcagtcggtggttatactcatctctttgtggctgtcgacaaattctccaagtggattgaagctaaacgggtcatcacaatcacagcagacaaggctagagatttcttcatcaatattgtgcaccggtttggggtacctaatcggatcatcactgataatggcactcaattcactggtggagtatttaaagacttctgtgaagacttcgacattaaatctgttatgcctccgtatcgtaccctatgagcaatggacaagtcgaacgagccaatggcatggtactccaaggaataaaggcacgagttttcgaccgactgaatccctatgccggcaagtgggtagaacagctgcaatctgtactttggtccttgcgcaccactcccagtcgagccacgggccagtcgccgttcttcctagtttatggagcagaagcaatgttgcctagtgaggtggaatttgaatctttacgttttcgcaactttcgcgatgagcgctacggagaaaaccgagtagatgatctaaaccgactggaagaggcccgggaagcagccttaattcagtcagctcgatatttgcaagggttgcggccgttatcataatcgcaacgttcgatcacgagccttcttagtcggcgacctggttctgagaaaaattcaaactacacgagatcggcacaagttatcccccttatgggaagggccatttatagtctccgaagtcacttggccaggttcctaccgactcaagcatgaagacggtactcctatcgacaactcctggaatatcgagcatcttcgtcgtttttatgcttaagcattacttttgtatttccctattttgaccgctaacatcaagctttcccttgaagttatcagtcggggggcaactataataataatggagtgtgatttttatcaattcaatttgcttacttgatttatcattgccttgcttgatcttttggcttagtcaatgaggactgaaacttttttaatagcttttgcgggttttaggctcaataaggtttcacaaaagcttttaagaaatcagaagttaagtttgaaatattgagcacagcataaattcatcggtattgtacaaattgtgcctccatcataatcatcatcatcagaatcattgttatgatataacatcaatcggtatcagttttttcattatcagagttatcagatccagtcggctgaaggtcgttgtcctggaatctctcaactacataaactgctatcttattggcggctttctgcgcatcgttgatgaggtcaagagcagcttcttcgctcgtcccgtctgcaaagccatcaatggcgtcaatgtcggtcctcgggtatagagacttggtcattgccaacgccaggcttgctcccatacttctagcctctttgatattcttaaaatatgtatcgggagcaactctcagcttgtcgaagatttcggaagcatcgaatgtactcggaccattgttattgaagaacatggcttggacgagtggggtagtagcgttagcgacttcatccctggccccttcaagcctcttgattttgttgactaagacatcaaattgagcctgcgacttgattttgcggtctgcatcaacagattcacatcaatgagtaagcataaagaagataatggcttttgaagtattgattgctagtaccttcaacgtctttcaaagccgagtccctctgtcttgccaattcagccttgtcgttttccagagtctgaatctgcttttccagttgagatatcttggcggcttgcactatattgcccctggttaattgatattacaaagatgacagcacaaataagttggacagagtttgtgtgtaccttttgatgagccacttagttcaaagttggattcctggagctcgacaatccgatccctcagatcatgctcagtttttctggcaagttctttgacttcgtgcagctggtctctggtggcctgaagggttccgagatgaggaactaatttttccagggtcgcggttttcgcttcattcctgagatagattctctgcaaaacagttttaccggcatttgagctaaatggcaaacaagatggttgatgccgtgcacgaagaaacttacgtttacaatgcgggtagcctggctgagtgcctttttcagcaggcatacttcctcatcttctttttgcttattgatcacaattccttgaggttgcatatcgtcgtcccaccacttgactaaaatgggtggacggtaatcctcagctgactgtatctggaggacttcttctttgtcgctgactatcgggccttaggcatttatgaaaagcgatgaaacaattggagaaagtttgtcagaccaaaatgattttggataatatgcttacctgtgatgatttccggtcggagacgagtgggctcttatgcttttacagaagagctggatcctggatcattatcggcatcctttccgagagggttgtttgcttgagtttcaacttcagggatctcttggtttggttctgtccccgactggtttccagtcgggggctcctggttaactccaattccagcttcggccgactggtttccagtcgggggcatgttgctgggttctacattatcggttgccggttgattatcactcaggtgatcttttgcagtcggcctagtttcttttgaagaacccgtctccatgttagtcagatcagagtcctttccagaaggatctatgtcagatggcttcctacgagtttgagttgtgctatcagtattattttaataatgagtgagcatcaatacaaggaggatcgtcaaacgatttatacctggaagacttcctgattttcagcatgggacgactagatgttttcttcttcggattggcttgtctcggttgatttccggtcgcctctttatttccaaattttccagcatcatcgccttcatcatcactcagaaccaatttgtcgcgaccgggaaaatttcattttcccgaacgctagtgtattaatccccgtcctaggaaaagcaggggtacagcatacaaacatgatataaaagacatatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcagatgcacgactaatgcaagggggtacaaggggtaatgatataggggttaagttttgcagaaaacagcatttaaaagtcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagcttgtcccaaggcaacccaggccaaccattccacatttagttgttgagcaaattttaagaataaaacactaactcgggtacattgctcggctggccataaccgagggcgtggctattcgatagatatactctgatcagaggtgtcatctttacccacaagaca

SEQ ID NO: 30176 - DNA, 7830 bp, Oryza sativa
tttccattggatcatctcccaagacatggcattgcctggtaaccggtgcttgcacttttcactccgtctagcatctgataccgagttgaagatttcactctttgccttcatagaaacacttttacctaggtcatcttgcttacttaatgacaaggtgactgttgcggggcaattacaatcaggggtcttccttgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggacgatgaggtcctttggcttgctgcctttcagtgaaaccttgatgtggtttgtcaaaaagctgcactgactaccttcagggaaatacattgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaaatattgatgtctcctggatcttcttaactgtttgtaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgaggttagaatatagttcttctgacacgagaccctaggtctcctttgtcagtaaaccattatacacatgatcacatatccgcatcttccaatagaatcctcttagaacttgtctgtattacacatttctctcttattacacgaatacaaggcactgccttaaacaaaaaggaaaggtgcttatcatcggtacattgtatcctcaacatgaatcatccataaacatagcaagctcactgtttatagacatgaatatatttatttattacatgattgctgcaaactttcgattacacaatgataagtagcgaactgaaaaccacaagcgtggctgctcattttgattctggagagatatagctggcattgttctagtgactgcatcatccttgattggttctgtgatgatgtgataggactgcatattgctatcattcacaggagaacctttcttctgattgctgtttgaagcggatggcggtcttctgcttggtatcgccctccggaggttgattgccctttgctcggcctggagtaggtcggggagagacacaacttcttccatcgacgacaattctttgctgaggctgtcggtgcagagaatggttggtgctaaagatattattgctatgatttattgcagagttaggtggagcaggaggagcattggtgctgtggatgatatcgtcgatgttgctgttggagctgactagctgatgagacaatcgtagggttgttcgttggatttctgcggtcttggtcaacaacacactgagttggcaatccttgggcacatggtttgttccttcgcacagaaaacatgtcaccttgcgagtgggacactcccctggtggatggtcttcttcatagtgagtgcagagtgtgagacacatgctagcaacgtgtccagtttctccacaacgggtgcatgcctttgatccgaagaagacacatctgaaactcttagtccaaacaaatgtctctttggttgatcacttgattttcttcgccatcaatcgctaggttatttgattcataatagattatgagcttacggaaatgagaacctaggtctccctaatcaacaacaaaatgtacacaactcacagcacttgcaatcttaacatggatccttcataaacttatcaaactcattcattatctcatgtttctctgttattacatgattgacggggaacaactataaaacaaaagtatttgaacactgatataagagtattatggttgcttctgactagcgctatgcttaacaggtactgcatttgctccagtgaccacttggcgattggcatgtctgcttccttaacaggtactacagttgtaacagacaataactttcttacgctcgggttcttcatcttgtacttgatttcttggctgctgtgctggaacgtccaaaggtacaatgccgatactggcctctgtcttgtcaactgatggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctacgtttctcggttttgggcacttgtcggcgaaatgacccattccttgacaattgaagcaacagatatcttcccggactcggcattttcttttctcattttgattcctctgtcctggcactggatttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccatttcatcttcatcatctgaggagacttgatctgaatcttcactatcagacactctacctccattagctaaaaggtgctctgtcaactgtggtgcacctcggaaggtatttcttctctgacgttttgtcattcctagtggaggccattttgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgtcaccatgggtccttcgggatgctggcggcatgctgacttgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcattcactcgggagctcgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtgtgttaggcttattctgcaagttgattaagcaaacaacctagcatggttacatcacaccccactgatgcaaaccacgcgctacacacacaagcaaggaaacacacgactaacgactctaccctagagggtggcttaggttctgtgacgggttctcaagatcttcactcctgcttcacagctggcttcactgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttataaaatatgtccttaggttttatccacttggcttatcctacagtcgagatggctctgataccatcttgtcgcgaccgggaaaatttcattttcccgaacgctagtgtattaatccccgtcccaggaaaagccggggtacaccatacaaacatgatataaaagacacatcattattatatcgataatatttacattattacaaaggcacttaaggcctgacaatcaaaaataaacagcagcggactagcgggcctacggctccatcttcacaggtgctcaactggggtataagccaagactccacctaagacttcttctccaaagcttctcttactgaaggggggagaaagatagagcaagaatgagtacaaccatagtactcagcaagccacaccggcagatgcacgactaatgcaagggggtacaaggggtaatgatataggggttaagttttgcagaaaacagcatttaaaagtcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagctcgtcccaagccaacccaggccaaccattccacatttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatcccattccacaataaaccaacaattccaaagtgtccaggtgatatgaatatcccaaagtctagagttgtaaaaccgcctaattttacctaattaatcagcgaagcatctacctaaaattatactagtggtactatgggtagagtgtccactagttggggttttgtttattctagggtgaacaaggaaataataacaataacaataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagtggatcttccgaagctgcagcgtctacacgacgagcggaaaagaaaaggcttttactctaataaactccatataacaagcagaaacaaagcacaaaaatgggttcttaacttcttaaggaaaaattagagacttgaacggtccaattccgagttcaaatggccaagttatggccatttgaaggttatatgctctttaaatgaatatttgcgaatttcttcatttaaattttaattcaaaattggatttattgcgtcagccgaggggaggggcgcgcggaccgggtccatgggagtggggcccacgcggcagtctcacggtccacggtggaccgggtgcacccggctcacaccggccagcgccgtgggtccaatgcgtcagccgcacccgagggtgcgggcggctgacggccgggccccacatggcagccgcgggacgcgcccgaaggcggccacgccggcacagccgacgggaggcggcgcgcccgcgccccgatggtcgccgccggcgaccaccggcgcggcggagcggcgcccgagagaggggagggaagggggaaacgaatcggcggtccacggctcaccccgggtcgacggcgacgacgggaacggcgactggagcggagaggggcggctgcgtggctcgggttgaccgggacggcggcgttccggcggtcggcgaccgaaacggagaggtggacgaggtcggcgaggttgcggcgaagccgaaggaggcggcgccgaggcgggagatggtccggggcgaggacagcggcggaccggagctcggcggcgacggcggagagagagagcgacggcgcgagctcgattccggcggagagagagtgcggcgagtggcggaaacggcggagggaggcacggggagtgtttatatagggttgggagggggagagagcggccggatgagggggaaacgggcgcggaagatccggccgccattgatgcgccggcgaggttaggggaggagtttccaaacgaatccgagggagagagggagggaaaaatggggggggggggaaagagggagggaatcacggggaatatttcccccctcttgattgcacgcgggacggacgtaagcggcgggattcgcggcggcggcggcgctagggcacgggcgaggcggcgggagcggcgggaggtaggggatgacgggtgggccccacccgtcagcgagggcggcgggcgggcccgcccgtcagtggcgcgcgcgcggggagaggccaagtgggtcgcggggagaggagggagaggggagggagatgggccgagccggcccaagggggagagggggagggaaagggaactttttagagtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagaaaataatttttatttcgggatgaatttatcaggacgtgacaaatccaccccccttacaagaatctcgtccccgagattcgaggaggctagcaagaagataggttgggcggtcttctcttcttgtctgacttcttccgctccgtcttcacaaactttcagcaaaacttcaccactcggaactgcttggcttgacctcctgttgcgggtggaatcttctcttcacctgacttgaaccagggtgcaccttttagctgactcagactaggttgcggtagtttaatgatgcttccgttccagaacttctcatgattcatatcttcggagtcaacctcatacaagttaccacttcatgtcatgcgtcgacactagcttgtcattactaggataccatgtttgtcatcataagaatatcatgcttgtcattcacttctaacttgccaccaactgcctcatattagctttcccggtctccgggtaatagctacttctgctatttgatgcaagggtcgataactttgcctttgaattatgcttcccaagagaaccaacttatcccacttgacatactttgacgtcttcccaaatggctttattgctggatttgttattgtctaatcattatcctgccaaatctgaggcttcgttgttagatgtgcttttaatctgacctctgtagattatcttcgaacatatcacttgattcataactgggaatagctctcacgaacaagcaactcggattcactttcttt

SEQ ID NO: 30177 - DNA, 2237 bp, Oryza sativa
tttttataaaatcattttaactttgtttatttcttaataattattatttgtgctctgaaaattccactaaaatttgagggctccttttagaccaaggagaatttaacaaaaattctccgggccacatttgaatttttcttttacgtattttagtgtttgccaatttcttttcaaattttaattaattctattattccttttagaaaatgatttttatttcgggatgaatttatcaggacgtgacacaatttcctcttgtgggagtctgactggctggctggtttagaggtgtttggttgagcatcagaccgaatttttggtcctccactcccctgaccagtctactggcgaggtgatcagcactgagcaattgggggatctgacttcatcaatgcaaactcctgagcataatatttcgaattgtcaaatggcttaacaagagacaagagcatgcttttgagagaggttgaggtgtttgaatacataccggtggaggaagattgaaggcgttgtatggcaccaccggcagcaagtgcgaatagctgactacgataacgtttgagaagatcttgcacattctctccttcatgaccttaaaatcaagagagtctagatcttcgcggttttgatcatgcttgctgtcaaattcgaaggccgtacgagatctctctttaattggagctagccgactcttgataaaatgccgggtgatctgttctccttgcagaccttgctcctttagcttcagcatacggtccatcaggtcaagcgcctgtgcggcttcatcttcaattggcaatgagttccaagtgtcctgataaagtggagggagacaggagtactcggggagtgcaggctcagggttctgtacatagaaccaatttgcatgcttgcctttgttcgaggttttgaagggcatggaaaagtattttttggctcaaacttcccctaagttggaaaccagccccccctccccaacaacacatggtttactcttgttcggttggggcttgaggaagaagatgcggcggaacaaggcaaaatgcggcctaatgccgaaaaaagcttcgcaggcgtgaataaagttggcaatgtgaactatggagttcgggtttaagtgatgcaggctaaacccatagaaattcagaattccccggaagaatcttgaggttcgaagggaaaatccgctatagaagaaatgagaaaataccacgacttcatgtgtgtcgggggtcgggaacgcttcaccgaatgctgggcaccacccaatgatttccttcgctggaagaacgccgtgcgccaccatttccttcaggttttcctctgttacatcgaagggtgcccattggctctcgaagctttctctctcctccgccatggatgcgaattgggtgatgcgatttgctttggaaatggatgggagtggatgggggatcggtgcggttgttgcgcggaaggtttttgcggagttttggaagatggattggagcagatcgatgaaccctagctttgccggcgcatctttgcactgtagcgggaaatggggaaagtggcaagagtctcggcggggaagacgaagagacgttttatttctctttggtgttattagggtatcgggagtactaatgggcttgggcctaaaatagtacttcagcccaattctattatcagcgtggcccattgtgatcttgtcgcgaccgagaaaaatacattttcccgaacgctagtgtattaatccccgtcccaggaaaagccggggtacaccacacaaacatggtacaaaaggcacatctttattttatcgataatatttacattattacaaaggcacttaaggcctgacaatcaaaaataaacagcagcggactagcgggcctacggctccatctccacaggcgctcaactggggtataagccaggactccacctaagacttcttctccaaagcttctcttactgaagggggggaaaagattgagcaagaatgagtacaaccacagtactcagcaagccacaccggcagatgcatgattaatgcaaggggggtacaaggggtaataatataggggttaagttttgcagaaacagcatttaagagtcacttagttgcccaaagccatatataaagacgatcctagagctacacaatattattaaccaagaccgtgaaccctcacgaacctgccttaacccaaggtctacgatgattcagaccgaactggcaacccgaccatggg

SEQ ID NO: 30178 - DNA, 1076 bp, Oryza sativa
  unsure (1)..(1076): unsure at all n locations
aatagattatactctgatcagaggtgtacatctttacccacaagacacatcttcctcacgtgtaaccacgtgccacataccaccacggtatacgtacggaagacgtgacatagttcccacccatcctagccataaacaagagtaccgactcaacnccacctacggcgggaaccnccgggacaggtaggcaggactgagcccccagcagcaggacaccggccctgtgccatgacatctcgactaccgggccgcagctcgtgtagccttcatttgtcctagagatgtccatcgacccccgacttcgtccatctccatgcgtgtacttttgtttataaccagactgagccacaaactaagccttacccactagacatgtggaagtacggtagtgctttgcaacaaaggcccgagcttaatccttatagtacccgaggtacgactaacaaaacccaaccacgcacctcgagcccagcctaaaaccattttgggtgttttgaatagagggggaggtgtgtgtccacttccaacgtaagccaaccattacatagtgtccaaatgatatgagaattcccaaagtctaaagttataaaaccacctaatgttgcctaattaatcagcgaagcatctacctaaattcatactagtggaaccatgaatagagtacccactagttggggttttgtttatccaagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcgctttcccaaacgtcggctttaacctccacgaagagtggatcttccgaagctgcagcgtctacacgaccaacggaaaagaaaaacttttactctataaactcatataacaagcaggaacaaagcacaaaatggcttcttgacttcttaaagaaaaatagagacttgaacggtccaatttcgagttcaaatggccagttatggc

SEQ ID NO: 30179 - DNA, 3155 bp, Oryza sativa
caacatcatgtcaaccatgcgtcgcgatacttaacaagtacccgaatagagattgtgacaataccctctgcataacacaattcaaagcagtacaccattcctggatcataatcacccccttataaaacaaggcatggactccccagcgacccccgtgggcttatctccgccacttctctgtctggtgccccacaatgaaccacactatataaaaggtaaagccattgcccacgatggcttgtggttggcacgattaatgtttcacaaccgaaaatcgtgaaccggaccttaattgtcatgagcacgaccatcaaaaccatgtgctcacaacccaccattatcatgtattagttggcatcttaattaatcaacctatcatgattaaccatcatgagctaccactaaaccatcattaagtaatagtgaatcatttattatcccattcatatgagctagtgtctctatgcatggctaagcatcctaatcattttagccaaaaccatataatgttctagctaatccaattattaaccaagtgaccaagtataggtaatcaataacaaaaggctataacaaaggaaataggtcattcctacccgatgattgtaacaccccaagtaaccacgtacctagagtgccataccaaacatacactcaaaccactaactcccaaaattattagaaatttcggcagagtctcccttgtaaatacggacatccatgacaggcaattataagttaaactaataacaatatcattcccataatacgatccatccttataatccatggggaagaaactattaaaaatctaaaagattattacaagaccaaaccatgatatagtttaagtatcattatggacctaggcaatatagtttgatagtgtgcagataaatatgtatataagagtgctacttcccgcccatgcatgtcggtctcaatatgtacctaaaaccaaataaaacacaagagtgagtataaaaatactcagcaagtacaatatggaactagaaaacacatatacacatcattggcaataaagcatgaacagaaggctttctttctctgataggaaacacaatttcaaacaccaagtcaaagaagatagtagttcccatcccaagcaggcatgaattgaaatagtagtttccatcccgaacaatagtgaatacatcctaacatttgccggcaaaccgagtaagcgtgatcagtgcttacccacacgaacatgaataaagaaccaaattgcactcccatgactacgcatggtacttgaataattgaaaccggaatcaaagaaccaaattgaaatcatattgcacattcatggcaagcagggaacttgaattatttacccagaaccagaatccggaatattgaaacaagaataatgttgtaaacataggataaacatgaaaatctaaatggcttgaacaacaatatgaatataagcggtcacatgtcacatagaaatatatcggaaataaatagatagaacaaacaatccatcaatcacacacttagttcgtcatgcacttgcctccaatgaagggttgatatcatgcacgatctgaaggaccaccacctaatcacaaacaaaacctcagcaaacatattcaaacatgcatataaaacaatgaaaaaggttaacctactgccccatcccatcaaaacgcaataacaaggaacgccgcttgcactataaacaatattgttgcttcaaacctttatatcttgaaatatgaaaaggctatgaccgcaaataaatacattttggaaatctacagaacaaggcctacaactcttatgtggaaatcatatttttattatgccattaaaatggtctaatttgcgcttgaaagcaggcttcacaatctgtccagaatttcagactatccgcactaaaacaatcataactggagttctacatgcccaatcagggtgtactttaccaatatggaaagctaagaaaaatctctacaactttatctataggcgtcttggctgattccactatttatcccgtccaaaaatagttcaatctactactatccagattatgacataaaaataacagttatactcaaaaattcgtatcgtctaaaccacttgagataaattcgcgccctttggtcagaagatagatataaatattatctacaacttcctagttgtacactttcacataaaatatcatttagatctccgaaacttcgaaaaactgaaacactgtaaatctgccaacgtgcagaacagccaattcgaaccacaacaaacaaaactccttctctaaccttccttatccacgaattaaaccgctataaccaccctagatcaactgatatgacaagagaaaaagcctcacctagggtttctttagataacttgtgaggagacaataggggagactctgatctaacccctccttttactcctctccacctcctcgttccgtttttccactttgcttcttgatccaagctataaagatggagatctagggagagcaatttgctgtagaggggagagatgcgaacacaggaggatcaggaggagggaggcgccggccagggagaggggaggcggcactataaggggaggtgggattcggttcccctctctgttttaggggagaactaatgggctgggtttatgggccttctcatgttggcccacttctaaagatattttttcttttgtttatttatattaacatctttattttaacaagtcaacccaactaaaaacctaaatatattttttttaatatacggggtattacattcctcccccttcaatcgaattcgcccactgtagagcttgagaaacagtaaaaatgaaaggaatacacaaaacatacatataaagtagttagtactctcaagcaacttcgaggacatctcctatattcacaacactgcttgcgtctaggtatggtaggtaataattaactagcataagaaagtttagtagccaacaattcaaaaacagctaataaacctactcagacctactagatgggaatattggcttgccaaagaagcacaatgcacatactaaaacacccaattggggcatattcaagaatcattggaacacatcatgaagaatctcactacaaagcaatggaacaaattgtgaaaacaaccttt

SEQ ID NO: 30180 - DNA, 9019 bp, Oryza sativa
aaacactcacacccatcacatcttattagtatgttgctccccttcaacaactaaaagtctatctttgattgtcaattattcggaggtaataaacaatatctacgaagtcaatctcaaggaccataggccacacttgttccacttagaatgaactttctgagtaactatgacgaaagcattttcctcaaaaactgctctgaacatcaatagatcgtgaattttctatgaaactcaaacattccaaagtaaaggaattaaatccactcaataaaaaacaatttgttgggtgcatgtaattgaaaagaaataatcaaacatggaaggtcaagcaacaaaacaaacaacataaaaaatgaatatttagtcgcaaacacggttttcttaagaaatctgagatcatgaaaatgactatttgtactaaattcaagaatcacacgtaaagacaatggaaatatttagaacatggaccgagtataaaaccactttttgaagaaaatgcgtagaaggaagcatcctcttcgacttgatttttttaaaaaaaaagataacaaaaaggaaatatatcttttaccataaactcatgaaccaaaaatcaaagatttggagtttgtttgtcacctcaaactgcgaatccggaagctattctataaaaaaattcaaataaagattaataatcaaataagtgtgaacttcaatccaagaatatcaatactgcacacagttctgtgccatgtaatgaaaataaatcactaggtaaagaaaatcagatttgatacaagttgtccataacaagatttaaattagtattttcaaatagcattgtgcatatcaataatttataatttatcagtgcaaagcaatcacgcaacacttatgtttgaactaaaaagcgaatgaaagccacaaaagtgaaactaaaataaatatttagtgttaattcttttctgaaatctggagaatatttgtcacaaagtaataaatgcaaagtcaaatgttttccatttggaattatttcagaacatgtaccacaagtgagaaagttatttttttcatttcctcaaccatagtcacataatagaactcacaaaaagaaactaataagccatatcgcccttgaatctgaagactgaaaaatggaacttcctcttttttttttttgcctttcgggtgaagacatcactacgttggtgcgtcaggcataacacatagacaaatcacaccactgtaagaaaagaatagaatgagtagatggcatgggggccaatccatcccatacccaaactattaactcggtacgttgatagatgtatcctgacctaacactcacactcgggcaacctcacttggcattggggaaaaaaataaagagtaaaagtcccctcctctaaccacattacactgcctatatggaagaaaagttacctattcttaaaggatcattaagtcttataggatacaacattaattacttctataaaagagattaacacaagttagagccatgatcaaaatagtttaattaaggtctagggaaactaaaaccttatcatgtacactcacatacctcaagtataactcattattgcaaccccatgttgttctccctaatagctttccgaatatagttattcgcaaacgttaatctccacactatacaccgcaccaatgtatcaaaactgaataatttttttatacctcctagctttacttaatatacaattagatcttattcgtaaaagagtatatatatcgagtaacagcataactccagaaatcactaatacaatgagatagagatcagtaatcaataaaataaatcaaaagtgtgatgcaaagaatgacccaatcccatcctattgtgcaccagtgtgtcagattttattagtttaaatctaactcaaattttacttttattttccccatcctaaggaaaacatgatcaatattttaagttgtcatacttacttcccatggacctaccgcccgctctgataccaactgtaacaccccaggtaaccacgtacctagagtgccacaccaaacatactctcaaaccactaactcccaaaattattagaaatttcggtagagtctcccctgtaaatacggacatccatgacaggcaattataagttaaactaataacaataacattcccataatacgatccatccttataatccatggggaagaaactattagaaatctaaaagattattacaagaccaaaccatgatatagtttaagtatcattatggacctaggcaatatagtttgatagtgtgcagataaatgtgtatataagagtgctacttcccgcccatgcatgtcggtctcaatatgtacctaaaaccaaataaaacacaagagtgagtataaaaatactcagcaagtacaatatggaactagaaaacacatatacacatcattggcaataaagcatgaacaaaaggctttcttcctttgataggaaacacattttcaaacaccaatagttgaatataaataatagctttaaacaggatcatcatgctcaaagggttgtttgggatctgtgtgacttgccttgctggccttggaactcttcaaaatcttctcctgcaaaatcggactctccgggaacgtcggaatctaaacataaaagagcaaaatcaccaaaacagtacataaacaatcataaacagcatatgtggatatttttaacatgtagatctcagttttagaaaaatttagagacttgaaccaactaaatctgacctaagatgaatttgttatgaatttttaaagattaaaccggattgaatcatttatatagaattatttttgaaaaggaaaaaggatttattgcgttagcgggctcaggttcacggtggaccgggtgcacgcaaatggtctacgaaacaaacggctgagatctaatccaaaccgaacgaacggtcgagatcgatctaatctaccacgggtctacggctgacgtggcgctgacgtcgatgatgacgtcatcaccggcggcggctcgacacctcgtgctcgccggcgaacgacggcgcagcggcgcaaatagaccacacctatgggtagagggcgacgcggcgaactcagcgagggctcggacgacgacggacggcaactgacggcgacggcggagaggtcgaggcggcggaggcgttcaggtcgacgatgacggcgatgctccggcggtcttcggcggaaatggaggacgggacggggatggtgacgacatggcgaacccgacggcggccttcccgagcgacggcgacgacaagagcggcggcggcgcacgactggacatgcggcggtgacggcgatgcacgggctgacgcggaggcggtgctacaagcgacggcggcctaaggcgaaggtggtggcgaaccgaggaggtctcgggggtccttatataggggctagggggcggcggctagacccacggcgtccggcggcggcgatggaaggtttagggttagaggagagaaatcaaatccgaatcgagctcaaatctgatgatttccaaacaaaattagatgaagtttctataggggaaaagatagaggagatcaaggggatcatttcccctctaccaatttgatcagatcgggaaagatgcaaccgaatttggaaggggcggcggcggcttgcgcgcggctagggcgcggctggcggcggaaggaggaagacgaccctggcggcggcggcggctaaagttttgcacggaaattcccggatgcacttataatgggatggagggagtagttgcgaacaacccatttagaaggggagtgcttcttatacttgctctcccatagtacgtactcgacgataccccgcgctttgctgcgggatatatgttagatattggagaaatgataaaatgatttggattgaaatattatgaaaatgatttgagaaagataatttagcatgtgtatgtttagttttagaataaaataaattgtagacatgattactatatacttgcattgtggagctttgtgtgcatgcttaatgggttgacgtggtatgcttgcatgtaggttttaggagtgctaataaatactatgcttgcatgttgagctttagatgtttagtgggtattagctttatagaaacaagagatacctgtttctggatgaaaataatgtgcaccttaagatacattcagttctctattttgtgtccatgtttctataagtttctctattttgtaaccaaatctgtttctctatgtactcaacatgttaacatgtattccagcgaactttcagcgtattctgtagaggctttcagttgcatgatttggttaccatgaaatatgtctttattttttactaaaaccaagattaaggctgtgtttagataggcccaaagtgccaaataaatcggtgaaaggggtgtactcgggactttggatctaaacagggtgggaggtggaattcggccatttcgcacattaatggcccaaacagtaccctaggggatgtgtggcccgttatacctctgggaggaggcgtcggcaccgctcctatccattccccatcgcgtcgtcacacgcgcgacccctagcttgctctcccccacctccgctcactgtccaacgcgtcgccgccgcacaaatccaagccttcccccggcgaatcggagggtaggtcgtccatatccatcagctccgcggcggtttgtgggccaggatcaaccggagtgtgcgatggattcttacaacggtgacggcgacaacgggggcggctacggcgacggccatgacggaggcgggtacggcaacggtgacaacggaggagggttcgccgacggcagccacgtgagcgggtacggcgacggcaacgccgtgcgcgtattcggcgatggcagccacctcggcggatacgtgccggacagccgcttaggtgcgtacggcggcgggaccaccggcccgctatacggggctgagcatcgattcggcgccggcatccctactcgcgacttcctcggtcagcctctccatgcgtcccgagatggcggccacccgtcgttcagctcgggtggattcggcgaggggtcttcgagcagccaaaacccctctcgtctcgagttcggggcactcgacctcaactccggcgacgactggtcgtccgtgcacgcctacgaagaccttcttcgaggcggcggtggggagggaactcaatgccctcccggcgtacgcgttcctgcccgtacaggaaatcgcacgctcaggctgcgcgactggccaagtgctcaaggggcttctggatctggggcgtgacgtgcccttccgatgtcggctggaggactcggcggatcgcattccgttgctgctgggttcgaagcgccaatggctccgcattccgttgctgctgggttcaaagcgccaatggctccgccatttggaggtacaggcgaaggaggcgtcttcgtgcctccgatccggccgccagctccggctgcttctcagggtagaggccgaggtaggggtcgcggttcacggcctcggtagacacaggtacgtccgttttaagttcttgcaatgtgtggattggcaattgaacatattcttgtgaactgcttcgtttcattagttgctatgtattatagttgttgaaccatgtgaattaaagctactgcaatacttgcgaaatgtgttagagctacggttagtccgtatggttactgactttgactttgttgctcacagttcttttgttaagggttagttttacagcaatgacatacattgcagcacatattttagcattaacatgacatagtgagatgagagttcattgttataaagttgtttaatttgcattgattgataagtgcgaaggtcattgcttcgttcggtttacttgtgcatctaggatgtcaacgacagggcaaattggacaaatgagaacaccaagcttttttgcgagctttactgcaagcaaatagatagggggaactgcttaaggggaaccatgaataaaactgggtggaaggagatcatgaatacaggggtttgaaaaatatgtggacctttatacagaaattgcgtacagacactaggttaggccgcaggcctaacggtaccgtcgttgcttctgagaagtggtgggatgacaacacgaaggtacaaaaacttcaatattaagttctgcactttcattcttgctctttcccatgcatctgactgctgccttcgttttttccaaggccatcctgaattgaggaagctgaagaacgggatgcccgaccatctcgatgagctggaccgcatgttcatgggggtggctgtcgacggatcgacttcatttgttcctacgcaccgcgcatcccagccggccaaccccattgtcgatgttgaggacagcgacgatgacgaagagtccgacaaagactacttcgaccccctaagccctagcagcgttgggacgaagaggtcgcacagcatgaggagcacaccaagcactaggagcatggcaactagtccgagcaagaagttgaagagcccagccgtccgcgccgtggtgaaagaaatgcaggtgcgcaacaatcttcagaaggacaaagcgacatcaattgacaccctatttggccgtttagaccagaggagggatgatgatgacgctcgcgcgcggcaaaaggccgagcgcatcatggcactctgtagggagtgcagggtcacagaggcgacaccgcccttgtgggttgccatgttcaagctgctgaaggatcgagatgcaatcaatgtctttgagctgtccaatcctgaaggaagaaagaccctccttgagcacctcgcacgggtcgacaactagaccttctcatgcttgctttacatgttaatgtatcagccttagttgtgtcttttgggctgtgaggtgctttctgtgttagtggtgctatgtccgttagcattgtccttcaagtaatgtgggctactgttgtgtttcgaactatgtcatgcgtaatgttggcaattaaatgtaagttgtagtatgtctgtcgttccaaattcatttcttacttatgactatgtatgaaagttaccgttgttgttgtaaatttttacaggaggacgtgcggcctgatcctgcggatacaagcgaagaagtttccgacaaagatttggaaataattctggtggaatacttcatggacgattctgcggacaccacgttcctgtacggtgcgtattttatcgctactcacattgacaagtactgcaaccgctctgattatagagatcatagcacaactatgagtggtttggaatgggtagagcataagcttgcagataggaagcggtgttacaacatgtttagaatgacccctgatatgttctatagtcttcatgatctgttggtcgacaaatatgaactcaagtctagcacaaaatctacaagtattgaggtgttaggaatgttcctttggatgtgtggggctccacagttggttaggcaagctgaggacagatttgagtgctctctaggaacagtgcacaacatgtttcacaaagttttggcaagccttttgaagctagctgctgacataattaaaccacgcgacccacagttcacaactttgcatggaagactaaggaaccctaggttctatccttatttcaacgactgcattggggcaatagatggaacccacattcctgttcaggtttcgaaagatctgttggttcagcacatgtgccgacaccacattacaactcagaatgtgatggcatgttgtgactttgacatgatattcacttttttgcttgttgggtggccgggttcagtgcatgacatgagggtgttccacaatgcaatgagtacatacagtcatgttttccctcatccacctccaggtacacagctacctgttgtaattttgcaatgtctaacttccataacgtgtaacttacaggtgattaccgctgcagggaagtactatctagtggactcgggatacgcaaaccggattgggtacctggcgccgtacaagggcacgaagtaccatatcaccgagtttcaaaacgcgccagaaccagaaggtaaagaggaggtatttaactacgcacattcctcccttagaaatgtcattgagcgatcatttggagtactcaagcagaaatggcgcatattgaaatatgtgccttgttatccccgtgaaattcaaacacatatcatagttgcttgcatggctctccataattacataaggcttgctggtttaagggataaacactttggtcgttgcgaccgagatgagaattatgttcctcctgaggcctatgaagatcagccaccggaggacgaggctcctagttacttacaatgtgaacatatgaatgcatttcgtgatacacttgccctcgagttgttgcatcgagcatgagccatttcaaccctaggttccataaacttgttctctcatttatttgtatttgcacttgtcttgccatgtgcttcatgtcaccacatggaagtgttgttgtaatttgtgaggcttgtaatcttctcctgtaatatgtgaggacttctgtctgttacttgtgatgttagagaacattttttcgcgacggcatagtcatggatgtctagtgtttgtggagtactttctgacaattttcagctgagctagcaacatgtgagctccaaccgttgcaatgtaatttttcacagttttatctacggactgttgtaatttaaacttgtatgacaattatttgtaaggattgtttttgttcctattttttttgcatatgtgcatggcgtggatgtcagctcttcaattgtcatgtgcaaggtgcatgcaatttgacagtttgaatgtgtgtgcatgaaatttgaacgtatgaatgtgtgtgaatgcaagttttgtgtcatatgttttattcatggagctgcattaaatagggttacttttgtctcttttcaaatttcttcattccatccttcaaatttgggctgccaactaaacaccccttgcaaagtttgcaatttgatatgtc

SEQ ID NO: 30181 - DNA, 9461 bp, Oryza sativa
  unsure (1)..(9461): unsure at all n locations
agttgtgtcgtgggcttaacccaagggggtgtgcaccttagggcaacctaagaaggtccggaatcatatttattcagtagccatcatcgtctagagtcgggttttgcttacattaatctgtcaagaatagtttcgccgcttgatcagtttgtggaaccccaaattcaagtgcttaatcattcatatgcaatttggttgcaatctatcttattcttccttgtgttcttcgtttcgcatgcagggattagccttctcggcgaggtcaaccgcgtttcggcatagttgataaccagaggagatgtggtgctgcaattatgtggctcagtagcgtgttcgttcagaagccagatcgagttctgtcgcgactccacccaaatcaactatttatcaatacctaatggaagatcggaacctaacatccttatcagttggtatcaaagcgcgattacccgttaggtaatttatcttcccacaactagaaaattgccacataaaaaaattttattctttacctaaacaatttgagcaattgcattgttgtattagattttgcttcgttgaattttagattgcatcatcgtgtcaactgctggtttagttctagatttaatttgtagttttgagtattgcgtctgtcatcacattgagtctagggttgatcagtcaagtcggtgtgagttgtacgtcaattttgggtccagttttgcatttcgtcggttgttgccgggaccttgaaaaattgaatctaatcattgtcgggtttccgtttttgggatttggagaaatttttgtacaacggttttggagttgctccattcaagaagttcctttattacagttttagtgcgcgtcccacccaccccccacaattcgtgtaagaagactagtcccaccagcaagtgcttgtgctactccccaagtaatcacgagcatccagatctgtttcactcattttgatacttgtaagctgcaattaattgtttcctaatgaaatacatcagcacttggaacagatatccagaccgtctgtttagctttgattcctgctgcctcccttttccattgagccttattgatcaaatagtgctcgaaacaaattctactggctcttgaactttcaccttcatatgatgcaaatatatgatggattgatgggtcatacctcacaaataaagcgggagggaaggagggggggtggttacacagcacatgggtgataaccatcaaattatatacgtatataaatagagagaacccattatatgccactgactttatcacgttctataatatgccatcgacttttgcttaacttctacgatttaccatcgccgtctggttagtctccgttagtactgtacaaatttgtcaaactgaccaacatacccctgggacaaaactttcaaaatttggataaaaattctgaaatatcagattttaagtttttgtccaaattttggatgtttacaatattatgtttataatatgatatttttgtccaaattttagaagtttttgtcctaggggtattttggtcatttggaaaacattgtacggtgctaaaggaggctaaccggacggtgatggtaaatcgtagaagttaaacaaaagttgatgacatattatagaatgtgataaagtcaatggcaaattgtagacgtgtgacaaagtcagtgacataatggattctcttatatagtattaatgttcatgtagatgtagctagataagaaaataacatctgttttgagatacaaaagaaggcttccaacctctcataaacaccaaaacaaggcaacatatgtttactgttttgccgtacacaaacaaaaattacatctcagttgacttaaaattagctctacgagtactaataccatagtaatgtcattagaactaatccttgatgccaaatatctttcaatagaacttaccaaatagtccgcaaatagtcgtctcctattttatttcgaagacatgtttgcactattttcagagctaaaaatgctctcagtggttccagttgacacggagagagtcaagactgatcaattgttccttttaaagagaaaatatagccggcaataagcacggtatgtgtgtggtaaatactctagccaaataaatagattaaaccaattgcattagaatctataagagaaaagtatcaactgtattattcgtaatgcagttcaaaagtacgatttcaaaaaaatatattgttcactggtattgcttaaaaaacttctttcagtctatttgttatctctatattatataatatataatttaccaggaattatctagaatttgcatgcttaatcatctttaaaagaagaagataggcttagtttgtttccgaaacaggtttcacaaattaagtgtaaattaaaagtaaagtgttttctttttttataactgattgtttacggattcagttttttaaccaaatctttaaaaacctattgttcaataaatttgctttatttgtacaatcaaactatcgccctctaattagttcatattaatgctatttgttgtatacttatatgtaagcatctaagcactgaaaaatgatgcgattgttatgataactagaaaggtagcccgcgcacatacgcgggcaccttcttatataatgtgagtgaaattttattatgaatatattatgtgcaggtggctttttattaaaatatcttgtattatgttctaaactaaaattaaacttattttgtgtgctttgaaagctagttatatttttataactacccttgcaatatataaattctaaaataaaattaattgagaccatgtggttttgaattgttgagaaaatattgtgtcgaaacaatggaggtggttcctataataaaatttacggtattttaactcaccaaaaaggatatcttacaacctcaaaagaaatccaataatatcatttttttgtttgattgtattttaaaattacatatatatatattttttcattctaaccatccttgtaaaatgtttgaatttttctatcaagtattggttttaaatccagcaacatttgttcaattttaaatttattccatgtccatttttttctttgggatagtttcattctatgattcatccttgaaatgatttgatctttgcaattttgggcaaaaaatataagaacacataacctagtatgggataaagggcatacgttctaaattttctctcctgaaatattgaagtaatggtcataatgtatttagcgaatcaccactaaagtgtattgttttataacaaatacatgtttctagattgttctacgtcaagactttacaatgtattgtagcaagtttaataaaaaaataaaaaagggcatagtcaataattcctatatggaattgacttgatttattgctaaggccactgcaaggttgttccactgttaaaatccttgggtacaacccatatgcttatcggtatgatgttcaaccaaccacacctttattttcaccctattgtctatattgctagatgaatacctactatgattagtgacttcgtagatcatatgtgtaattcagaggctatgatcatctttcttataactacttatttatgtcctaaaaacatcatattaaaagtatcaaggtcaatttgtataggcatgtcaagagaaattaattaagttggcaganagttgttagatgcccaaaaggatataattaatagatggaggtccatttgtgttttttaaccatatagataattttaattttaattgtcaaggagataaaaaaatatagagaaaagaatggcgcacgttgtacatgggccgagaaggaaggaggtttgggaggtttctctaaatgattaatctaacaaaaaataatgtgtcagatgtttatgttgaaactgatggtcggatgttttgttttcttgtcagaattttattaggattttctttgatttaagagaatgacgtaacatcttaagagcatttataatatctgtaatagacttttaacaccgtatgccgcaaaagaaggagggaagaaggtttagggtgctcttttttaaagaaaaatatatctaatgacctaaaataatgtgtccatcaatttatgtcatatctaatggttgggtgtttttcttttccaaaatttctaagatttttctctaatttaagaatgccatatagcagcttagaggcatttataagatatttaatggattttaacaccgcactgggatggggagggacagagagaggtttgggttttttcttattaaaaaactaacaaatcaatagccaaatgttttattcttttttaatattttctagtattttatttaatttaatagcaccacgtagcagtttagaagcattcgtaggatatttagagtcacagagtgagagctgctagacctaataggtggaggtctctttgtgatctttttaatgtaaaaataattttgattattatttctcatgaacatagctcgttggcacgtatgtgacaggacgttcggaatgtgtgctttttaaaaaaaaaagatctaaccttctaatataaaaataatggatccaccgatttttaaataaaaatcgatggttggattagattgccacttggcaaccctggagcgtttgtaaggtaccacttggcgaattaagagtattcgtaggattgttaatgaacatttaatatataattgtctttttttgaaatttctaagattttctttaatctaagtatgtcatgtgacatagtagtttagaggtgtttataaaatgtttaatggattttaacactgcacgggattggggtgggagggagagaggtttggaatatttttattaaaaaatctaacaccctaaattcatcaatttaattagaaatcaatagtcccgttgcttttgtnattttttaaaaattttacccacataggcgattatacaacccagggacgagacgctgcaagttgcccctattgtgtgttttttttaccctgtaaaagtatttttgtttttattttctcattaaatagaaaataacacatgaatgaggacagaagggaagtacgtatacagtacatatgtacgtacgttcgactattacgtaggtttgtacgttggtttcgtatgatggttccggatgttcttttttctttactagaaaaatgctcgtgcgttgctacgggaaaaaacgttttttatcctatacattatattcccttggttttggaccggatgcttctttgtttttggaccggacgttcattccttcctttctttttagctctagtcctagagtagtccgctaactctaagctgctcggtctatctctttttggctcagcccacaagtgaaactgtagtcttagctcgaacatttccgtgcctggcctacctcttttcggctcagcccacatgtgcagctgtaggcctagcttgaacagtctcgtgcccgtaccatgacggagccgatcctcccatcaaatccggtaatctggtcgagctcacatagttcagtgtccgtacgatggcaatcctctccgtcaaatacggtcgaatctttctcgatctccaaaattatcgagagattttgatccactcgatcccctttttcgttttttaccaaaatcaaagcaatccgcanaacttggaaaaaaatgacgaactgaaaggaaaattcacgcggaaaatgatgaaagagtagtggagaatcggtttttcaatctattggataaggaaatacataaagatgcaaatcgatatggcggcggcgctagggttcggcccgacgaaaaaaccacacaaaaaaagcgaaaccagaaaaacggtgaaagaaaaaacggcgcaaacaaaataaaacggacgaaaaaacccgaaaaaacggtgaaagaaaaaagcggtaaaaaataaaataaaacggaaaaggaaaaagaaaagggaaacggacaaaaaaatttattttatttttgccgtgacgggctttctttttatacaatcgttttttcagcacttttttttccgcttttttaagtaaggataggaatcggtcagtttttttttccacactttttttttcgccctgggcttttcttaattacgatcggacttttttttatatttttttatttacggacgaaggaaacatcttgaacgtagtatatatatatatatataggagatagatagataaaatagatctaagtaaatctaaccatccaaaataatgggtccaccaatttaaataaaaatagatggtgagatttctcttaattattatggtgtgccacttggcgacttgatagcgtttatagggtgccacttggcggtttgggagcgtttatagaaagtttaatggacttttagtatataatagatagatagatagatgggtatcctacttaagtgaatgctaagaactttttaatgtaagagttttatattttttttctataattagatcactttgctcccttttgtatttcctattttattttatacaactttattttaacttgagatgataaaatattaatgatagagcgttataccttatgtatcaaccattttctgtgaaaactcaatcaacttttgtgtaaacatctaaggctaaataggttctcattatttatttattgatggatttggggaaggtggggggaggattcgaggttggatcatttcttgcaagtgtgcaaggctccacccagcctagagagaacatgattggaaggctaaatataactgcgaaggcatcattatgtttggaatatgatttttttattgtttccgtgatttaaatttttgtatgaaatttataattaaatattaggaagtatgtactcgataccaatcactctacaaactttttgattagctagattgcactgggcatgaattaagtacaataagattatataaacatttagctgatgcttataatgtctatccacttgacataattaccatgtatttggtcatggatgtcttgaactcaatgttcagtcatgcttctcttgaaggttggttgcagctcctatctattcagcatgctcaacatagatgctctttttatgttgacgatgcggttatatatatgttcctaaggccaacagtgaatgacataactatcatcaagcaactgttagatgtgttcagtcatgcttctgggctagtgactagtggagtaaaagagtttccctgcacctacgtgtggttgcctctcaatattatgaaacctagcaaagctgagctacaattcttggtggataaggtggccaacaccttctatttggaaagcttccctcatgaatagagctgggagactcaccacactgaaagtagttctatgggccatcccgatttatttgatgatcacaatggatatccctaaatgggtgatcaaggtgtgaaatagataaaaggcgaagaggtttttcctatgggtcgggcatgaaagggctaactgtggtaattgtttggttgcatggtagcggatttgtcgacccccttatgtatggtgatttaggaattcacgagctcatgaatcgggaccttcgcattcggtgggtttggttgcaaaagatcaatggtgctcgagcttggtaaggattggaccttcaatttccaagcaatgctcatgctattttcaatatggccgtggaagcaatggttgggaatagtcaatccatcttgttttggtccgatcgatggatacaatacaggaccataacagaggtggcccctaatcttatcaatttggttcatataaaaaggttattaaaaaccgtactgtcgcacaggatttagaaattcatagatatggactacagaaatcgaaggagccctccctgtccaagtcatcgtggagtatcttcagctgtgggacttggtggttaaagtggatttgcatgatattttccaataaagtaaggtctaggtaagatcattaagattggtctactcactctctccatgcttctctctctcatcctagttcgcgcaagaaaatctttaggtttcaaggtataaacaaattcattataaattttgtgtatgtctaatatatgacaatctttagcttttactgtgtttgcaaggtatttagaagtattgagaggtggagtaatgtggactgttgatcgagagaggtgtaaggaacggaataaaatttattgtaaccgatggtagtgaagtaattaaatagtaaaacatgggcattttaagtggatggaatatttggctggactgaaccagtaccaatcagtaggaaaaacataaatcaggcattgatttatgcattgaatagatcttcacgggaaaaagatatcagatccgtcttctttcttcttccacattggttcgttcttgctctaggatttgacctaaattcacccaaaaggaacagagggagaaccgtcggaattgttgaggattcaacatgagacgagattgaccagtcaatggcataggtggagcccatcgggtgagatctccttgatgtcaattgattagttatttagatagtttacaaattccttcgtatgagagattggaatgagatctcctctgttcttctaatagggttcgaacatgtggaccagcaaggagacatgaacaagggagaagctctggcacagtcatgtgttcttttgaacaaaacataaatctatagaagaccacgcaaatgagaatctttacgttagtaatgtgttcttagaacaaaatgtaaatctagagaaaatcacacgaataagaacctcaaagaacacaatgtaaatctacacgaaacgacgcaaaagaaaacatgtacgctagtaccaggcaaatgacttaagtggtacctatgcggtaccgatttaaatttgaggacaattctgcccttttctctttactagcaaatttatattcaaactttgatacctaagtacctacactaatacttaaatactttttacatcatatatatatatatatatgttattgagaagcgttggatgtttactttttttggaatgcaaacatcgtaaaagctctcttttgttaacaatggttttcttgcacctcctagtaatcatgccgcagggttgtaaaatttgtttagatactgacacatggatgtttccatgttgtgcgcagaaaaaatataaatttttgttcatacctggaaggtatagaatagctcttagccccctgcatgtataagtataactacgtatggcatattaccagtccgtaaaatagactctataatatagtcggggcaacggcccgcttgcgaaaatggaagaaacgaacaaaaaaaatcgctggcccacgccgggagccgccgccacccgacccgcgccgccgccccacgccggagccgtcgtcgtcgcacccccgcgccccgccagccacgtgcctcgccgccgcggccctcccccggcctcctcccggccggatctgggaggggaggggaggg

SEQ ID NO: 30182 - DNA, 8844 bp, Oryza sativa
taatacaaatgtatagttagttggaagtattactcaatatatgagggtttgatatggagtatataatatggatgtttttttagtcagaagggacatgaagtaggaaatttttttttatgaccatctatatatgaggacatgaaggatcaaatttggataagctgctggggtgctcttatacaactttttaactagcagctatggcattctactccatagtggtgggcgcgtgcaattcatatgcctgggaggtgtctggcaactcaggaaatccttgtaatgctgtgcatcgtcggcaagatactcccccgggaaaagcattattacctccgtcccataatataagaaagttctagagttggacacaattattaagaaaataggtagaattaaatggtgaaagattgtatttggttgagaagtggaggtaggtggggaaattgaatggtgaagggttgtgattggttgagaagaaaatgttggtaaataagttgttatattttgggacaaattctaaaggctaaaagttgttatattttggaggaagggagtagaaaaaatgcacgcgcgatttagactaattataataccaactaggaaggtagcccgcgcattcgcgtgggcatgtattatagtttgtgtttcaaacgctataacgacaggatatgaaccggagaacatttgatttgtggaatataaatcggaaaggaaattcacacagatgcacaggcatcttatttgttattaaaaaaataatgctaaaaggaatcatatatcttaataatcatataatgctaaaaggaatcatatgctagagacacacactgtaagagaagttagattaccctacaataagaaaaaaaaagaaatatatttcccataaaatagatggtatattttaaaatacttctaccatgataagaatgttttttagatttaaccaaaaatacctttgtcctggtcatatataaactggtcgtttgtcatcactacttactatcattgttttaagagttaggtcaacttttaataaatgaacctgtattagtaccactaaaccaaataatacattattaatacactaaaaaattcatctacctgcatagcccggtgttcatcacttattttcgcatctatatataaatagtctaaatatactatatctaccgaataatacgataacactgtttaaaataaacataaatgcctctctaatggatgaagtcgactgtatctgcgaaagaaggcttttgtatgtaatgccttgaaacatataggttccacgtcgatgtagccatacccctaaaaaccatcctagagtgcaattttaacacttagtttactatcagtacactcacaaatgattatatggtaagtatgtcactttagttacactgtggcggcactgcctatggtgacctttcacggacactacctttaactaaaccatgtacatacccatgcaatatttacgatggcatagcaagtactgcaccctgcattcaaggacagagggacagaaaggaggagttgatgaaaatgcatttttttcatatgaagttagtaataagtacttctcaaattttaatggaatacatacaatattatgtatttcaaatgagtggggttaatcatttgacaatacttaataaaaactatagctaaaaagacataccaccatgagaatatgcaaaacaccatatcattatttatattttgataaagatttatactttagcaccaaatttgtttccaccatatgttgtaagcaaccatacgagactcatttactaatactaagaatacgagactcatttactaatactaagaatgtacttattttcacaaacttatttacaataactaattcgctagagtgcacttacagttgggtttagtggtgtataacatttgtccatcaattatacccggtatataagaatctctatcaactataaaaaatataacataagtagttttatgcgtattttattggattattcatgtttttccaatactacttggcaaagaaaatacataattcttgtgatgaattaagggttgtattgtagcaaattaactatctatcatgtatgcttctcactctcaaagagcaataaaaaagttttgaaaaatttcagatacttttagaatctcaatctcacccaaaataaacttaaaaagatccacttaaaaatcacatctaaattatgttgttttattatcactggctaaaatttaatttaatgtttctcatcaatctattaattatgcttctcacagctcaaataagaaaagttttgaaaaaattccaaatactttgagaatctcaatctctccaaaattaaataaacctaaatagatgtacttaaaaaaatgctaggttttgttattttaattattacatatgtagattcaagataacgctttatatttgtgatatttgacaccataaaatatgatatgaaattatttgaaacattattatcacatttgctattacatgctggtgtcatttgtgatgatatatttatcactacaataagtttatgattaattttaactgtgtagtattattttattaaaatcgtagattaaaggctgttgacaacaaatcagtgccggcacttatgatttttccttattagtatttctttctgattctagtgcatgttttctttttttattttttttggctttaactgttttttcgatcgtatatggtgcaggtatttaagttttgtttttttttgggagggagacgatcgtacgacacaagcactttatattttctttccgggatagagattagcggcatgggaattttaagagctctaatccaatgtttaaaataatgggtctactaatttaagtgaaaaatataaggttggatgcttttctttttttactctaaatattttggatttctttaattttaattttattagagcgccacgtgacaatgtaagagcatttgcaggtatataatagatttttagtatataaaagatttcaatgatttctctaatttatttgagagccacatagcgatgtaaaagcattcgtataatatacagcgatgtaaaagcattcgtataatatacttttagtatataatagattgatttagaagatggtttaaaggaacattgattaaatatttattatagatcttagtttaactaaacatactgatatttgtgaagtaatatattttatctttatattgtagaaaatcatattttaaaaagaccgttgatttttatgaatgcatatataaattctctgtcttttttatgtatacatgtgtatttgttttcttccagcgaagattaggaaattttatcgttttgttttcacaatcatgtacgtttgtatacatacgggaagaacagcagtagtatttgtatcgtacaaaatcatacatacggacagcgcttctatgttataaacaatacaaaagttattattttttaataatagatctgatctaatggtctacaataacgggtccaccaatttaagtgaaaatcgacggtgagattaaattgtgccatatggcgacttaggagcgtttgtaggagtgccacgtggcggcttaagagcgtttgtaggaagtttaatggactttttgtatataatagatagatagatatccaatgtaaaccttagtaaaattaaacatctaaaataataataataaggttgattgtttctagagacggatatccgatgatatgattctttccagtacccagtgaacaaacttactattaatcctcaacattttcttcgacacaattactgttggatctgttttccccttccacctagcaatgttttggctggggaaaacaggattagttactggttaattttctcactgtcgtcgaacaaagggcacgctcactaacagaagacatactgacttgtcagttggccaattttgctgactgatatatatagagaaatatatgtataatggtttctccagtcatttttcggctgacatagtgatcatcgtgtaacaagacgtagccagataagacaatcctgcggcgactagtgcttcagacgttggtgcaggtatttaatttgaagcgacttgctcctttgctaatataaactggtactataaatgcgctgaaacacccatgctgatccattgtgcagtgctttgcaaaatactcctgatgcctctcactcctatgcgtatgtgacgtcgttgatggatggcataataacatgaggaaattaagtttatacctagctttgtaggtgtatctcagagcacccggtgcaaccatgactccattcatgtgaattagtctacagtggatattagaacagatttaactgagaaagtatctcattcatgtgatgtacgtgttcatgaaagaactccactttgaagtactatttatagccagatattcattttcgtatatattcaggtacgccaacgtaatgtaacgtcccaggctcccagcatatggcattaacttttctttaatttcatcttgtactttcccaagtctttgtagatatatattagtgtgttcatcagaaaaagaaggtaatgagttcagaataaatgtgggagcaaagggcaggccagtttttaggctcctccctagcatgtaaaacgaagctcgtatttgcatgattaattaagtgttaacttttttaaaaaaaacatggattaatatgattttttaaaataactttcatatactcgctccatctatttttgatagtcatatttccaaatctgaaaattttatttttaataggcatattttaatccaataacttatcctcttaatgattttctcgaatttaatgtgtgactctccattcttccacacatgattggctacatgggtattgagaaatataaatattaatgaattgcttctttacgaggaatgactagtagcatgtttaaatggatgataagtagaattacttatccttggtctgtgtgttaagatgaaatatgactatcaaaagtagatggagggagtagaaatttttttataaatcacaccatttagcagttcgaaaagcgtgcttgcggaaaacgagagagctgagttgggaaaatagggggaagaacacagccttccatgtgaattagtgcaccgtttagtctttttactcgatcgaaggctgtttagcattgtgtatagcagctagctttcctgggcaacaagacgcgaataatacgcaagtcttccatgttgcttaggttaataagttggaaatggaaaggaaggaaatcgagttggtgcagatctgcgatgcatggggaggcatcaggagatgattttctagcgggagcagtacacttggtataaggcctaaacctgtctaatcatttgtccctacaatctatccacttttagaccttatacactaccccttttattactgcagatatagaccattgacactagtttccctctcatcttttagaaaaagccgctccacggtagtaaagtctcaacttctgtattggccggacaaggtatctccacagtagtaaactctaacattttgttagtgtttgttcaaatatgtgtataaaattgattacagtttagaatttggagttgtactggatatcgaaatagggtaagagtcagactctacccgaggatcactcttaaatagagagcagacctgttgtaactgcatgacgacaatggcaacttcacataagcgagaggtagcgactaccatcggtatctggtcgagggtcattgtaactctgataagctataatatgctggatgagagaggagcacctgtaatcagtacccagaagatgtagacttcagctgaaattcgttatcacatatcgtgcctcggtaacgtcatctgttttggatctcctatggcgtttctgccacgtttggttttcgatggtaatttcgggcttgctctataataagtagtattagagcctacaggagatccatggtagaggcgcgatggagatgcttgacatcccgccgcttgcggtttatatctagcaagggacatgtgagcaaggtggagcatgtcggtgagcaacgatttaatcggtggatcgaacatttcatgcggcggtctgaaccgttcgatagctgcaatcgacagaaagatgactagacgtagtgctcgggttgatggcggcgaaagcgattggcgatccattcggtgggtcagacactttgagcgggtggcccggactttcctcttagctactctcaacagggagatatggggccccatgctcgagttgaaagttgcaggcgatcagtgttctcagtaaatggaatcgaacactatgggcagggtggcccaggcctttctatgagccatgttctacagaaagatcgctagatgtagcgcttgggtcgttcggtggctggaaggatgacatgtgatttgtcggtgtcggctcgtgactagattgatggcattcaatcggacgtcgaaacagatggaccctagaggctgatgagggtgttgtcgactaagttttttaacgatggattgctatgaagacagtgtaccagcagcatgcgacatgcacagaattctacagatcgatggcttcgtcgatggcggagttgacggaaggtacttgtaaaggtgctcaaggctgcaggatgtacatgaggctcaggtggtcacccaatttaagggggtgtgtgcgatctatgtcgaggctgagccgagaaagtgacaagggacgatgtcggtcgtggcaggcttcaaagaagcctagatcgtgtgggattcgtattctgtgtgcccagttgcgatggagattacttggacgtggagctacactcagggtctgtttggggagcataagattctgagaagcaactggttgagccagcttctgagaatctggaaaagctgggtttagcttttggcttctagttcatttactagattctacaactacagtttcttagaatctggatcaaaatctgaactgtttggaggagcttctgattctgaaagaaactgcagcagttagaagctttcccatacagacccttagacacgcataccaaacaatcaaggaggaaacctagccgtacacgtattgggaagaacgaggattctgagatagtcatgagttgaactcaaacccaataaaatcagcatggattccatcggattgctacaaccaaagcaatcgatcgagcaaatcacaaggcaagggcaagaatttcgtgggcagcgtggtttgtcgacatgaacttgggcagcgggctacggcttcgacgagcagcagtacaggccatggaggagcttgacgcgggccggctccagttggtggtggcagcagaagtggtggcgtctggatccaggaggacgcatcttcagatgggggcgctaagcagcgctggatggggagaccaaggtggtgcggcggcgtggctcttgtgctcgtagttgatagggaaatcgttttccgatgcggccaaaagtgatttttgcatgcagacgggtggcccactagcaaaacggcatgcgaaaatccgattttcgcaagcagatgcttaagccgtctgcatgtaaaaataattttggcgacaaaacaattccgaaaacaaaaaccctagatctatataacacagaaaccctaatccgcggtcgtgtcacgtaggatccgttgccgtcgtcgtgccaggatccaccgtcgtggttgtcgctcgaggccgccaccatcactaccgacatggtccaagttgccgaggcccggcaacgatagatccgtgcgtcccaaggcctggtggcagcggatcccgctcacccaaggcctggcactagcagatccagccctccaccaatgccgccggtcgtcgcggaagttgtcgtcggtcatcgtagtagtggtcgccgtcgacgccgcctgcccgctcccaccgcatccgccttagctgctagagtgggatgggggagaggaagggatgagaggaagtaggagtgtataacaagagtaggagaggaaaggtgcggtagagagaatgagtaggagaataaaaggagcgggatattacgtggggcccacttactcacccctttgcccacatgcaaaaattgtatgcggtctcttaagaggtccacctaaaatataagtctattttcattgacggatctcttaaggaccgcatgcgccgtgaaccttcccttggaaaacaatctttacaggtgcgatcaattatagttcatctacaacttataagggtcatcgtacagagaattttttgtgtagtagtgtcagggtcaccaacaactcgagtcgaatgggtcgaaatactagggatgcaagtgggtagtcccgctacccacataaaaacccgcttgctagtctatttttcacatgatagtataaaatttagaagaaaaaataaactagaagtggcacaagcgggataaaaaagccgacttgcccactccgcttgcatccctacgaaatactttgtcgtgcttcatgggacgcgacctgaaagaaatgtggtacgaccttgagtatgcctcctcaataagaaaaatcattagttgggtcatgaaccaagaaattacggaacgatgacccaagtcgagaacgggttcagggttcgcgaacctaagttatgctggtcgaagatttcgaggagtccaggctgcatagagagcaacaatctgcatgagacttcttgtgtcagatgtgtccataagggcaagttaaatagtatagccaactactaactctaattcatttataaccaatctaatagctatacaatagttacatactacactattaatatctggtctcatctatcatacaca

SEQ ID NO: 30183 - DNA, 16184 bp, Oryza sativa
  unsure (1)..(16184): unsure at all n locations
attaaggagtcaagtactttaataggtctaggtgactgtttttagctcgttacttttaaaagcagtagtacctttctcttgtatctaataaaatcatacaagaaagtgaatcagaaagtgtgatcttgccgtgttcttcgatacaagagcaggtacaatagcattattataaatcagatataatcatattttaaagagataaaagatgagagaaaaacagtgggctacagatctatagccagctacaggcctacagcatggactccaagacataatgtgtatgacaggtgggaccagatattaatagcgtagtgagtaagtattatacaaattggctattaatttggccatagatgatttggagctagtagttggctacactattaaaccaacttactctaatgcatgcgtatgtcttctttgtgacggtggggagaagtggatagtggccagtagtataaggccagtctcaacccaaaacactagacatagtttacataaacttcacataatcaataaactacactactctttcaacgcaaacacaatttttccatacttaaatttaatgctgcttatctcatatgatgtattggatgttgtgtagaaaccatgtctcgtaccaaacttgtttcccttctctttactcatttattcacttgccgcatcatctttcatcctaggtgacagcttatttaatgctatagacaccatcctaatcattgggttgggaatggtctaagcctctacacacttacccctaggtgccatgtaagctcacatgatgaggtggatgagagagatgaaaggagagagaaagagacacctctcatataaggaacaacctctatacaaactttaagagatataagaacaagagaccaatgaattgatagcaaacaaataaatcaaaattaatatgatgtattatggtaagtgtgctagaggtaatttgttgtagtatatactccctccgtactttaatgtatgacgctggngactttttaatcaacgtttgaccatttgtcttattcaaaaaatttatgctattatcatttattttatcttgacttgatttatcatcaaatgttctttaaacatgctataaatatttttatatttatacaaaaattttgaataagacaaatggttaaatgttgattataaagtcaacggcgtcatacattaaaatacggagggagtagtacattttcattaatgagttaatgatgtgaactgaattaagggagactatcatctccactgtgaagcttgccctaaagggatgcaggctgcagcaggcagggccgacccgaggtgaggtgtggcgcggcatgcgtcgagcaagctgcgtgcgtgggcacgtgttggtcggtctggcccgtgctagctgggccgcgtaggaaaaaaagaggagggagtggactgggccggcttactgatgggctgaaaaataaaaggataggagagagaaggctagcccggcctgagagagaggggaaagaggacgatgaatagtgctactttattaataactagtgaggcacgtcgacatatattgaccatatacatccactgcctaaatcaatcatgagggttagtatgtggtaacataaatcataaaaaaactatgttctggtaatgttatcttattggaataaatcattcctgaagatgttgatagtaagtcccatatcaatcctcattggttatcttttcacatgttggcgagcttaccatatcaatttgaggttatgtatgtacttaaagatttcttgtttgatcaaatttattttgaatttgtaaaaataaacccctacccccatgcctctctatgacatttttcttccgtacactgacatttttccctttgcatatgtctgaagcagcaacaaacactgactaaacatgtcaacgtgtgtaagttattttcaagatgagccgactcacaactgcaccggctcccctgcatgttcacgtctttcaccaccggtttgctccgctccctgtgccaccacagctccttgtacaacatggccaccaacgtcgcctcctcctccacgccatcgtcgccggccaccgtggtgccgaagttgtggaaccagcgttggccgttgccgccgccgccgcgccccacgggttgtgtcacaggtccactcggtatcgcagccaccactcctagtcatcgtcatcgactgccgccgccatccaaacttcgtgggtggccacgctcgtgcggacgtgatgcacgtagcacagctcaccggcgaggtccgagagacggtcgtcgttgtgtcaggccgtgcagcccagagaggacgggaccgcgtcgaacgcctcatctcgcaggttgaatcacagcagctcgcatggctgagactcgttgatgaaccagtagaaggaacccccacgcgtgcaggcggcgggtctcctcccgccgggactgatggcacgcgacgggtcttgcatgcgctgccatccatcgccggcgcctgtgtcgagcgtgaagatctcgtgtccgatgttgtagaccggcggatcgttgtgggacttgcagtagaagcacctgacgacgacgtacctgttccgccacgggtcgaagccaaccgccgccgttgattctgtagaccgtgggcatgggccgctgccgttgccgggcggcagcacaacgagctcctgggtggccgggttgcacacgagcatggccctgccgtaggtggcgaaggcgacaaggccgtcgcagtgggtggggatgatatggcgggtgatacggccgccgttagggatagacttgtggtgcatcggatcagtctcggcggtgatgtctagcggcggcgccgccaccgctctcgctcctggtctagccgccgcccgcagggtaagccttagccggtgaagctgacaacctcgaagttggagagtgtgctttctcgtcccatatatcttccgtgctcgcgacagcaagcaaggatgacgttggcagctgcctcgcgcgcaaccgctcgagttggcagcggaccaaggcggggtcgtcgacggcggcgtgccacgagcggcaaactgccctgaaacatgcgagggatgttactgggaggttcacgaagatgtgggagaagaacacgtcgtcggggatggatgtggtggtgcccgcataatcttctgggatcgcggcaacggcggcagcggccagtggatgcggtggattgatttccggtnaaggtaagaaggcggaacgnncggcatgggaatggcgcgtgtggtgcagtttcttcctttcgcagcgattctttttttcgtgcgcggtgcggtttctttcttagggatgacaggtgggacccacgtgagagtgggtctagaagattgcgggattggtaatgaactggtactttttatattagtagattagtatagagtatagatatagatttaatcaagaatttgtgcaaccggacccacgtgtcaatgagataataatgcaggattaagaggatgattactgtgcaagattaattaaaggaacatgggtcccacctgacagtgtcccttttcttctcttctcgatttctcctcttctcgatttcttctctcctcgttcctctttcttcttcacgcgcgcacgagcggaggaggcggaggcgaggcgaggggtgcggggcgcggtttttttcgatttggcgacggttaagcgctaattggagggttaagcgctaattgcaactaaacaactcgtgctttttatattagtctatatctagattatattcacaatatgaatttatataatatagtatgattataaaagaaaaactgttgcaccacattcaagaatgcatcgagtttgattataagattgaaaagaactcacagttgcagcccaaatctgatgtcgcaaatgaatgaacattaggttgcccggagatcagcctccttagcagcgccaatgctgttctgtgctttaccaccagctatcctgagcctctcattcaaatggctttgacaaacttgcctgaaaaatcacatgcttcactctctcccctacttcctcaaacaatcgtccacttctttctagcggaacaaagagaaccattaggagtaaactattattatcatcatgatatttactatgagtaacagaagacctgaattttctctggatggtcaatacttagaaattagagaaatcatcaaaacacggaccaaaattatccatgcatgttccaaaattccatcaaaacacagataagatgttacttgaagagaaagaaggcaggagtttgatgcaaccatcttctcctgtagctttggaggcggaggcttgatgtggatcaaggttggcagcggtgcatggactatatggaataagagtgttattagtaaatgtaaaggtgcagcaatccttgtgccggcgaaatgaagatttggtttctgaaaaaaggttgactattagggcccaaggccatagaaaagtttgatttttggatctaactaagcaaccagcctttcaaatccaatttgtggggtagatttgcacaaaacctatcaatcattttcggaaaacctttttctaacatcttttccaatgaattagatttgcacagcacacacaaaaggattgatagaatttgaaaatcaatgtgtcattaggacaaaaaaaaattccctggagcaaattctatggttgctccctaagcaataacttttattttgatcaaccagcaattcatgtatttttatcccaacaaattaaaacatcaatgttggatgtagtaaatcaatgatcttaatgttaaaacttattaaccagaggttagctcatgattcatgaatatttatttcagaactcgccaaagtttgcaccatgccaaagtatagtgacattctagactttaggtatgtattggtcacaggaaatgtgaatattctgaagattattaccagtcgaagaccatgcaaaagcctaagatgcaatccaaaggtcaaacctgagataaaaaaaaggaaaaaaaatttagagcaccacatcattctgaaattgaagtccaccaaatactgaagcagcaccattcagggggtaggccagcatgacatccatgccaacgatacttgtgagatgaccgacaaagaaatgctcgacttcttcgcacaaagtgtgatgattagtgattaggccaaagatacttgtgaaaaattaattccttcatgaagtccagaaggaaaacttcgatgtgatatattctcttgtactaagaggggccaagatggtaagccagtcaacagtctcaccccaattagaacactttatattagaaactataaatgttaaaagggaaaagggattatgtgcttgatttggttacatgatacctctccaccaattttgttagccaagcacaggccaacagctcctccatttttcttcccttatatctaaaagctattcaaatgattcaggatacaaataagctattattagtaaataataaagtaaaattcacaagtagttttcagataagtaaaattctgatgaatataaagaagcaaaattcacaagcaattttcagataagtaaaggccatattacgatgcacagatccatggaccatggggcatgtttaatgtaaaagtcagtcctaaaatacatgatctacaataccatattacaatgcaactcactaaatccacagatcacttgaaaatccataaaccacgttggctgaaacaaccaaatccacagaccacgtttcaataaaacaatgtaggctcaaatttgcaggtaaccgatggaaaacaaaaaaaaaaacgggatttcaaccgggggtggaggccggcgaggtgctgcaacggcgaaggggagggcagagaccggtgaggcgcataggcgatggaaggaggcatgggagacggtcggcgaggaggagcgattccctccctgcatgcccgtggctgggttctcgccgaggcggaggcggcgcgcggtccacgggagggatcgagggaagtggctcgtggtgggggaggagatcacgcgtcgacagaaggggagggaagcgtcggcgctcggcgtggggagaagccgcagagcgagcggttgttcgtgggttttcttttttttttttcctctctctctctcgccggacgacgtgggatttaattcctctctcctttttaccgatcgctctaaccgcggattagcagaggtgaatcgctaattgcagggtgatccaactcttgatataatccgttggatgaatagatctaagggtcgaaaaagataagtgttcgatgaactggtgctttttatagcagtaagtatatagattattaagggattggaattggagtacagtttttattttttttattcaggattttattatgaatttaaaacttgatgaattttggagggaacattagatggagggatatattgatcaaatttgaaatcattaatggcacgagatttcaaaattttgaaatttaaaacgtaataaaaagcgtttttaagtaaaggagtcaaactcaggatgctacataaaggttttattagggttcatcttcccgaccggagaaaaatcaccaagaagagagtacatattaactacctgatcaaggcagggagcataactcttatgtagagtgcttcaacaacgaataatggagattgccgaatcttaattaggtagctccagaaaaacttgtcccgtctttatatttgtaactagaaaaggtagccgcaggcacattactgacaccttgtttaatgttgcttgaaattttatgaataatattaacatgtgggtgatttttttgtaatatgtttttattatattctaaatatgtttttgtccataatttgtttaggatcgctgctttaaatgttggtcatgattttcttctaactaccctatcaacatataaattctacattaaaattatttattggaattcataaaatcttgagtttatgagaaaatatcgtgtcgtggaaatggagttgattcgtatggacctatcatttgtactatatgtgtttttaatatttagtatatcatatttttggagtttctaaactttaagtaatagcttttcttgtgtactatagatatctttatggaatttaggatattttaatggaaaaaactttctattaagatatatatggtaagaggaaaattttgtccaattataacaaatttatatttacttctgctacctccttttttcatatacttactatgttcttggaaaaatgaatttaaaattgaaataagagagcaattatataaatgaaattagtttgtgtagagtatttataaataaaattgttgatgacattggttgaaattgggcgtttgtcaatagcatttttggattttgtcatcctatttagtcataaatatttgtcaactgataacagatatataatgatatgctttatattgtcatttgttatataattttcatgtctgtttggattatatgaaaagaatcaaaatgcaacctgaaatataattttattttataagttgaaatatattcaaaacagatagtaaaatattaatttaatggtaaataatatgatggtctaaacttcgttttcaattgtagagcgaatttagttatgcatgtttgtaaaagtgatatataataaaataatatatgtcgccatttgtttgtcatatatgatgaaaagggtcattatatgacccaaaaaacatttttatttattataatttaaaatatgtcaacaccactttaagcctatctcaactattacattatatgtatgtaaaaattttatgtgtaattttgaatttgtagttgattagaatttaatatgataaataacaaatattatctcaactactataaagaaaagattaaaggaaagggaagagaaggcgaggagggccagttgcgtgcatgcagtatgaagtgatatttttttaagggttaattggatcatgccactacaaaatatgccattttagaaaaatatcattactattcacaatattggctacgtgccattggaatttgaaaaaattagaaccataccactccatcacgttttccgtcaaaaatctccgctaaccccaactgcacgagggacctagctgttagtttcatcttcacttccctcccctctcttctctttccccttcctctctctccaccactgtcgtcgaccaccaccgtcactgctgctgtcatcggccacctccgtgaaggcctcaggagccactaccgtcgccactatcgtcggccctatctgcggcgggagacttaggagccgttgctgccactgccgtctgtggcaggaggctcgggagcagccgtcctcaacgccatccacgcggaagggctcaggagccccggccgccgtcactatcctcgaccccatccgcgacgggagggctcggaacctgcagccgccgccgccgccactatccttgatgccatccgcgtgggagggctcgggagccgccgccgccgtnnnnnnnnnnnnnnnnnnnnnnnnngggaggtctcgagtgccgccgctgccgccatccttgacgccatccgcaaaatcgtgaatagtagtggcatttttctaaaatggcatatttattgtggcacagaatataagtgattttagttgaataggatatcatagtactacgaatctaaatccatgtccatgcatccataaaaaaattttatattttgggacaggggaatatgtattttctaattaacttcttattattttaatcttattaattggttttatgtgttttatattgtctagtgtaagctacgtgttgttaatcatatggtttaaaaatctatctgtttttccattaaaatgtgtgttgagtggccaatagctggtccaaagcaatgtatttcttttacttattaaatacagttaattttttgttctttcttcgtttcgtacttattgatatctcctattgctagatcaaactagacttatgtagcacatctactataggttgcaaaattcaggtcacgctagtttgtgaaaggaaaccagggacgatccatgtctgatcgtacatggatctaattagttagttttggggatttggccgagcctatggctgaaacattttctgagtgcttacacctttttctccaaaagtttctcatttgcattaagagacctacatacatagcaaagtacgattgaaaccacaaaaaatagttgattgatccaaataaataaatatttacaagaaaatttattttcattccaaaattgatgaaactttcaagttctaaacactcctatatgcaactaataatttgttcacggctttgaaataatccatttataaacatatttccccaatcttgaaagaaacgaaacttggcaaactgaggttagctcggctgttttttattaaggaacctgccaatgatagctgacactgaagtgctagacttggcatgagtgatcgtatttacagcaaattattatttccatggtgacgacgtgttattgacaacaagatgtcaatggtggctttgtcaatttcaaaatatgccagcccaatctctcggaattggtaaggctaggatttctgcgtgtgctttcattgggatcaatgcacgcgtgtgtatatgagcatctgtgtgcttgtactgtgtttcgtaaaaaaacaaaatttgtatttgtttgcaactttcaatttatatatattcacatattgttgtgttattacactaaattttgagtatgcacaagcatggtttacctgtttattgcatataaaattttctgaagtgtataaatgcaaatccaaaatgggtgtattacactaaggtgtatagaagatctgtactgatagcactaggatttgagatgctctctgatctctaggtcctagtactacattgaacaatatgatatggacatataaaccacacattctgccaaacaaactccatacatatgtcttcatacacgcaaagcaaaacacacacacatcccaacttcacatgcacatggtatatatacaccttgtatcatctcttggtatttaacatgtcacaaaactatgaccacactatatcaaaaacgcagaaaaattaaatttaaaaagcagtaaaaaaacttaagaaaaataaccacatatccatcctccaataaataattcagccaagaaccagcaggaagaaggtcgctcccagacgaagcatgcaggctgccaggcgggggtcgccgccggcggccgtcctcgtcgccgcgccgcggtggtggtggcccctggtggcgacattgtgcgggtccaccaccggcgtgccggagccaccgtcgttgggattgttggggttgtgcgaccggtggcttgtgtaaccgcgtccatgtccgccgccgccgccggccgtcctctccgtcaccaccatctcgctgtcggcgcctgtatataaaaaaaaacacacgtatagtatcaattgaaattgtatcagcaagtttctgttcttcacgtgccacaaaataacatatttttttagataatcataaaataacatattcaagttaattactccatccatcacaaaatataacaatttctaacccttaagatttgtctcaaaatataaaacttcttcaccaaaattctattctcaatcaatcacaacccttcaccattcaaattttttcatctacctccacttctcaatcccatttaattttatctagttacacgtgtctaaccctaaaaatccttatattctacttcctccatctacttttaatagtcatatttcatcttagcatatagaccaaggataaataatcctacttatcatccatttaaacatgctactagtcattcctcgtaaacaagcgattcattaatatttacatttctcgatgcctatatagctaatcttgtgtggaagaatgaagagtcacgcattaaatccaaaaaaatcattaatttgataggttgttggattgaaatatacatatcaaaaataaatttttcagatttggaaatataactatcaaaagtaaatggagggagtagtacagagcgagtacttgattttatatgtccttcaaaatttaaaattgtttttttctactcttttttatggtttgttctggatcgagcatgacacatgatcatcaggttgtttgtttgtaaacaggacgtgatgatgccatgttatatttattattggtgaataatcactttgtgtgatatcacgagagcattagttaggaatataattaagtatcattaacggcgtgcagtgcaagggtctccggaaatgcaggggaataatatctcattaattatactgtgttcccccacatggacaggacagagcatctgttcttgacagggttttcaggcaggatgcctgatctgcgcgctcacacaccacatgagtattcatcaagtttttattattattattgtcttgtttattgatttttgactggagattcaagtatctaggccagccagacccttgatatgttttgaataagttaattactaactaatataggcatgtttggactgaataatattttaacaataaggaaatcaactgctttgttttccaagaaatttcttccagatctgaacattttaatttagtactgaattcttcggtccatcgacggacacaattaatcagtagggccatgcttgacattgcaattacttttgttcattttgcaggtggatatgcatttgattagtgaggaaggaagatatatagatagataaacgggacgacaacttatgcgaggctacccaaaatgaaattagaaacgttttacaaataatagggtgtagataatttcctcaagaaatacacggtgtagataaatttcaaatattttctaaggttttgcttatctaaacttatggcaattagccaaagggaaccaaccacagctataatcttgcctttcttttttagggacccacttctggtgttggttgtacttttgacataatcaaaaaattcatcgtgcataatgcttgtaataaacaaacaaatcttcatgtgtttcccacaaaactaatattgtaagtagtggaacgaaagttaagttgaatagtcgaacatcatgtccaaccccaacagaaccatagaaatcatgttaataacaactttacaaacattcagaaacatacagttctatgcagatacaatacaaaacatatatacacgggagttgtcatcatttgtttcatagaaacatagagctgaaaaaaacgatgcatataaggatactatggtgtaagaaacctactaagacagacatgcagagaagagaaggaacactgcgtacctgtacccttgatagctgcagcaacatgccttgctccatggatacttggaacaaggagtaggagtaggatgagggagatagcaaggcaagatctctttgcactctccatggctgcaatgagcagagctaatgatgtagtagtagtgtaaactgaactgatactctgcctctgctaccaacactcttcatccttcccttaaaaatcctttaaaaatgagatagaataagttcttcaaggaactttccacttgtactgccagagctatggacaccaactttattgtttatttttcttatttctttattttgtaacatccagcactaatacatgtttcctgtttttttttttcttatcctcagctttctttccccaaaagcattatcctactaataagcaacaatgcagcaaaaggtggtcatatttaaaagatatgcaccaagttgttttttttaaggactagtactattattgcacattttagatgtgttgtttggcccgcccaattacgcatgtgggtcttgtaccaattgatggtatgaaatgtcatgacctggtcgtttgtaatgaatagaattaacatgaatgcttcccaaactcctaaacggtacgattttgtagaaaaaaatatatatgtgcgaatttcttgttatactattttaaatccattttccaactttatcatagttaatttatttgtttgtacccatgaaatattatcacaaatcattcagctattcagccaataattactaaggaccagagctattcagaatggaacaagtcatgtagaacactaacttgtgctgtttaggcaaatatgcataggtaggctttgaatttgatcaaatcactcaggcagcgttcacacacaagtatttgtggaacacaaacttgcctctgaagattaaggtgctcatatggttgatgctgcagaattgtattctcactaaagaaaacctgatccccaaagtgtggaaaggatccaagaggagcatgttttgttcagtgcctcgaatcagtagaacatctactcttcaaatggttgtaacaacttctccaggaagctcaaatggtttgtaagatcaactttaggcacaaaactaaaactagtaatgattgtgttggcagcaacattcagagttagctccttccatacagacaattagtcttccattttttttatgggattgaattttggcctggcatggtgtttttgttaatggttcttgtttaaaactatatttagcttagcttgtttagatccttttggagcataaagtagtaatcatgctaagttttctatacttgtttctttttgtgcagagtttctgtacttctttttctttcttgggtccttgtactccggtttcattgtttttgtcatgaagatgggactccttgtttcaaaagaaaatacattcaaatcgttgttcttttagatgcacatcataaggacctttaataaaaattaaaactctgatgaggggagttacacgggatatatcaaggagagttggctcgttttaaaagaaagaccggacctaaaaaccttttttttaaataatggatttaaataaaaccttgccattacatcccagggatgtatacagccacacctaaaaaaacgacaacacccaaaaaatgagtgaaaaataaaaacatgttttagcacggcattatgacacaaaacatatatatgacgtattatctatgtccccattctagccagttgcatggctagaattattttttttagctatatttacgacggcacattttaaaaataaatagttaaatcagttttacaacttatattgtaattaagttttgcgatgtagtacgtagtctagagcttacaatgctcaaatggcacatttaggtcttgggttatttcaagcctagaaaaaaaaaaggggtcaagctgagccctcatcaaaacacgtgttaagaatccatctgagcatacctactgttgaaagtgaatagaatcgattgagaacgagtaagagagaattgagcgaatgaatcggatgttctttattgatcaatgaaggggtggcaaccgtagacgcgaaggttgggaaccatcgcgcccgttgcgacggatcatcgagtggaagagacgcggttgcttcggttgcgatcccatcatgagatcaccttgtagtttcataacacctactatagtagaaagagtatgattaaaattaagtgaaaaatatgacaatatctttcgtaaacccattcttctttagagtatagacagagagaatgttaactaaatgagattttctactgcttttaaggaggtacagttctaatttaaattttgatgatctctcaatacggtgttaagttacaatgccataaattaacactgccgccttacaaaccagtgaaatcactctaacatgaaaatgtgaaaaagatagtgaaagaataccaaaaaggatagctaaacaaaattaacccctgatcaactaatcttctactaccattgagcctaagtacatcgaactagagaggaagcagccaattggcagcagcggcgaggcgacgccgcagcaagcgatcgccgtgctacctccggggcggcggtcgaaggcggcggcgccggatttcttgcccttgtgcttgcggccaccgcggccgtggcggccatggtgatcgccgtgggagcttcttactacgaccgccaactccgccgccgtgctcgccgtcttcttctcctcagctcctgctcatcatcaagattcaagacaaacaagacgccactgggatcagatcaatctaaccacgagcagagagagagatcaatggagagaatgaattgaattgcttgcccgttaattcgttgctgccaattgcagacgaatcaccggctgcaagaacacacgaggaggccaggaggaagaagacgaggaggagcagccattgtttcctgaccggtgaatccatggttggtgaattttattttgctcggtgtaccgtaggatggccgcagcttacgtatttaaatgcaattcgtggaaagatgagtacgttttttaagtttagcaacggattatacgattccaagaacgcattcaacaaaatctcgatttcttggaaagcgcacacacaaaattgcagattgaagatgcggaaaaatctcgccgggaatccccgaatcgggcggattcttggcgattcatttggattcatttcatttcattctatgtacacacagcaagatgaatcgatttaaattcaaatgcgaaatcgggagcgattcgggtccagaattcattcattcagaagcgaagcagagcgacgacggcggcgacaaggagggcggcgcaggaggccgccatgggagggcgcacggatccggccgccgcgctgcgcctgcccgtgtggtgctcggctggctccggcctgccgtggccgctgccgtggccgtggccggcgccggcatggccgctgccgtgaccaccaccacctcctccttccctcacggtgacagaccaccgagccaccgccgccgccgcggcgtgcgtcgtcgtcgtcgtctggtcgctggcctctgcaactgcaattcacgatcaaacacttgacacaaacactaatctcactctcctgacgaagcagatcaactagcagcaaatcttaacaacagtgactgacctttggcttctttggcatcattcagagcacgagctccatgaacgcatggtggaagaagagcaagcaagacgacgacggcgaagaggagcggtaacaatctgatgaggcgacgattatttgtcgcgatcggcaagccagcagcacgggaggaggacgacgagtcactgagcctgcaactgatga

SEQ ID NO: 30184 - DNA, 330 bp, Oryza sativa
tcaacatgtttgttactttaaatgtactatttatttggtttttattagtctttttcctcgttttgcgtgttagcttgtcgttttcgtcgttttgaaggatcgtgagtgcgtcggaagtgttcaagaagacttattgaagaccaattattgcaaggtaagtcacacagatcccaaacacaattcctttgagcatgttgatcctatatttaaattctctatttatttcaattgtgcatttatttttgaatgtcatcaggtggtgtgaacttattcctttgtgtaacatccttaaattttaaactaaaatttgactgcatcatgctggctttt

SEQ ID NO: 30185 - DNA, 413 bp, Oryza sativa
ttggtttctattagtctttttcttcgttttgcgtgttagcttgtcgtttccgtcgttgcgaaggttcgtgattgcgtcggaagtgatcaagaaggttaattgaagatcgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattaggataacttatgactcactattatttaagg

SEQ ID NO: 30186 - DNA, 618 bp, Oryza sativa
tccagttcactgtaagtaaataagttgtttattatcatacatgcttatttgcgaccggatgagttttttgtactaacatttcattcttaattgtagggggacggtctgcaacctgacgctgatgattactcggtccgacgctcccttgaggcgtacctgttgtggttgttcgggtgggtgatgttcactagaacccacgggcacgcgggttgggactttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccatagggcgaccagtggtggacagcgcaccctacggggttggtcgcagcgcgcagtggccagaggacggtcccacgatggggacttactggtgtcgatgtgggttagtgcaacttcgctgcgttataagtttaacagtcctcttcttttttttttcttcacataacatgtctaattccaatcatgtttattgcagcgtcgttacgcttga

SEQ ID NO: 30187 - DNA, 8501 bp, Oryza sativa
actcagggaacgtgtgtaatctatctaaggctaagacaatccaaggataacaacgataggtaggctaggcaggctagagaggactttctatgtgttttaattatctaagctaagcaaaggtaatttcctatctgttgcttcgggcactgacccctcttggtctgcccgcgtggttccgactatagctctatgatgtatccgaacgtggaggattactgggtcgggattcagggcaggcaccacctgccgcctacctctgacaaatccgtgggatacacagcaaactaaagtaatctctaacctagacaccacgtctaagttattaattactactctaatacttgtacaggaacttccttctttatccagagtcctagtactagagcacttagtatgaatactaaacaatgaacccgcaaagatggaaatatatcttacttagactaagcaactaaataacataagaaaggaacacgaatgcttactttatagaagaagttctccgaacccggagcagagtctaccgacagcttcggtactcctcccgaattccttctacgaagctacacttgtcaaggtagaagtcggatgagcaccaaacttccgggcactcctccagagcttcccctcactcgctaccttattctaatatgcaaaagatacaatagagcctcttgtaattcagctcaaagttttgtgttgtgaatgaatgagaggagctctctttatagcctccatatgacggttacaagtatgggaaatgaccaaactaccctccaaccgtcatcaggaagtaatcagggctgtccacgtcgaatctggcgatcaacggccacgaaacgggttcggccgaactggtggttcggccaaaccagaaaaccctcctctcggccgcctcttcagccaggaggtagcttaatgggcccctaacatcatatactatgttttggcccaattctaagttgtttacattaacatatgggccctctaatccatgtaaacgcgtcctgaatgtgcggaggtgcattttatcgcatgatggatgtgttttctcctcaaattacctgcgtaaacatatttcaccaccactagtggaaatgattggtaataatccctaccactaagttggataccatgttttatttcattatatgcaggtattgatggtcagatattatgatttaaggaccgtcaacatggagccgccgctgttgctgccattgccgcctttgccgtgcttgcgacaatttttgttgttgccgctgttgccgttgttgccgccggagttgccagaggtgttgccgctgttgccgttcccgcgagcaccacaggcggccactacgacgaaggcagtggcggtgccggcggagtggccttgtcccttgttgatctcggcgagaagaagttgcgagcgtgcctccaggaacatcgggaacaggtgctgcatggggagaatagtctgcaagttgtggtacttttcattcaaacctcaaaggaagttgaggatgagggtcttgtcggttatcggttcgccgaggtccgccaaagaatccaccatggcatgaagacgatgatgaaccctgagttcctctcaacactcaaggctgttgttggcccgatcttttggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaattgaagaaacaagcaagaacaagaataaagcaatctgatattgcaaatagtaatttaatacaaatgataagtggggttccgaagaacaagcagacggacggtctagccgacacgtgcgctgcaagcaagtagcaatggctaaactttaatctaacaaaacccaaaaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgaggccaaacgagatagatttccgagatgatgctggatccgttggaaggaggacttcgagagctttccatcaagtactcacgggcccaaaacgaagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcagcctgcggcccaagtctccatcttctccctctctttttccttccctctctctctcttgggctgcccctccctccttcccatcggcccagctccctcctcctccctctctcccccgggccacctctccctcctctcctcctgggccgatcgcccggcccaagccgcgccccccctacccgagccgctcccctcccgcgtacgcacgcgcgttgcacgcgcgctgaccgcgcgcccgcgtggggcacacgcggcggtcgtcgtcttcttcctccagccgcccggcctcctctctctctcccaaaaaaccctagcgccatttcccgaaaaatccaaccattctttccaaattaattggagggaattaatccccattccttcctcttcaattccccctaattttccgcttgaatggcgccgtccatcgcccggaacggccgcggactttccaacctctttccatggccaccggccgtgtttcccatcgccgttccgccctctcccatgcccggctccctccccgcgcctataaaatggagcatcctccctccgttctatcgttttagcctcctcccgcgtcttcccgtggccgcaccacccctccccgcctcctccctctctctctccgagcgccggccacctccaaccgcccctgccgcagtgtcagcacgccggtcggccgtgcagtcgccttccccggtgtagcagccgcctcctcttccccggcgtcgcctccgtttcgcagggaaaacatcggagccacctcctcgccgacgaccagtgatgtcgccaccactccaccgcctccagccggctgtgccacctcgccggtgcggcggctgtcgtcgtcgccatcctccctcgacgtcgccacatcgccctctaccccggcctgccctcgatttcgccggaacactgccgtgccgcgccggcctctccatccgcctcgccggaatttccccggtcggcccttcctccacccgtgcgccgtcggccgcgccaccaccacctccggcatcgcagcggcaaggtcgccctcggcctcgcctcccctccacccgagccttgtcggtgttcgttgtcgtcatctccgttcgtactcgtcgacgactcctctggtcggtcgttcctcctcgctggctcgtcatctcgttgtgccacctccgtcgtgtcccacgccgtcctcgtctccgtgcagctgctgccggctgccctcgtcgcctcctcgccggtcccggtcgtcgtcctcatcatcgtggtgttcgtccctccgtcaagccgttctcgtcttcgtcctcggctccgcgtcgtcaagccttgtgccggccgcgtctcgccttcgtccaaggatcgccgccgaagtcgtcccctcgccgttcgtctccgtcgttctcgtccgtctccgccgcgcccgttcgtcgttgtcgttcccacgcctcgtcgcatggtggtaaggatccctctccctcgctgccccgtcctcgtcctttcggtgtcgcccgtgcccgttgtgcggttgtcggccccggtacccgtgtaccggtgtcggtagtcgttcgtgtgtgcgtgtggtgaccgtgttagtgtgcccgctcggtagccgcgttgtttccacgtgtgcagcccgcgtggtgtctagtggagtccgtttgtcggccactcgcctcggttgacacacagcgtctgcttccgtcgacccgtagaccgtctccgtgtactcggtctaccgtggtcctttaggttgacatgtggggtccgcatgtcaacagcacagccttcctgtcttttccaggctagcgctttcacatgttttatagttgtaaaacctaattataataatccgtaaatctccatgtaacagcattaaacttcggatgatcatatcttggtcatacgaactccgaatcgacccgttcaagtctcctaatgtttgttataacctaaagaaccatgtgctttctttttatgtattgttattgcttctttataggcttgtagctttgcttgtgtgcttcgcgtagctttcgtcgttctggaggttcccgaagcgtggttcgtggtcatcgccgaaggttcggaaggccattctctttgagcaaggcaagtcacatcatccttgagcatattgaatcccagtttataaaattattttgatttaaattaatgcattatcgctttatgtaaattcccgcgttatcactgttttatttagccatgcctatttacctttcttatggccttattattattgctattgttattattaccttgttcaccctaggaaaataaaaccccaactagtgggtactctatttatggttccactagtatgaacttaggtagatgctgcgctggttaattaggcaacattaggtggttttataactttagactttgggaattctcatatcacttggacactttggaatggttggattatggtggaataggacatacacctctcttcctctttcaaaacccctaaaacctgttttccggtggggtttgggtgcatgccagttgtgggaagtagcaccccggccactataaggattaagctcgggcctctgttgcaaagcactaccgtacttccacatatctagtgggtaaggctcagtttgtggctcagtctggttataaacaaaggtacacggatggagattgacgaattcgggggtcgatggacatctctaggatagatgaaggctacacgagctgcgtcccggtagtcgagatgtcatggcacagggctggtgtcctgctgctaggggctcaatcctacctacctatcccgggggttctggccgtaggcggggttgggtcgatactcttgtttatggctaggatgggttgggaactatgtcacgtctttcgtccgtatgccgtggtggtatgtggcacgtggttacacgtgaggaagatgtgtcttgtgggtaaagatgtacacctctgatcagagtaaatctattcgaatagccgcgccctcggatatgggcaagcctagcaatgtacccaagttagtgttttaattcttaaaacctgcttaacaactaaaatgtggaatggttggcctgggttggcttgggacgagctgggacccagggtcgggttgccagttcggtctgaatcattgtaggccttgggttaaggcgggttcgtgtgggttcacggccttgtttaataaatattgtgtagctctaggatcgtgtgtacaaagtagctttgagcaactacgtgtcttttaaatgctgtttactgcaaaatttaacccctatattattaccccttgtacccccttgcattaatcatgcatctaccggtgtggcttgctgagtactgtggttgtactcattcttgctctatctttccccccccccttcagtaagagaagctttggagaagaagtcctaggtggagttctggcttataccccagttgagcgcctgtgaagatggagccgtaggcccgctagtccgctgctatttatttttatatgtcaggcctgaagtgcctttgtaataatgtaaatattatcgatataataaagatgtgccttttgtatcatgtttgtgtggtgtaccccggcttttcctgggacggggattaatacactagcgttcgggaaaaggtaattttctcagttgcgacaccttgtcccctccattgttcctaatcacaatataatcattaggtagcaatctattctcgaattcatacaaagaagaacataggaacgagctcacctctaaatttaattgtcgcacacgagcacttgttatcggtccttgaatgaccgttggaggattgatgtgtgtatccgaggtagtgatgttcgcatcatcctccccctcttgaattgaagtcatcctcgactcaagctcatcctcttctcccaagtatggcttcaaatctgaaatgttaaacgtgggactaaccccaaactcgggaggcaactcaagtttatatgcattatcattcatcttctcaacaattttaaaaggaccatcagcacgaggcatcaacttagactttctcaattccggaaatctatcctttctcaagtgcaaccaaactaaaccacccggttcaagcttaacctcttgcctacctttactatcagcaattctatacttttcagtcatcttttcaatgttgagcttggttgactcatgcattttcaaaataaattcagcgcgtgccttagcatcattatgaaccctctcactagtaggtaaaggcaaaatatcaataggagcattagggttgaaaccatacactacctgaaaaggacttaacttggtagtagaatgtgttgcccgactctatgcaagctccacatgaggcaaacattcttcccacatcatcaattttttcttcaaaatagccctcaacatggtacccaaagtgcggttgattacctccgtttgtccatctgtttgtcggtgacatgttgtagaaaacaatagctttgtacccaacttgttccatagcgtgcaccaaaaatgacttaagaattttgcatcacgatctgaaacaatagtagaaggcataccatgcaagcgaacaatctcatggaaaaacagatcagcaatatgaacatcatcatcacttttatgacatggtataaaatgtgccatcttagaaaaacgattcaccacaacaaaaatgctatccctccccctcttagttctaggcaatcccaaaataaagtccatagaaatatatgcccaaggaatagaaggtacaggaagaggcatatacaaaccatgtggattcaaacgagactgagctttctgacaagtggtgcaacgtgccacgaacctctcaacatcttttctcatccttggtcaaaagaaatgcaaggccaaaacatcttccatcttcttagctccaaaatgtcccatcaaccctcctccatgcgctttctgtatcaacaaaagacgaacggaaccaactggaatgcatagacggttagctctataaacaaatgcaccattgatcacaaatttgttccaagtacgtccctctttgcaatttaacatcacttcattaaaatcaggatgaagcgcatattgttctttaattgattcaagtccaaaaatccgacaatcaagttgggacaataaagtatagtgcctagacaaagtgatgaaccctgagttcctctcgacactcaaggctattgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcaaagaaacaagcaagaacaagataaaagcaatctgatattgcaaataggaatttaatacaaatgataagttggggttccgaagaacaagcagacggacggtctagccgacacgcgcgctgcaagtaagtaggaatggctaaactttaatctaacaaaaacccgagaaaccctgaaggggtaactagctatatataggggtgggtgcctagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcagatcatcctctccttcttcacggaaaaccgtcctcggtttttccatatggtgctctttgcgtagtccatttacaacaacctgtttcttccaatcaaaacaaggcaaactcgagacaatttggttagcaataacatttttctctagcttgcatattttatccacatgtacaggaggttctaaatccgagcagatgtaaactctatgcacaaaatatattccaag

SEQ ID NO: 30188 - DNA, 488 bp, Oryza sativa
cactcggtgctggctgagcggcctttgccgctgacttgtcactagatggaggaggtgctgctcgactggttgtgggtgtggaagatggagaagcagtacggccggccggaggagtggtgcgtgtctgccatgatgaagttttacctgcagaaaaattagccttggcactagcacgtcgtccttgcacttccctttcagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtccattataggtgatgcaataccttgttcctgtgattctggccacacgagatagaattcagagaagaggctggatccattagaaagagggctccgagagcttt

SEQ ID NO: 30189 - DNA, 1444 bp, Oryza sativa
actttcatgattttaaaatttgtatcacttatagtggtttacaagaatctaatgagaacacaatgactagatttttcagagggcttaatttcaatattcaggctgggcttgttaatgtgacatataatcatataggccaattgttcatgcttgcttgcattgttgagcgcaaaattttggagaatccaatggagcaacaagatatgcttgtgcctcctatcactgatgttttgcaggaagttcagaaaagtctccaaaatgagaagaacgatatgtttgagatgtcacttccatcactcgcgaatgaggagaaggctgatgcagctacattatctgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgttccttgtgataaagaagagttgtgtgataatgtttcacttatatccatgccacaactagtgaatgaacatgttagttctactatttctttgtgtgctgattctaagcaccttgtttgttcatccacggatgacttggatagaatttggtgatgaggttggatccattggaaagaggactccgtgggctttccatcaagtactcacaggccgaaaacggagatcgtatgcagattcggtggccgtttgaagtcagttgtgtagcaagtggccgaatcggattctagcacgtggagcacttgatcttgttatcatcttattcatccatgatgtgagcaatggtcgtatctgtagtagccgtggtcacatcatcctccccttcttcacagaaaactgtcctcggtttttccatatggtgctcttcgcgtagtccatttaaaacaacctgttttttccaatcaaaacaagacaaactcgagataattttgttaggaataacatttctctctagcttgcatgttttatccacatgtataggaggttctaaatctgaacatatgtaatccctatgcaccaaatatattcctctatcatcagattcgccaaatatatgaaaaatagcagtagttggacaaggcaaatcagacttagtaaataatttcttcttcaaattatcaagctcacaaaaatcatcaaactgaacatagcccaaagtatttaaagaagatagcaattcacgttcctctacttcattagcaatgtgaacaacatgcttaaaatcagcacacaaagaaacagcttgtggttggtgcgccatggctctattcaaccccttctgggttcgactcccaccaaacacccctttttcctatatttgctcctacttctcatgcgtgcacatggtctggcagggtagcgcccacgattgagcggtccaatgccggttttctgac

SEQ ID NO: 30190 - DNA, 4229 bp, Oryza sativa
aatccaatatgtccaaaaatcatgttttggtgctttttgaactttttcattccggtcaaaaacatcgcacccgtgtgggccaatattggcattaatggacaaaagtttgctgcgcgaatcacgaagtgagtttttgccacgaacgcacccaatacactccaatatgtcgaaaaatcatttttggttctttttgaactttttcattccggtcaaaaacatcgcacccgtgcgggcattatatgccaatattggcattcgaataaccgtgtccgcggttatgggcaggtctaacaatgtctatcgtgattagtctcacacttctcaccataataaatgatgctataactggtaataatttgattagctcctggtttagaatggtacattcctagtttggagatagatctgtacagccgggtttggttgttcaggatggttgggcctgtgcagcatgggtgtgttgttcagtgttgattagtattgatgattaattactctactgttttacaattctcaaatgtttcctaaatgctgcttttgcaaatgagccctatattatgccttcctttggtatccttgtgcacttgcatatttgttgcgtggcttgcggagtattccatgtactcaccttgcaataatcaatcaaacctcagttgaagacaagtcgcaaaggagaagacttttggcttataccccagttgagctgcctgtgggagtggagccggagcttcgctagaccgtaattccgctgctgttctcttctcttttgtaagtatttaacattattattatgatgaatctgtatattaaattgtcagtttgtgtacctcggctgattactggacgacgattttatgcacaaattagttcggaaattactaatgaatttctgggcgtgacaagttggtatcagagtcatctcgactgtaggataagccaaatggccaaaccttcaggactgattttccgaaaacatgatttgtgaaaatttttcctttcttccttctctagaattctttgcgaattgttttatcgtcctttccccttcctttttcaacttgagtagttctgaaactagttgttgaaacatgaagacgccaatgtggtctacttatcaagtggatcgaggaatatgaaggtgatgatcgatctgaagtgtccaggtgtatagatggaatgaagtttggatcctaccttagaacctaaaccaccaaagtgactttgaagaatagttagtagggtagagcgtctgttgcttgcttgtgtgtaggtatggttgcatttccatcattggtgtagatcggtgatgagcgtgtaactataataggttgcttgcttaatcaacttgaacaatataatggtctacacacaccagatcagtggtaacctggttaaggtcttgtctttagtgtaacccctatccttctatcttctctaatctgcaacagatggtgaacactcgcgctagtggaagcggaaacaataacaatgaggagaatccaagtcttgcttaagttctggctcaacagactcagttaatgaatatgatgatgcagcagatgcagaaccagctcaaccaaaggaacaacaatcctccaccaccgcagaacaagctagctgattttcttcgtgtgaggccgcctaccttttctagcactaccaacctagtggaagcaggtgattggctgcacactattgagaagaagttggaattgctccagtgcacagatcaggagaaagttgttttcgcttcacatcacttgcatggatctgcttcagaatggtgggatcacttccggatgaacagagcagaaggacaaccaatcacttgggtagagtttaccgaaggattcaagaagacacacatacctgcaggagttgttgctttgaagaagcgtgagttcagggcattgaagcaaaaggatcgtactggggcagagtatcttcatgagttcaaccgtctagcacgttatgctccagaagatgtacgtactgacgaggaaaggcaggagaagttcttggatggcctgaaggatgatctcatgactacgctgattttcaggaactagttgacaaagcaattcgacttgaagacaagaagaacaggatggacaaccggaagagaagatgattgttttcccaggaggcacagggtaatagtcagaagccgcgtatcaagccagctcaagttgatggatcaagtttgacatctcaaaaaccatcgcaacagttgaacatcggtggtgagatcaattcagagattaatgcaagcaatgaagttaacatcaagcaagctactcaatcagagccagttcagcaggatcagtctcaagaaggtaatagtagtggaagggagtagcgggtatgtttcaattgttatgagccagatcacttcgcaagagagtgtccgaagccggagcgtctgcagacacaaggtcaagtcaacaacatcgttgtcacaggaagtgccagttgcgtcttcaagagttgcgtcttcaagtgttacagctcagccaccagtttcaaagcagcagtagttttctttaaagccttagaaataattatcagagttatggaataagatagactgcagtttacttatgcccttttctttctagcagttccgaatctcgggatgagattctttgtaaggggaggggtagatttgtcacagcctgattttcgtttttaggatttataaattatttaataaattatattattaatagaatttatattaaatgttcgttaatttacaagtgaagttaaatgtgggaaataaaatttcctagatataaagaatggttggatttaatttttattaaattctccatgattaattatactctctggaattttctctgatttttcagagctcaattcctaattttaataatacaaagaatatttcagtaataattcacatattaaattaatcattaaatgatctggtttcaattttgttaaatactttgagtgtccaagtatgttcaagatttttcttggaattatttgagcattggaagtatttttaacaattgaaagatcatttcagtgattaatttaattgggaaaagtaattaaaattcccttttccttttcgagccgaaacaggaaaagttgacctttactcctcggcccattcttccttctattcgtccggccttatcccttcccaaagtctagtttgcatccctccttctatcgggctgtgcaatagaagcccagacaaaagtctgtttggccacccttagacactgttcattttccagctcagacagagtccgagccagccatgcccgtgcacagttcccgctgatccccttccaaaatccggcctcctcgttgctcctttttccaaattagttgcgggaatgaaatcctctcaatctcctctataaattccccaagaaattcccaaaagtttctatggaaatcctttccagttttgcggatcaatctttcctttttccgaagaagatccttaactttcccagagtttttcccgacgatttgggcccggacccgagttcccgtgcctatataaaggacccgctagtcatcctctgcctatcccctcaagtcccgtcttccgccgtcgtcggaatcactctccccgcgagctccttctctttccacctccggccgccgctccagccgcatctcaccgtcgcctcggtcgcctccgctctgtgccgtcgctaccaccgggatcgcagcaccaagacaaagcccggccacccccccgttgtcgccgcacatcgccggaaagtcgtcgccgccgtggacagtacctcgccgcccttcgaagctcgtcgccggccatcttccgtcgctgtccgtcattgcgtaagtgttggtaaggaccgtcacctcactctctttctcccggtgttctcccttttcgccgtcgctcaatagttcaccgatgatcgtcgctcccgtgtccgccatccggtgatatcgtgtggttgtcttatctactgccacctaaccgcctatttgtctctgccgtgccatgtctatctaaaccctagatcagattcaatctaatccgttggctcttggccaactctatgtcaaaattaatctcagccgtccaaaatcaatataaatatgttctctcttttcaatggcatattagtccttattatcatatgtcaactaccaaatattatttaatcttttccggaggatgttttaatcttttatctcagttataaatcatt

SEQ ID NO: 30191 - DNA, 791 bp, Oryza sativa
ccatgccgagacggtataaaccacttagattgaaatatatattagcaacaagattatatatgttcatagcataaccgatcagatagatctagcatgtatcggctaatactccgataccagtttatactaagatattaaagcaagtaaaatatatcaaacagtagtgtaatatacctagatgcaacaagattttaatataaagggcaaatctagcatgtcgattaagcacatgaaatataaggcaaaattaggtaaggtcggctgaaaccccgagactactctcatcaacaaccaagaagcaggctagagactgagattctaatcatgacttataaggtcaaactcaattgatgcagctataagtatgaaaagaagaacaatatctagacaatcaagccgttggatgtttcatagagtggtggatatcctgtacaatctaagtcaacatagatatttgacttaatcggctgccttccaataatagacatttagccgattgaagactagataacgatattgtcgaagattatacagaatatatgataactcgacgaattacataaacaagattagagtatcataaagatggaagcactaatcccgagaacgcaagccgccataattagttttacctctagttgaagatcaaaaccgatgcagctcaacccgaaagcaagaactcgtcgaaacaaaacgaaagtaaagggtggcgatgcgccgagattatattgaacgtgtgttagattcattacatggggctcggggtctaattatacccgagattacaaaat

SEQ ID NO: 30192 - DNA, 8836 bp, Oryza sativa
ccgtttcagttttatttccatctccgatgctgaaattaccaaatttggtcactaacacatgccccccaagtccagaatatttggtaatgtttcggatttgccatatccgttcctccaagaatatcgctcaatgccgtttttccgactgttaccgcctcgctttaaatactaaccatcgtccccgagaaatttcacaccattagctccgttttcactgcttaagccaacctcgtcttttctctctccggcgatcccctcagtgcaaaaggcgatctcaaggcgacttcccctccggctaaatcttccgcccgcagagatgtcgtcctccgctagcccgtccgtcgcaccatcggccaaatatgtggaggcaagtacgcatcggctagatcctctcctttcgcaatagattggtttttccttgcctcatcttgttttcttcttctctgttcttgtttatatctggagcacttgtccaatctggttacgatcccaagtctgtcacatgagcaccactattttcttggcccaatcggcaatctcgatcccactgaatttattatcgctaaaaccaataggatcccttttagattggccaacccgaatttaagtcactggaagaataccttcaaatcttggccttctcttgagaaaacttcccctgagaaaagttgggctgtgtggtataagcgtgtgtcggctagcaagcaagttcattgggatgaactaggaatcagccaagtacttgctcttactttagcaaattcggctaaagatgaacccctgatggcctatgctacttacttctggtccaataccctcaatgcttttctattcaatcaagggccaatgactcccaccctgctcgatatcaccatgcttactggattggatgtaacttgcatcggctaaccccatgagcttgaacatcaaaaaccagtttgattttaggaccaagagcataggtggctagtctggctatgttgccgcatacatgggcaaaggatctgtcactcccagggagcacacatcttttcttctgatgtggcttgagaaattcctcttttgcggatcaagctgtggccctaccaccaattggcaattcttagctgaagcccttgagactaagaggtagtttcccctgggcaaaatccttctcggctatctataccaaatgttgagcaatgcatcggccaagatagccacaggttcagtagtgggcgcgggtggaccgtggtggttgttgcaaacatggctcaaccttgttgttatgaaggttgtgaatcggccacctctgacagatgtagaattcccacggctggagcccactaccaatgatgatggagaagaggtcacccatcgccgatgcatgtcgtatggagaagctgcatcgacaccagccgattctggagcaaagctatcagccaaactactcaaagactggttctgcagtttctatgagggattccagagagatgctcgggtttggttcccatatgaggattcagtgaactttgacctcccagcaaacttcagatttgaggatatcgactccgagaaatttgacaaatccagagaagtcttctcggctgctattagtccttgcatccttcctgttggcatccaccaagggagaaatatacaagtgtcctatgagttctaccatccgatgagctcagctaggcaatttgaaatggggcagctaccaatcggcttgttctttgccgataagatctagtgcagaggagaaatctcatcaacattgataatggatcggttgcttaacatcccaggacctcctttgggcagtatcgagaacatagaactggcaaggttcaagagtaggaactttgacagatggtgggttgaatggaagcaacatatattccatcagtcggcttctatgtacatgacagacctatttcctgatgttgtccctcaggtacatctttagtttatcaattttgtttgaataattgttagctaacttgaatcttgactaacttctctctttaccttgtagacaacagaatcttctcctcctcgcaagagcaatagcggtagggacataatatatgctccaggccttctaccaaatggaggtggattagctcttccagtcatcggctaccatgccccaggacctcaagtctacttcaagggcagatgagagaacctgccgatgttggtaggaagagaaagaccaagtcatcggctattgatccatcggctctggttcccaaaaagaaaaccaagaagaataaacccaagccagccgatgacttgcctgccttagatccatctaccttggatgaagaggaaatcgaagaagatgtcgatcagcagcagccgaattgagtgatgaaggagataaaaccccatcggcttcacccaagcaaactcctccaactcctgctaccccgtctcacttctcaagggtaaaccactcaccatgactccttcttgtaatcattttattcatagccgatcacttataaatcttgtttttgcagaaaaagaagactactgtgaggaagaaatcggcagcaacaacacttaagctagctcgaccagtaagattttctatacaaatcctttaacacatttgaccatagctgatatttacttaacacttgtctctttgcagcctcctcctcctcctccttcacctcatgtgcagcaaatgtcaagtgaccggactccatcggctacaggaagtcaccaagttgaggaagaataacaaaccagccgctcctgccatcccagtaagtttttcactatcgtaaaattttagatcggctgaatttgtttttaattatcttcaaatttctcttttgcaggtcttaactgatctattttcttttgacatcaaggattatcttgatgaaatagaagaagacaccaccagtaaagccatagctcctctgtccgatgatgtgaaaagaacacttgaagacatctctcatcggctagaagcatcatcattagatagcttagtagtcgactgtggatcaatcaggactagacttcatgaaattcagtctttgatcccagatgacctagctaatattcttactctagcagtttatctcgaacaacatcaattcaggctggagaaagccaaacaaagattagctgaccggcgggaacgcgaggacattgaagctaccaagtcaatcggcaacttgtgcatgaagaaaaggccaagcttgatcaactctctgtcgggccgattcaatccaatatagatcggcttgaagctcgccagattgatcttatagcgcaacttgaagaatgtaatgtcgagttagacctaaaaaaacagaaattggtcaatctccctaatgctgttgaagaacaaaagtcaagattaaaatcggctattaggaatgttaccgatttgactaagtccctcaagatgatctctggaaccgacgctcaaaacgctcaaataattgctgaggtggaagagatcaggcaaaatgcaatatcggctatccagtgctatctatctgcatgattggtcttgtaataggatttagaacaattttttgtaatcggctcggaaaccttggtgttccttttgttactgaactgttgtgccgattaatataacttctcaatgtgctcgctcaaaaatttacaaatttgcaacttgtgtatatatatgcccccctaattttgcaatgacgaaggcattgataaaattataatttggactaagggcgatataacaatatcggccattgtatatcggcaaaacacaaccgattacaatatgaaaacaactaagggcgatataataatatcggccattgtatatcgacaaaacacaaccgattacaatatgaaaacaactaagggcgatataacaatatcagccatctcaaggcgatgtaaatacatcggctatcatgtatcggcaacacccatacccagccgatcatgcattaacccaaacacttggtaatattttttcaagtacttgccatttagtgctcgtccataaacttctccatcaaatccttgcaacatataagcccccttggacacaaccttgtggatttggaacggtccttcccaattcggtgaccacttgccgaatttgttatctcgagtctctatcggcaaaatcaatttccaaacaagttcaccttcagaaaaagacttgggcaccacttttttgttgtaatgtcgagcaatgcattccttatccttggtaacttttgcaagggcttgttggtatttgatacggttacagataaaatctgcaagcgcacggatataccgtgtagcacttcccctactgagtattccaagggtatcaaatccaaggaaacatgtgtgatcagatcttcctctggttcatccaaggacaccaagcaaatgataggccaggatagagaggatttaatagtgagaaacagtgtctagggaaagcttaactttaatcctaacgcaatacttcaagcactggcaacccgctgttcccagatgtcgctctactacgtacccggatagggagaacttaagtgatctcgagggctttcaccacctctacacccacctcaaacgtactgtgggatatgcatcaattactgaataacaattacctaaacaccacgtctaagcaattaatatatactttagtgtttataactcaccaaagcaatcactatattttagttgattatagtgaacaataatcccgtatgctatttaagaactaaccaagcgataattctcacaagataaatctaaattactcaagaagaatattatagtgaattcagagtaataaacagaataaaagaaataggagaagattaccgacaactctggaattcttccgacttcttctactctactttcttcctattctagtatacaatatagtacaatagagcctcttataattcagctcaagcttggaagtgtgtgtgagagtgaatgaagtgaggtccttttatagggcagttatgacggttgtgagaaggggaattgtccgaattgccccgcaaccgtcattgggagaacaactggaacgtccacgccaaaccccaggatcaacggtgatcagggggggttcggccgaaccagggggttcgaccgaacctgggccgagccctcctggcctggccttcagttggtggactccttggaccttcctctgtccatttctcggagttttgggttgattcactgatgtcttgatgaagttcacaacccatccttgtattgatacatatttctcctcactttagtctgatttacctcccaacatcggagtttatcatctgcatacaaatatataccaacacttgtggaatatgtgagattaagcacctatcactatattggttgttttattatccgagctttatacagatgttggcggtatgaaatcgacttttaacagccgccaacaaaaccccccatacttagccctttgctcgtccctaagtaaagattagtgtagaatgaatttcttcaggatataaatcaagcatataaatcattcacaaccatacctgcacctgtgaactttatgagtggctatcttaccatcttgagtaattgataaatggaaagatcttgattccagtccttcttgcttctctgtcaaactcatgggattttatgaattttcgcaaactagctcttttcctcatattgactttctctcttgtccctcaaagatgtatattttctttggatcctcaccaaggcaaaatgtaccagaacttatccctattctaaggctaatatgtggatcttggtagggataaactgtgacgtacctgcatcatatatattgcaaagccaaaaatatggactcaagaagatcatcaatcatactcctagatcaagggtctttattcatggtggaaaagtaaaatatgttgtggaatggtggaataaataaatgattctccctttttcctatactttctctccaagttggttctcttggcatgattgtggaaggggcatggctatattttctttgctcaatgttttcagagcaaactttttttcttcttctctttttttttcatagccatgcctttccctccttttctcattttctttttgccaagaacttttccaggagaagaaagcatagttcactgtaggagtttatttgaatggatatttttgtggaaagccaacatccagtgtagaagccgagcttaattttatatgtggaaatggaaagtggaaatgataatgaccccttgatcatgagagtatgaaagatatctaacacaagtcacacaaatttgacaaagctcaatataatgtcaagcagtcatatgcataacaaggtttatcaatgatatacttgcatatggccttggtaggtataaggtaaaatcaattggaggattgagcctttaaaaacaattttactttaaaaacaaatgcccaagagtcataacaagagttgcaagaatttctttcatcttaatcatctctcataaagcaatcacttggatgtataaagttccctaaacatggatgggtgttcacaagctcgagttcagctgagaataatgaatatataagatcaagggttaattagatccatgccactagaaatgtggaaaatcaaaaatatgccactactattcaagttatctgctgagtgccacagtaaatttctaaaattagaaacgtgccactctagtcactctttccgtcctcctcatcctttctccgtcctccccatccttaatcatgccacagccgcagccgcagggcggactcccgcgcgagctacctcccgacgtagaacgtgaaactggcggagctcggcaacgaggcacaggtcgcggccggtgagatgttggtgatggtctccggcacggcccggcgcatgatacggccgatgttggccatcgacaggaatcggtcctgctccttccctactcctcctccaccgccgccgctctccgtcccgtcgaacccctccgacatcgctgggccctggccgccggatttggacttgtcttgtcttgtctagtgctcaatggattcagaatggctgcagcgatgcagaaacgagagggaaaattagagttaaatcagctgctcctgtctctcagttaattttgtactaccaggaggtgagacagtgcatgcacagtaagtagtgttgattgatttatacaacggttttaaattttgtttattttcctgatttgaaattgaacaaaggtctttagaacaaacctatttgtgtgattctatcccagatcggcaaggaactccctgcatccagtggaaaaacctagcaaaagactgccaactctgcatcaagcatcatcagttgcaagcagattaacgagggcgggaggaggaccgccgcttcttgcaaccaccggctgcggcgcagggcgcggagaaggcgaccacggagtctgcacgctcgatgcggagctcggcgacgaggcgcaggtcgcggccgttcccacggtcggcgagataggcgagcacagcagtgtcggtggcttcatccgaggcggtggaggaggaggagaacggggagaggatggggatgacggacaggttgacggggaggatggaaagagtgacggcggtggcatggttccaatttgaaaaatttacaatggcatctagcagataacgtgaatagtagtggtatatttttaatttgccacatttgaaggggcatggatccaattaaccctaagatcaatcacatgaggaatttcattagttggaaattttatctgatacttatgcttgaaccaattgttttctgaattttcagctctagtactatgccatggtggagatatacagatacaagacgtgctcacctacttacctgtgaaaattgagaggtattggggccaacactggctcggccgaaccactctggtgcccaatacctctgcaactttctgcagagttcaatgcttccaggtgttcaaacatttaatcaattttccgagtatatgcatgtcaaaggctgggatatatcccccacacttattcaaaacctgaactttattaagcatgaaacaaaacaaactttggcaaacattggggttaacaccaatgagccacattattcatagcaagtgcttacatgaaaggaaagataaagaccaagcacctactactattttatttatgggaaaggaaatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctaacggccgccacgacttcatgcgaactccgatttgggcgtgcaagtacttcatggaaagcttatcaagtctactttcaaatggatccagccacatgtccatatctattctggagcggccgcaattgtcattttactcccaactattttttgtccatggtgctgcgtcacctcttttggcccaatgggctgtgtatacatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaatcgcccgtctgcctgtaatcggaaccccaccatattgtgtttgatagtgaaactttcatctttatcta

SEQ ID NO: 30193 - DNA, 2074 bp, Oryza sativa
ggggttccaaagaacaagcagacggacggtctagccgacacgcgcgctgcaagcaagtacaatggctaactttaatctaacaaaaacccaagaaccctgaaggggtaactagctatatataggggtggaaggacgacctaggggtgcctagggtcgtgctccaccaacttggggcgcaccccacatgggccccacctgggccggggtcccaaatgaagttacaagcccataggcccattataggtgatgcaataccttgttcctgtgattctggccacacgagatagaattcagagaagaggctggatccattagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcacaaagcatctgcaatcacattatcttaccctttctcttgtttgataacataaggaaaagattcaataaattcaacccatttagcatgtctacgattcaaattattttgagaacgaagatatttaagcgattcatgatcggagtgaataacaaattctttaggccacaaataatgacgccacgtctctaaagaacgtacaagagcatacaattccttatcgtacgtggaataattcaaaacaggaccatgcaacttctcgctaaaatatgcaacaggcttaccattttgcatcaacacacctccaatgccaactccagtagcatcacattctaactcaaaagtcttaccaaagtttggaagttgtagcaatggtgcgtgtgtaagcttgtccttcaaagtgtcaaacgacttctcctgtgtctttccccaatggaagaccacccctttcttcgtcaactcattcaatggtgcagcaaaggtactgaaatctgtgacgaaacggcgatagaatcctgcaagaccaagaaaactcctgacctgtgtgatagtttggggaaccggccaactctttacggcttcaattttcatctcatccacctcaattccctatggagtaacaacatatccaagaaatgaaactcgttccatgcaaaagatgcacttttcaaggttagcaaacaaacgtgcatcacgtagagcattaaaaacagcacgtaaatgatccatgtgttcatccaaagacttgctgtaaatcaatatgtcatcaaagtaaactaccacaaatcgtccaatgaaaggcatctatgaagaaggggaggatgatgtgaccatggctactatggatacgatcattgctcacatcatgaatcaacaagaagacatcaagatcaagtcctccatgtgctgcaatctgattcggccacgtgttacattgctgacttcaaatggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatggacttgtaactttgtttgggaccctggcccatgtggggcccatgtggggtgcgccccaatctggtggagcacgacccttggaccctcttggtcgtcctcccacctttataaatagttaggtaccccttcagggtttcttgggttttgttagattaaagtttagccattgctacttgcttgcagcgcgcgtgtcggctagaccgtccgtctggttgttcttcggaccccacttatcatttgattaaattcctatttgcaatatcagaatgctttattcttggtcttgcttgttcttcgaattgctggcaggaataggggtgatctgcaccggcaagataaccaccccacggagaggtgtatcgatcgctaagcgcaacataacgtctcgtacggttgtagtcggatcgtcaacgttcttccaaatatagtgatcacaactcaccgaaagatcg

SEQ ID NO: 30194 - DNA, 26063 bp, Oryza sativa
cacgttttgtaccacagtcgtcgctgccacgtgtctctgtggtgtcggaacctacgaaacggaatcggctcgctgccacggttctatttttgtagtttccgaaagtttctgtcggtaagtttggaagttcttgagttgcatctagagtttgcggatccttgtgtgtgtttgttttggccgtgcctgtgtcgtgcacgagaggaggaaggtgaattaccatatctgattttgaaagtagtcaagtttgttttggaaagatatagtagattggattggttaaaaatcagtttcctttttatcccatacaccaaattcggttgccatccactccacctcctggccgagtcccactcgcccctttggccgagtccgactccctccctctcttccaccgttccgagttgtgtcaaacaccttggcgaatttttgtttggtgtcggtttcgagatctgtttggaaaaacggaaccggcataaattcagcattccattttttgtataattttaattttgggtttagacttttacatttgagtccctataaattttatatttatgtttgagtccctgtaatcttacattaaggtccttgagtcagtttttgttaaaaaaataagaaaaaaagtgagaaaaaaaaaggcagaaaggtgcaaaaaaaaaaagaaaaaaaaagccgcaccaaaaaaaatcagaaaagaaaaggaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaattttgcgttctctgatttgagcatttgctattcctttgctacatatttaagcctacccagagctccacagatttgattgcagccgtacagcaagtgtttgccgaggcatcgatatatccaacctctattggggtgcttggttgagtcggtgtacatcaccattccacttgcattggtaagatcttgtaagagcttggttaaaagcttgagtgtgtgtgagatttgagctgccagtacctagtagttgataggagcgtgtatattcttgtgtatgtttcttgtttgctgctaaccatggcaggattgcgcaaggggaaacaagatggtcatgctcaacgtcaacatctacaccttcgacgagatatgacgacttcttcacgtgatgcatatgaggtacatgactataattttgcacaagttgcatgtaagttaccagtctatgatggaaagtatgattccgctgcatacattaattgggagctagcagtagaaaaacaatttgatgagtatgatttttctaatgctcaaatgattaaggctgctagtaataagtgtgccggttctgcatctttttggtggcatactgtggggaataagcttgaaacttgggatgaatgcaaaatactgatgagaaaaagatttatgttttcatactatagacgtgctctccttgagaaatgggaacatctaaaacaatgtgacaaaactgttagggagtactttcatgattttaaaatttgtatcacttatagtggtttacaagaatcaaatgagaacacaatgactagatttttcagagggcttaatttcaatattcaggctgggcttgttaatgtgacatataatcatataggccaattgttcatgcttgcttgcattgttgagcgcaaaattttggagaatccaatggagcaacaagatatgcttgtgcctcctatcactgatgttttgcaggaagttcagaaaagtctccaaaatgagaagaacgatatgtttgagatgtcacttccatcactcgcgaatgaggagaaggctgatgcagctacattatctgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgttccttgtgataaagaagagttgtgtgataatgtttcacttatatccatgccacaactagtgaatgaacatgttagttctactatttctttgtgtgctgattctaagcatgttgttcacattgctaatgaagtagaggaacgcgaattgctatcttctttaaatactttgggctatgttcagtttgatgatttttgtgagcttgataatttgaaggagaaattatttgctaaatctgatatgccatgtccaactaatgctatttttcatatctttggcgaatataatgatagaggaatatttttggtgcatagagtttacatttgttcagatttagaacatcttgtagttccggataaaatatgcaagctagagagacatgttactgctaatcatattgtctcgagtttgtcttgttttgattgcaagaaataggttgttttcagtggactgcgcgaagagcaccatatggaaaaaccgaggacggttttctgtgaagaaggggaggatgatgtgaccatggctactatggatacgaccattactcacatcatgaatcaacaagaagacatcaagatcaagtcctccatgtgctgcaatctgattcagccacgtgttacattgctgacttcaaacggccgccaaatctacatacgtgctccgttttgggcccgtgagtacttgacggaaagttctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataaatagttaggtaccccttcagggttttttgggttttgttagattaaagtttagccattgctacttgcttgcagcacgcgtgtcggctagaccgtccgtctgcttgttcttcagaaccccacttatcatttgtattaaattcctatttgcaatattagattgcttttatcttgttcttgcttgtttcttcgatttgcttgcaggaatagggttgatctgcactggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcattacaggccgagggagagagagggaggactttgggctgggctcggcccaaaggaggaaggagggtttatttttagtttttctttttagtaaactttgataattgttattgttgcttaataaatattttcggtgctctgaaaattcaagtaaaatttgagggctctttttagaccaagaagaatttgacaaaatttctccgggccacattcgaatttttcttgtacatattttagtgtttgccaatttcatttcgaattttaattaattctattattccttttagagaatgatttttaattcgggatgaatttatcaggacgtgacacaaggagacacttggagaaggacttagagccatggaggatcatcgaggacgtccaagtcaaggtagtggcccaaaccaattcgacctcgggtgcaattcggataccaggaccagtctgcactaaaacgggagcctaggtcgcatacgtgctcggattggggcattctttatatggatggaaagctaagaagataacctttccaatggttttggtcccacatccaaattatttccgagtcaatgggaatcgaccaaacaagttgacattcagaatttgttccggtgctgcgtcaccgtatttgggcctttgggccgtgtatcgtgctggaacccagtagggttgcgtcgagagtgggttgcacgaccctaaactctatatatcagtaccaccaccatctttaggtttttggggtttgcttagattaatctgtcgaggacagtttcatcgctagatcggtttgtaagaccccaactcgtgagcttaatcattcatctgcaattttggttgttttctatttctctcttgtttttgttcttcgattggcaaactgccgggtcccaaaactaatgatttggtaaccgacatgttaaaactgtatcaagccctggatcagtagattgatacaagttcaatattttggatcgtctttgcttacgtttagacatagctttgaaggagatattattacataaagtaatagggtatttacaagattgtggttaactattacagcagaagctttagaatggcctaactctgttgttttgctatagacttaaaccatctatctaatctagacttgagaattaggttgaaatgaaactaacttatatgattgaactcccagcttcggcacaaactccaaatgaactctgaaaaagggggttgaagcaagggtgagtacaacgtactcagcaagctattatatttaatcaacaatgaatgtatgaaataataatatctgtgtaaagctaggtttacttgcaaaaagcagagaatgtagaagtagaaaacctgtaatgttttaaatgcagcagtatttaataaaatttcaaattaggtttctatccaagatgccatagtgagtcccaatgctcgataaccgcgagcacggctatttgaatagttttgaggatattcatactacagtagatgtacgctttacccgcaatccatgacgtgccaaacacattagccttgtcatggcaaagcttttcagttactaacatcagtggtacctgttccatgaactctagtccccatgcactctgaacgtaacgttatcagcagcgagaggagttctggcgttcccgagggctttagagagaactgattgtatgacaccatgtcatcgcaatcagggttcacaaacaatttgtgcacaattcatttcatatatttacctgcgcctcggtaaatatcacaattgcccttcgcggcataaatttgcctcctgcacgaggacttaagaagaaccactatacagaggtaccacttttgctagataacttaatcagctaggtctatgcccatacgagaattgcggtcgtactcatatgttcttcacatgtacttggcagtcttatatcggttggaacagtactagccacccggaaatcaaccatttctaccgtactgtcccaatctaagttcattatattttatgcattctaactaggcagggctaagcaaaagctagcatatatctggtttgctatatattcaggttatgcattcaaaatcatgtatggccaatgcacaagatactggagatatagaatataggattattatgctcaaatgggaggaataataacttgccttgctccaacgcaaacaaatctgagataggcaacctgattatccgatcctcgaaacaccacaggttgccatccaaaagataatagactctactaagaaagacgaagaaccaaattcaataaaaatcatgaaatagcaagaaagtgataaacagcaagaagggctaggcttggggtataaatatctctgttaaaggcgtataggattctaaagggttggaggctaaggtggagaggggatccggcaactaaggttgcttatattttatgtgaatgcttggttgttgaaagcataggatgtatattggataattgaactggttcagttgatgtatggctagtattggctggtggtaggttcaggtagtataatacctagggtttgattatatttaagccgactgcggagtagagaagcatatcagctaggctctgtatagattctaggagagtaggtggctgagtatagtggataggcaatattggtaggtgggatatttggatgacggttgggttctaactagcaaggtgttagctagggtttggttgcgtgctagtcgatgctagagcataatgactaggtttggtattttctctagccggtatcgacagatagcatatcggcaagagggattggaggtttatacaggtttagtggggcggaagtgttactccgacaaccgtgagtggcgacggagcgactagaatcgcacagagcttgagagcgaactgtgtagcgtgctgtggaggtcgagggaatagtgaagctccgaccgttgtacgcagcgaggcgtacggtgccaggagcagcacttcgaccttgggtttggtttatgccgagctttacaaccaacggttcgacgttggggtccatagaccgtgcgaacgtccccatggaaggcgtaaagttccaactgatggctttttagtggctaaagggtattttgaaataaaaggagatatttgaaaagcaaatgacatttaaataacttaaggaaatccaaataaaatattaaaatagcaaatttggtatcaaaatgtagattttgaatttagatgaatttaagtccaaatttgactgtaatcggatctacggtttaggagatatgggcttctaaataataggttttgaattaaatagagaaaataagaagagacactatgcaggggacccacctgtcagtcttttctttttctttttctttctcttcttcttcttcccgcttcttccttcttcttctcttcagtcgaacagagaggaggaggagaggggcgtcgaggctccggtagtggagaggcagcgacgccggcggccagtggtgttcccgggtacagaacacctagggaaggaagtggtcggcaaagggggttaagggaatggctggaacggcgagcacaagaccgtgaaccgacaggagagagagagcttcggtggggcttgatatgggacgaaagagaaggggaaaagtggaaaaatgggtttgccggagtaaggcaaggttggtggtgagaggatttggttagtggtgctccggtgagagagatcggctgacggtggcggcagccggtcttgaggaagagagagagaaagacagagctcgaagagctcggatggtgtggaggggaaaaggggcgacctcatcatctatttataggccgcggaggtcggttgccgaaggcggttgtagaggcggtcgtcgactcggccacggcgacgctgtcgtgaaggaagaaaagacagtgccagcttccttctctgattggatggcgacggcggcgcgtgcacgtggtggctgccgtatggctgggcggcggcattagagaggcacggcacagcgacgccttggcgtggtcggcaagttgactgcggcggcggcgtggagagaacggcgggcggccggtttcttagcggcgaaggaaggcgttggcggcgtcgtgcgcgtgtgcaacaggcgcacctggaggcggctcggctatgggccgatttgggccggcttgggctgatgggagatgaaaaaggatttcggcccaaagtgaatagaaactgtttctgaattttgaagggggtttgggtaatggaattgaataggatttatatttgaaaagaatttgaataggaaagtttggaaggaaattatatatggatataatttccaaaagagatattttctaatttgagtgcaatatttttggaagtggaatatagtggaatttatatagatgcactcaaatgggggagagagatatatatttgagaatgtgggaggaaaatggagggaatggaataaataaaattttagcccaaaatatgtggtaggaaatctagaattaattatgggctaaaagaggttttggatttgggatggaaggatgaaatatatcttcttagcacaagagcaatatttgcaatatttgtaataatattattcttgtgccgaggaggaaatcaagccacgggaattaaattggcggctagattgaaaggaggaatttggatacttgagatttgtaaagggaactaaggataggtttggaatcaaaggatgggtcgacaattaattccaattaaaattggaatttcaaagagttggtttggagggttttcttggaccataattcatacaaatgaaaagggttttcaactaaatttgaataagaggaattttgtcgaaagaaggttttaatttaaaaccaaatcaagaaacaccttaatttaaccaaatatatctttaaatgaaaaacacaaaagaagttaaataccagagagggattttatgcaaattagttttaggaggtcctactaattatattttcctaggtttaggaagttattaaaaacataagaagcggcatgatgcataattagaaaatagctaattttcagtatgttacacaaacagggattagccttctcagcgaggtcacccacgtttcgacacgggtgataaccagaggagacgtggtgctgcgattgcggggctcaagtgtgtgcgcattcaagaagccggatcgatttgtgtcgcggctccgcccaaatcgttgtttatcagaacctttcggaagatcgggaaccctagtgcacatcactgtcattggctatcgtggccctaggacttcaactcttcttcaagggctcagcagagaaccagccgataccggtaaaaagagaaaaaccaggtcatcggctgcagatccatcggctcaagctccaaagatgaaagtcaagtcaaagaaaacgaagccaactgatgatctgcctgccctagatccatccattgaacaagctctggatgaagaagaaatcggcgaggatgttgaccaagccgcagatgaagtaagcgatactgaaagaactccatcggcttcacctaagtaaactcctcgaactccttctgccctagcccatttttcaagggtaagcaacttcccttgattccttttgtaatcacttcattttatggccgattactcacagattttatagttgcagaagaagaaaactgttgtgaagaagaaatcggcaatagcaattctcaaatcagctccaccagtaagatattcttaactcttccactagttgatctcagcctgattttatctaacacttgtctctttcgtagcctcctcctcctccttctcctgtacaacaatcatagagtgatcaaactccatcggctgtagaaagccaccatattgaagaagaagaacaaccagctgttcctgctatcccagtaagtcttgtctataaaaatcttgaatcggccaaatagctcatgttgatactcaactgttttcaaattccttcttgcaggccttagccgatctgttctctttcgatattaaagactatcttgatgaagaaacagaagaagacaccaccagcaagtctttagttcccttgtccgatgatgtgaagaaaacccttgaagacatctctcatcggctagaggcatcatcactagacaacttggtggtaaactgtgggccgattaggactcggttacacaagatccaacctctaatcccagatgagctagccgatgtcttcacttcagctgtctatcttgagcagcatcaattcaagctggaaaaagccaaattaagactagccgaacgtcgggagcgcaaggacattcaagtcaatcggctgcttgtgcacgaagagaagtccaagcttgatcagctatctgagggcccgatcaagtccaatattgatcggctcgaagcccgtaagattgagctcttggcacaacttgaagaatgcaacgccgagctggatatggaacataaaaagctagccgatctcccaaaatctatcgaagaacagaaggcaagactaaaattggccatcaagaatgttgctgatctcaccaagtctttaaaagtcatccctggaactgacactcaagatgcccaagtaattgaagaagtagaacaaatcaggcaaagggctatttcggctatccagcaatatttgtctcaatgatatcttgtgtaataggtcttagaaatttttgtaatcggctaagaaactttggctctttatcgaacttatcctcataattttatgccgattcaatagaactccatattttgctcaaaaatttgcaattttcatatatgtgcccccctaattttacaatctcaaaagcattgataaaattataacttgaactaagggcgatatgaaaaaatcggccattgtcccatcggcaaaccacaaccggttacgataagaaaaaacaactaagggcgatataacaatatcggccattgtacatcggcaaaccacaaccgagtacaatatgaaaaacaactaagggcgatataacaatatcggtcatctgaaggcgatgtaaacacatcggctatcatgtatcggcaacattagccgatcatgcgttaacccaaacacttgggtaatatttcttcaagtacttgccatttagtgctcgtccataaacttctccatcgagtccttgcaacatgtaagctcccttagacataactctatagatttggaacggtccttcccaattcggtgaccacttgccgaatttgctatcccgactcccaatcggcaaaatcaacttccatacaagttcaccttccgaaatagttccttatccttggtaacctttgcaagggcccttaatctagactgaaccaagtcttccctttcattggccatgaggttataatactcatcggctgttaaatcattttgcaactccgttctccttgagccaattctaacttcccatggcaaaatagcctcatgtccataaacaagcttataaggagggacttggatcgatccatgacaagccatccgataagaccacaatgcttcggctaatcgagtatgccatagccaaggataatcagaaatctttctcttaatcaatttgatcaaactcttattagatgcctcggcttgcccattagcttgtgtataatatggtgaagaattcaacaatttgatacccatgctataggcaaactgaacaaactcatcggacacgaaaattgaaccttgaccggttgtaatggtttgatgtggggacacccgataaagtcatggtgcacccacgaatacgtaaccgcccaggatgttcagttacgcatgaaatgatataaaagcataaagttcgattatacaatacttaagtcacttagttcacaacacaacataaatacaaatcattacatatatggcctataaagccttatttctataaacagataaactactagactccatcacaggaactgcctgagcgtaggatgacgtagaaaccatagttgtcccactctaatagattgttgtcgaaacgacaactgcatacgtcgaaagacgtggttactcaacagtggttggaaaaatgaagtgtactaaattttgaattttacatgggatccccccattacatggccctaggggactatttatagccccattacaggtccttactaccagggtttaggttgtacaggggaatttacatgattacccttaaagaaggggcatttacaggggtacataatgttataggggctcatgggcccctgatgggccgtttggcgatcgccggcctgatgggccggaaaggcttcctcggccctcgcgggggcgaacttgtcaaggcgaagtcatcctccttcggcagacagtcttcgccttgcacccttcgtctgagacgcctctggcctagcgctactcttcgccttgcgctgctctcgctccatagccttcgccatgggtttcggcaggtttcgtcgaagggcctgatgccatccgccaacaagcccctcacgggcaagggtgagactggagcttcggccaagaccgtgcaaaccatgtggtatggtatgcggcgccccctttcgaccgatgctcctaccgaaaccaacattatacctgcgaatgaagattattatttgtgcggctggtattattttgccgcgcttcgcctcgtgcgattgatggttatatatattcttttttcctgggccgaacgaaacagtattgggccttcctttcttgggctttttactgtgctgctcggtcgacaggaatttaccgtttcgcctacccttgcgacacgtggcgctttattactggtgggtaggcgaacggtcgcttgagcgggctatatattcctgttgctctatccttttcaccgccacacttgccattttaccgtgcgcgctctctttctccatctcttcctttcacagcgtctttcgacccctcaggcgtttcgccgaatctcttttttcgccaccgcaaacgcaccgttcgccatggctccacgtaagccaaaccctacttcggtgaaagggccggatcccggccgagtcgatgacgacagcaccgcctttctgggggtctctcttgtggacgacgtcgagctagcgaagctggtcagctccggagggttggttgaggggcaggctttcgccctagggaaaaccgtggtgccgaaacctgtcgacaaccggacggtggtgttcgccgtattttttgaggcagggctacggtttccctgcaacgtgttgttgccggagatccttcgcctctttgaggtggaacttccacagctgagcccgttagcgcttgttcagatcgctatcttcgactgggcgtgccggacttccgagtttgagcccaacgccgagctctttggcgccatatttttcgccaccgtgaactcgaagaaggtaatcaccctggctggaacgaaaaaaaccgtgttcgggagcgtgaacttcaacgttcgccccgagcggtccgatctctggccggtgaacgctgctatgtcgaagtgggaccgccattggatggcgaggtggttctaccacaccatccctttcgaggctggttctgaatcagcgaaagccctccggtgccggcgtagggtgattgcgccgaaccggagacccaagatcgctgtggacggcgccatggaggcgcggttcgttctactgcggaaggtttgctcccgccttagctgccgtgacttggtggaggaattttgtatgcttcgcatttttcccctctcccagtcatggcaagtcgcggttgaacaaggcgaagaagtcaacggtttgccgaacctgatactccctgaggggcgaacagtaagactgttctattgctatatactgctgtgctttgttatttcgccttatttgacttttgacgtagcttcacgctctacttttacagtgttgaccctcgaccaggccgaagtcgaagcccgcaggatgatcggcgatgtttcggtcatcgagtatagtcagctgttaacgcgtcaagcggctgggcgggcgaaccgggtttacaatggcgaactgcctccccgggcgaatccccaaaaggccgacgacgaggcagggccttcgtgaaagcggatgcgtggacaagtgaagcttgcccccaagaagcgaagggttcctgcttcgtctgactccgacaccgacaacgaggatgatgccgaagaacgtgacggcgaggaggaaggagaggaagaggaggaggtggaggctgtggctgataaggccgcgggtgaggcggtcgaagaccgcgccgacacccccgggtacactcctaccccaagtcctagtcacaacgaaaccggggtggagtcgaacagctccccccttcgtcagaaggatttggaaggggcgaaggccctagttgcgttctcttcgggcgcgtcggcgaagggaggtcctgtcaagaaggtggctaaaaagaaagggctcgtcaatgtcgctcgcgtttttagcaacgacgagtcctccgacgggactccgacttcacccgctggtcgcagcctggatctttcggccgcccccattcctccacttggcgccgctagagtggacggtagtaccgccgctggggcttcggcttctgcggaaaggattgtgatggccgcggcgaaagtattcggcagtcctccgcatcagccggttgcctcgccgctgatggaggcgaagggaaagagagcggttgctgagatgtccgcttcggaatattcgctctcggtaccccgcttcgcccctggcgacttcgagacgcgagcggacctccttccttttgtggaaggggtaagcaatcttgtactgcctgccagcgccccgagcttgttcaccgaactgaatgagttcgacgaggggtgctctgctataaaaagcctggctgttcgggtacgtttcccccccccctttttatctttactcttcctctatcttgtttttacaattgacacttgttctcttcgccgctcgtattctgcgcccagatcctcgcggctcagtgctcaacagagcgaaccgtgcgagctcgacttgatgggttcaaaagccgtcttcgggccaaggacgacgaactaggccgcaaaaatttggacatggaggcccttggcaacacccttagggaggcgaaggccgaaagcaagcggcttcaatcggaactagagaaagggaaggaagctagggccgaagtcgatcgcttaaaggccgaactggagaaagagaaggcccacaccgccatgctcatagattattataacctcaccgagccgaagatggaggctctttggcaggaggttcggaaggccgaagcaagcgccgcagaggagtcgcggcggttttcgcgggagatggtgaaaaccaccgagtccgcgcggacagcgtgccaaacgcttcgccttgcccttactgatatgggcgcgaaggtgcgggatgtcccctccgaagatgccttagcctttgacttctccgaatggacccaacaggctggtggttcggtttcggactgcgccaccgcatacggcgattgctgtgcacgcgtgtcagcggcctttaccatgggcctcctgcagcagttcttagattttcatagggggtggaggcgatgcccaggatcacccagaggtgtgaggccctccgcccttctcttagattttcatagttttcttttggtgttcgctagatgtggcgaaccattgtatattcggcaaactgccgctaaaccttaaaaaaaaaaaagcttttttgcatacttggactgtatgataattttaaccactttttaacgattaaagtctttggcatattattatttcactcattttgcattatgccataccttccccttctttcgcctattcttaccatgcaagatgtgttttgccttttctgcactgtctaccagggggtctgccgaaaatcatgcattcgggccccttctgggagctggcgaattcaaaacgagaaatttgtggcattgaagggtttgccgaaggtgcgatgtccatttcgacctgtttatcgcgaaatggaaataaacggtcgtagctataaagttttcaaggttgccaactggctgcgggcgcaccccgggcgaaccttagaagattacgatcttgttcattcaagacgtttggaggatatggctcgcttttggcgaaaccatcagaagactaaacgccaggaatcgatctttcagcgtcgttacagtttagtctgtgtttcgcccccttctcctcttaaggttgtgtatgacattagtagtgatgacgaacctagttcatccgaccattccttagggagggataatgattactggggcgaaaatgtaatttacttgtaaaatgaattgtatcgggttgtaaaccttgtactcttcgattatttttttgaagctaataaagagcgtgctttatttccttttcgctatttttcgcatcgtcacactttgtgcttttgttaggtcggaacatgctggcccctttgcatatagtagcgaaataggtgtagtgacttttcagcttttcgttgttcgtttttgatctgtagcgttctgtgtcgagagaaacgcttttgcttttatgctgatcggtcgtaacgtcgtttggctatttattttccaagacaagctgttgcggtttcaacgttcggcgagcaatgcttcggcagattcgtttcgcccccctggcctttttcgctgatcaggcgtttgccttggggtttttcaacaaattatcaatcacacgaaaagaaataaaaagaaggcggaggagacagagattttatactggttcgggcctccatggtggataatagccctacatccagttttttttctcttttttccttttttttcttgccgaaaggcttacatagtgccaaaaggcttacatgataatatgtacatttttacaagttggcgatttgggtgccacccattctagacatagaagcgcttgagggaggcggcgttccaggaatggtcgaactcctcgcctttgagtgtcgctaggcgaaaagatcccgtcctggacttgtgtttgatgatgtatggtccttcccactttggttcaagcttgccaaccgctactgggttcgcctttttccttaagacgagatgaccaggcatcagctccgtgggtcggacttttttgttgtaagttgccgaagtgcttgtggcttacttctgcatgtgctcgagcgcttcgacccttacaccttccaagagttcgagcgatacctcgcgcccctcttcgcccccggagaacataacccttggtgagttagcccctagctccgctggggtcattgcctcatcgccataaagaagcataaatgggctaaacttggttggtcttgtgggggtcgtccgaagggcccaaagaaccgaaacaattcttctggccatttgcctttcgccgctccctcaagtcttttctttagtgcttctaggatcttgccatttgtatgttcggccgccccatttgactgtgggtgcgcgaccgacgcgaacctgatttctaggttaagcccttcgcacatttctctgaacttatcagagtcaaactgcttgccgttctcagtaatgaactctttcggcaccccgaaatggcaaacaatgtttttccatacaaacttctgtactgctgccgaagtgattaacccaaggggttcggcttcgatctatcgagagaaatattccatagctacaattgcaaatttatacccgtttcgcgccaccgggaatggcccaataatgtccagtccccatctggcgaagggccatattggtgcaatgggctgcagatcatactggggcacggcttggctttggccatgacgctggcaacttttgcacttcttgatttgctcaacacagactttcaacacagtgggccaataaactccttgtctaaacactttggaggccactgttcttgcagcctggtgcgcgccacatagcccctggtgtatttcctttgccatttcttcgccttcgacaaaagagatgaaacgatgtaagggttgaagtaccccggagcggtaaagctgacccgagaccatcttatacttcgtggctctgagttgcaaacacttcacttctgcttcgtctaccggaagccagccagtttcaaggtgtttcacaaatggggttcgccagtcatatgggtcttcgcccagtttctcttggtcgattgtcatgacttccgagctgtccatgggcacacttggagcatgtaggacttcgaaaaagatgccaggcgaatgcgggccaccacaagcagcggatttcgccaaggcgtctgcttcctcattttggtctctaggcaagtgttcgaccgttatgccggtgaagcattttttatggaccgaacagcctccagatacctcttcattccctcttcttttgcctcgaaggatttgtcaacatggcctgctaccaacttggagtcagttcgaattagtaggcgccggactcccagtgctttcgcctttcttaggccaaggagaacggcttcgtattccgctgcattgttggttgtgtcgaactgcaatctcgctgcgtaccgaatcggcacaccattcggcgaaaagaggactgccgcaacgcctgcccccttgtgcgaccacgaactgtcagagcacatcacccagaactggtcgtcgggctcggggtcgggggcaagtaccggtgtccattcagctacaaagtcagctagcacttgagacttgatagcagagcgtgcaacaaaatgcatgtcgaacgggcatagctctgccgcccacttgctgagccggccagtgacttccttgcatcggagtatttcgcccaaggggtactgtgatgggactatgactttgtgggcctggaagtagttcttgagcttgcgcgaagccattactagagcgtaagcaagcttttccatttcaatgtaccttgtcttcgctccttgcagtgcttcggagacgaagtagaccggtttctgtccagactctgtttcttggacgagtgcagcactgactgccactggcgaagctgccaagtataatagcagttcgcttcctaggggtgggcttttcagagctggtgggctttgcaagtattgctttagctcctgcaagcttttgtacttcatgtacgcttgacggaggcttcattttgacgaaggcttcaaaatgtgccgaatagagtgatgaaggacattttggggatgtcgagcgagttcatgtggatctggtggtaaccggaatatgcatccaggaaactcatgagctcacatccagctgttgaatccacgagctggtcgattcgcggcaaggggaaatcgtctttcggacacgccttgttcagatctgtgaaatcgacacacatgcgccatttgccgtttgacttccgcaccagcactggattcgccaaccactccggatcatcaatctcttggataacccccgcccggagtaatttttgtacttcggccttcaccgcttcttggcgatcggcagacatcttgcgcaacttttattttcttggcttaatatccggcttgactgctaggtgatgcatgatgagatccgccgggacgccccccacctcgtcagggctccaggcgaagatatcgatgttctttttgagcacctctagtatgctctcaacttcttcttcgcccatgtcgccccccagtgatacgagttttgtggggtcggcatcatcaatctgcactttcgttaccttgccgtgaggggtgggcttcggcgtgtgcttcggccgctcatgcggttcggtctcaacattgtgcactgctctgttgattatggctagattgagttttgaagcggccgaatgctgaagccccttgactactatcaccccttttgggccaggcatcttgagcttgagataattgtggtgggaaatggcttcgaacttgttcagggttgcacggccgaagatggcattgtagttgtatgggatgttgacgacgtcgaacagtatttgctcttcgcgcctgttttctcccgagccgaaagctatcagcaaaagtgcttggccaagaacttgcactgcctctccgctgaacccccggagcgacgtttgtgccggtgtaagagcttgggttggcaagcccatcttagcatatgcttcggggaagatcacgtcgaccgaactccctccatcgaccaggattcatcgaacttcaaaaccggctatctcagctgagatcaccagtggatcttgatgcgggaacaggactccttcggcgtcttctggcccgaaagagatcagctggttcacgtactgtggcgccccctcacccgccgaagtgatgctgtggaccatgcggatctgcatctttctctaccatttcgacaactggcttggcgggtcggctcttttaatcacttggattacccttcgttgtgtatcttggcgttgttcggctgggggtgtttgctcctggactgcttcacggggtgcttcgacagttgctccctgctgcggccttgggtcttacgcgttgccatgttgcctaatgtttcggcattgctctgtggtgtgcgaagagcgtccgtgaaaggcgcagtagaggtcttttcggaccttcttgcgggctagctgctgatggttgcttgtttgctgggcgtcgaactccttgcggagggcttgcacttcttcgacagccatcacagccttgcccgctcgatctgttctgaactttctccaagtcatgggggcttggccttgccttggtggctgtccctggatcgccggctgagactggcgaacagagaggggaggtggttcggcaatttgaacttgcgcttgagcttgagcagcggcgacggagcctttatcatactcagcttgtatagcttgtcgtcgcctagaatcctcctcaccccttgcgaacccgtcaataatgcgaagtaggtgttcgagcgtctgcggctccttgttggcgatttttctcgttagttcgccctcaagcagaccagccgatgcggcgtttatgaccgacgcctcggttatgtcttgaacttggcaccgggcttgcgagaagcgactcatgtactcccttatcgacttccccggcctttggcgaatgccgagtaggtgttgttgcgccttcggctcctcgtaggtgcctcgaaagttaaggacaaaaacatcgcgcaattgctcccatgagtaaatgctattggctggtaaattgaaataccaagaacgggcgatgccgtctagagcgagatgtattaccttcgccttggtattttcgtcaccatgagccgcttcgatcgctgactcgtagatggagaggaactccttcgggtcagtttcgcctgaatagcgcgggacgggtgggaacttgaactggggtgggattggatgagtcttgattcccccactcagcggtagccccttttcgcctcccgccctgtttaccgcaccttgctgcgggtacggtctggtgaagggcgaaatcgcagcttgtgcgtgaggttgggccatggcgttcggctgcccggctccaactggaggcacttgctgagccgccatggatgggtcaaaaattggctgcgaccacgtcatagcagcttggattggtgcttggtttgttccgaagcctggggtcggagcttgctgccgaacggttggcgcctgagcaacgttggcgcagtcgaactacagtccctgattccacggcgaagctcccgagcctgactgaatcgatggcaaccaagtaggcgcaccttgacttgtattccccaccgggtgaaccgatggggttgtacttgaaatgtagtggggttggttgagttgctgaaggaaagcttggagttgcgcctgcagagccgaagtcccttccgccactgtttgtggcacttggccagttggttgatgctgcccggcgaactacaccggcgcctgtgcggcttgtggcggaaagggctgggtcgtcacttgcggatggacttgatgtgggacatagcctgccgaatactgaaggattggagccgacgtggccttgacccgccttgccgcctcgtatgcttgttgttgttcttgcatttggcgaagcatgtcttggagccgtgtcatgttctgccgcatggcttccatgtcggcttcggcttgtgcttcggggtcaaggctggtttgggactgtacaacggtgagcgcggttgtggtagctgccggctgtgatggagctgcctggggcaccaccggttggcttgtcgaaaggatctccgccctggtctggagtgcccttgccgccgcagccgcctttgccacgtcggcctcgttcggcacgtgcaccgaggttgcaggggccgaaggcggttgtgatggcgcttgtgctcctccagcttcggccacgggcgccgaaggctctgctccttcctcggcggccatgtctggtccggcgtcgctctccttccgcctggcaaccttctccttcacgaccctcttcggtggcattcgctctcagtggtttcgctcggagtccccacggtcggcgccagctgttgtcgaaacgaaaactgcatacgtcgaaagacgtggttactcaacagtggttggaaaaatgaagtgtactaaattttgaattttacttgggatccccccattacatggccctaggagactatttatagccccattacaggtccttactaccagggtttaggttgtacaggggaatttacatgattacccttacagaaggggcatttacaggggtacataatgttataggggctcatgggcccctgatgggccgtctggcgatcgccggcctgatgggccggaaaggtttcctcggccctcgcgggggcgaacttgtcaaggcgaagtcatcctccttcggcagacagtcttcgccttgcacccttcgcctgagacgcctctggcctggcgctactcttcgccttgcgccgctctcgctccatagccttcgccatgggtttcggcaggtttggtcgcagggcctcatgccatccgccaacacagatcaacaggttctccacatgcatcttcctcttcatgatctgaacccatttatgagtacaaatggtactcagcaagacatgcttatgataaacatgcagtattgagagctggaaggtttaaaccctaaccttaacagttatttcttagaggctaacttaataaacatttaatataaacaacactattgaacatttaatttaaacaataataacgagcataaaaaaaatacaaatcttacttatagataacttaaatagaacatcaaataataaataagttaaccatattaattagtagccatttagtttaacttgtgcccataatctggaatcacccatagacacatctccattaaccgagagcacggcgtatacgaatactcaacgactctgcagcgtctgcctagctttacccacacgatacccacagctggccgggctgaaaagtaacaaggtgtaatattgctccatatatctctcccttctgcctagtaagttaaaggatgctcgggatgttgctcggagtgatccggtccgaggtgtgtgccaacctacctccgcatccacttaccattgtttgttactcgatgggcagcccagaacttcatggacccatagggtagttctgaattctcggggcccatcaagcccacatatataaatcatataaacatgaaccatgtcactttgcttcatacacttgaaagctaatggccagtacaccgaaaggcctacagaagttcaatcaattggagcaatatacggccaggttcgacaaatcgatcgtgtggccaactatgtcattcttattgacacaaggtggttgattattatatcaattttaaataagaaataaccataaatatatacatatatccatcacgaccataaacaggtccataaaaccaaacacatgaactctatcatgtgtaccacctgctcacatgcggtgtcaacagctcttagcatatagccataaatagttccataagtatgttttcatatgcaataataatatccatattaaatcaatagcatgttaaataattaaccatttgtttaagtgtttatcaaaatttatcctaagtttgttagactctaaggctcattaaggtatttataaaaacaacagaaaaatataatgcaataattgcaatataattaatttaaaagaattcgtgcagtctatcgtactccaaaggacaagtacgctaccaaaataactctctaactactgggattaaattgttcaaaggagggtgcatgtctttcaaccttcgggctcgatgtagtcgtacaaaccgtctcctcctaccgtggagatttcactcgcttcgactaccggaccaacgtcagcgttttctattgacgcaacaatcatcaccacaataaataacagaaaaaaaagataaacaaaagaaaatagtatcacaaagtgcaacaatgggtgaaaaggatttaaagaaataattttagggatttttttggaatttcggtgaacggcgaaccctatggctaaaattagggtcgcgacaacgggtgctcggattacaacgaaactgacacggatggattcggaataattctaggagtttggaataggtgtcggatttcgatttcgaggacaaacggatggtcaacttgatagaataagaaaaaggatttttctgatttatttttcaataggaaaatcggatttttcttcttcttctcgttctgcacaggaacggccgaccactccatggcgtcagtggtggagatggccggttttgggcaaaggggcgccagttttgcgatctacagggtgcagcgactccgttcccatggttggtggcggcgcaggcagcggcggcgaggctggcgacggcggccaggagctggaggcggcggcggccatggtggcggtggttccggcgaactccggtgagggcaacgggcctggtaagcatcagggaaggaaggggagcgcggtggtggcggcaactcggcctggggcggtcgggagcggcggcgcgccgtacggctggcggcggccgaacagagggcgacgccgggaggcggcaccggtggcattccggcgacggattggatggggaaagagaggggaaagggagtactcggcatggagaatccgtttttaccttcaatttcagaggatttgcaatgtatgtgacgaatttgggagctctatcaatggtgcaaatttagggtttcggggatttttcctccggtgatgacgatttgattcagcggaagtaggggcggacttgatgaggtgaaagaggttgaaaatgcgcttcttttgcctccagtcttgagccttctagttgagagacgaaggagttacagaagcgggaagatggaggtgtcgcggcggcattcattcgtcgttcgtcctcgtgcgagcgtgtgcgggcgtgtggcgcgcgcggggcggcatgagctcagcgcgagcgcggcgcgaggcggcacagggttggcgtgaggcagctcgagcgcggcttgcatcgggctggcttcgcctggctcggcctagccgagtagaggaagaagaaagaaaagaaaaacaaagaaagggaaggagagggaacaaaaatagaaaaaggaaaaaaaatatggaaaaataaaattaaggtggaaatagagaaaaggaaaatttggggaagattaaaatagataggatttgaattggtgtggaatttagatggtccgatattcgggatagaattaaatcagatcaaaggaattatttgagggatgatatgcactttgcgacaaaatcaaatgagaaaagaaacgtcgaatacaaacatggaaaataatattttaaatgaactactaactcgacggttattttttttagaagattaaagcaaactaaatcggttttaaaaagttgtcaaattttagggctgttacgtttgaggaataccaaatcgatagattatatgttcttaaacaaattgtatagcatccccagaatcaacctttcttcaaaggaatcgcctccacccacttggtaaaataatcggttgccaccaatataaacttatgtcctttactcgatggtggattaatcatgccgatcatatcaattccccaacctctaaatggccatggcttaatgataggattcatagctgacgccggtgccctctgaattgctccaaatttctgacaatcttgacaccctttgtaatatttgaaacaatcctctagcattgttggccaaaaataccctgcacgtcgaagcaaccacttcatcttatgagccgattgatgagtgccgcaaatcccttcatgaacttcgccgattgcaaccttagcctgatcggcactcaaacacttaagcaacaccccatcaatcgtccgataatagagttcgtcaaccaaaaaagtatactttaacgccttatatctcaatttccgagaagccgactgagatcgattctgtaaatattgatgcacatcatatctccaatcataggctgttattacagcaactacaaccttaacatctttgatcatcggcttataccctgatgccccttgggccaaatcattagcttcaatattttgctctcgagagatatatgcctcaaagtaaccagccgaaattccctcattagttcttggcacttctcattataaaccattaatgtatcattcttgcattcatatt

SEQ ID NO: 30195 - DNA, 36791 bp, Oryza sativa
gtgcattcgttggacaatagataatcccttaaccttgtacatgaaaaatataagcacaagcacaacttctccacaggagaatatctagtctctgcatccaagagccgatgactcaagtagaatacactctttctttcccttcgagctcatgaatccagaccgagccgattgacttctcaccggccgacagatataacctaaaaggtgtccccttctgtggaggaatcaaaaatggaggagagctaagatatttcttaatattatccaaagctttctattgctctgccctccaagtaaacttttgatcggctttcaatattaataatggtgtaaaaggctctaaccgtccagataaattagaaataaacctcctaacaaaatttatcttgccgatcatctcctgtaactctgtcttgttctccggaggctgaatcttcttgattgcattaacactcctttgagttacctcgatccccctctcatgaacaagaaacctcaagaactggccagctgatacgccaaaagcacattttgtcgggttcatcttcaggccatatttcctggttctctcaaaaaccttcctcaaatcagctatgtggtcttctatctctttagatttaacaaccacatcatcaatgtagacctcgaccaaccagccgatcagatcatgatatatataattcatggctctttgatatgtagccccccagcacttgtcaagccaaaactcattacaacccactcaaacaagccgattgcactaggacacctaaaaactgtcttatggatatcttcttcggccataaagatttgattgtatcctatattaccatcgataaaacttaaaatcttgtgtcctgaggcagcatcaaccagctgatcagctactggcattggatactcgtcctttggggtagctttatgtaaatctctgaagtcaatgcacaccctcaccttgctgttcttcttgataacaggaactatactagaaacccactaggcatatcggcaaggacgaataaaaccagcatcatataaccgtttaatctcagccttgacaggttcaagcatatcggctttgcatcttctaggaggttgttggtgtggcctaacccctggtttgataggttgtcacgaccggaattaacccaacgggcattccatacgtgcgtgtattgttccttgtcccaggaggcaaggtacatcaaaagttgatacaattcagagtttaacaagcggaagcataaatagttaatttattacatgggcgatgaaggcccagcacacacgaagataaacggaaaacagcggaagactagggtgacgaccataggcacttgacgacaggcacgagctagacaccaaagccttcatcctccaggaactcctcttctgggttggggaaaaattgagcaagattgagtacaaccatcgtactcaacaagacacacccacgaatgcagaataaatgcaaaggagtacaagggagttataataaaggggttagggtttgcagtaaacagcatttaaaagtcacttagatgcccgaagctattttgtaaagacgattctagagctacacaatgttattaatcaaggccgtgaacccgcacgaacctgccttaacccaaggcctacgatgattcagaccgaactggcaaccagacccaggtcccagctcgtcccaagccaacccaggccaaccattcaacattttagttgttaagcaggttttaagaattaaaacactaacttgggtacattgctaggcttgcccataaccgagggcgcggctattcgaatagattatactctgatcagaggtgtatatctttacccacaagacacatcttcctcacgtgtaaccatgtgccacataccaccacggcatacggacgcaagacgtgacatagttcccaacccatcctagccataaacaagagtaccgacccaaccctggctacggccgggattcccgagaaaggtaaccaaggttgagcccctagcagcaggacaccggccctgtggcatgacatctcgactaccgagccgcagctcgtgtagccctcatttgccctagagatgtccatctctatccgtgtacttttgcccatgaccagacagagccacaaactaagccttacccactagacatgtggaagtacggtagtgctttgtaacagaggcccgaagactggtccttgtagtggccgaggtgctactatcaaaaccatgcacctcgagcccaggctaaacccaggtgtgtgtgtctatttccaataatccaaccattccataatgtccaaatgatatgagcattcccaaagactaaggttataaaaccacctaatgttgcctaattaatcagcgaagcagctagctaaattcatactagtggaaccatgaatagggtacccactagttagggttttgtttatcctagggtgaacaaggtaataataacaatagcaataataataaggtcataacaaaggtaaataggcatggctaaataaaacagtgataacgcgggaatttaaataaagcgataatgcagtaatttaaaccaaactaattttataacctgggattcaatatgttcaaggatgatgtgacttgccttgctcgctttcccaaacatcagcttcaagctccacgtagagcggatcttccgaagctgcagcgtctacatgaccaatggaaagaaaaaggcttttactctaataaaatccatataacaagcagaaacaaagcacaaaaataggttcctgacttcttaaggaaaagttagagacttgaacgttccaattccgagttcaaacggcaaagatatggccatttgaagtttatatgctcttaatgtgaatatttgcgaatttcttcatttaaattttaattaaaaatagggtttattgcgtcaaccgaggggagggggtgcgtgcaccgggtccacgggagtggtgggtcccacgcagcagctcctcggtccacggtggaccgggtgcactcgctgctcaccagccggcgccgtgggccccacgcgtcagccgtacccgagggcacgggcggcagacggctgggccccacgcggcggccacacggcgcgcccggaggcggccacgtcagcgcggccggcgggaggcggcgcctgcgcccctatggtcgccggcggtggccataggcgcggcccagcggcggccgagagagagtaagggaagggggaaagaggcggcggtccacggggcgacgacggcgacggaggaggcgaccggagtggagggaggcggtggtgcggctcgggtcgacggggacggcagcgtttcggcggtcggcgagctcggcgaggcggtggatggggtcggcggtggtgcggcgaagccggaggagacgacgccgaggcgggggatggtcctggcgagcggctgggcccagccggaggtcgacggcaatggcagagagagaggacgatggcgcgggcgcgaatccaatggggaggaggggcggcaaacggcggaaactgacaaggaaggtgcggggagggtttatataggtttgggagtgaaagagggtggacggcggggaaggaaaccggcgcgggggtcccggtcggcatcaatggcgccggcgagatttgcgggagagaggggggaaaatggggggaaagggagagggaatcacggggaatatttccccccacttaatggcacgcgggaacggtcgggggcggcgggatttgcagcggcggcggcgctaggcgcggccagagggagtgacggagcggcggcaggagggggatgacgggtgggccccttcccgtcagcgagggtggcgggcgggcccgcccgtcagcggcgcgcacgcgggaagggaggggaagccgagtgggctgcggcgagaggagagagaaggggatggagttgggctgaattcggcccaagagagaggggagagggttttagggtttttcttttcataaagccttttcaactttgtttatttcttgataattgttatttgcgctcggaaaattccactgaaatttatttacacattttaggcttttaggaaatatacaaaaatcctccaagccttatttgacttttaactttgcacattttaatttttggaggcttccacaaggattttaattattctaggcataatttaaaggatatattttagagtcgttttgggacgtgacataagtagccgatgttcaacaatcgatcggctgagtccgggcatctcataatactcccaagataagcaatctctgaattccttcaacagctctatcaacttggttctgaattgtcactccctgaagttcttttcccaagcctaaattgaatttataaatggtctcaagaaaatatcggtgtaaaagcaagagagaaaccctaaaggaattaatgcaaataataatcggaactggcatgtgggatttttcttcagttctacatgtcgaaatacgttaagaagatttttagtggaattttcagagctctagaaataattttaaccaattaaaaatgagcacaagcaatatttaattccctggaaattcatttccttccttttctttctttttccctctttttctttccttttcgaatgggccgccggcccattctcttcctctccccctccccactaggccggccaaaggccgaggctcagctcagccggtcgcctccctccccctttgggtcgccgacaggtggggcccacctgtcgggcccgtctcccacctccagctggcgccgccgcatcccgcaaccgccgccccgctcgctcctgcatctcccgggccacatcgcccacgtcgccgcccgcgcccgccttccccgcgcccactccctctctctcctgcctgctctcgtgctcgagacggccgagattcaatttttgaatcccgcctctctctcctccccacctctccccactacgctggcgaaatcgcggtctccccggccacgatcaaccctcgtgagtctatataaagcacccccgttccctcctctctctttttcgttttgcaatcgcccgctcccgtgcactccaccaccctagcgccgtcgccctcctccccgccgccgctgccgccgctgctccggtcgccgctagccgctatgccgagtcgcgccgtcgacgccgtcgcgttcgccgtcgtgtggatcatcccgtccacccctcctccgtcggaatccaccgccggaacccactccgcaccgtgcgccggtgagcaccaccatggccgccgccttcggccggcgttctcgctctcttccatcttcctctctctctctaacccctttcatcgggttcgctaggtggttccggagctcgtcccgctgtcgtcatcgtcctccgtcgctcgccgtcgtcaatcgccgtcggtgaggcacctcctcccctttctccctctctcccgcgccggttagccgccgcgccgccgcctagcggcttaggccgcgctatcaccatccgcgtagccgagacgccgccgccctccgccgccagccggtcgccgctttgcaccgccgctatgtcgagtcgagccgccgtgcgccatggccaccaagccggcatgagccgcccgtgcgcgccggccacgcgctcccgtcgcgagggtagatcggggccatccaatcccgccgcccgcgtggctgccatgtggccgccacgtgtgcgccgcgtcggcgccacgtgtgcaccacatggtgcgccgtcccttacccggtccgtggacccagtccaccgcggaccgccccccgagtcactgccatgtggggcccgcatgtcggcgccgcgtctctctccccgggaatctgctaaaattcatagaaaattcatccgagctctgtttaagcccattcaagtctcagtaaatcaagaaaaatgcatagaatccagtaaaaatggttttgttctctgtttcagtagtcttatagtctgtttgtattgtttgctttgtatgacgcttagattccggctctcccgacgctccggtgtactttgaattagtcgccgaggttcctccagcagcagagcaaggcaagtcatgcttgtcacttgaacatgttgatcctatattgtaaatgttctattgttttccttcaaatattgcattgttttacaatgataccatgggatgtttaccttctcttatagccatgctatttttgtaccatgctcctttgttagcttgggatataacatgactagatattgaactagggattgcttagccatgcttagttcaactagcacacaatgggggggaatcacattaatgtatagacttcaggttctagtgttgatgttggattagagccaccgtcctggtgttggttaattaaaatatatcatatggtgggctgcgggtgcatggttttgctagtcgcacccatggcaattaaggaccggttcgcgggaaaccctggaagaatccctcatacttaccacaagccagcgtgggcaacggctaggcttgtagtgtagctttcctctagctgatgcatccaggcaagggtgggcgtgatggagtttggatgggccctgcgacggcctatgcggcttttggattcacctaggcacgagaggggactgcccactgccttgcgaggagtgggggtgaaacctgaggtgtggtgtgcttggttagagggggttatgcgaagggtactgtcacggcctctatctagtatgtcgtggtggcatgtcggcgcacggaaacgtgtcgtggggctgtgtcttgtgggtacagttgtacacctctgatcagagtaaaactattcgaatagccatgcccgcgattatgggctgtgatgaggacatcaacaccatcgatacatccacgtccccccatgtacaacatgatggtcctattacccgcgctcgtgcacgtcaactaaattatcaggtgagttctttcttgagttcatattcctcgtctttataccccggagacgcgtgcactcgtgttttactcaggaacgatggagaggacccaaagggaagaggattcgcgcggggtggattcggactgtagggcagcgccaacttctgatggccgccacgacttcatgcgaactccgatttgggtgtgcaagtacttcatggaaagcttatcaagtctactttcaaatggatccagccacatgtccatatctgttctggagcggccgcaattgtcattttactcccgactattttctgtccatggtgctgcgtcacctcttttggcccaatgggctgtgtatccaagttgggcccattaggggcgcgtcctagggtaggagcacgaccctatggtcgttcttcccctcttcttatacctctagtcgccacaaagaacaggcgggttttgatgatagagatagcttcttgctaccggctcgcagcgcgcgtgttggctaaatcgcccgtctgcctgtaatcggaaccccaccatattgtgtttgatagtgaaactttcatctttatctagcaatttcagtgcttgtcctacttgttcttgcttgttcttcgattgcttgcaggacgagtgccctcgtggccgggttgacgcgcacgacaagttcgcggcgaccattggagacggtgtatcggttgctaaggcccagcgtctttggacagttatagtcgggtcgtgaacgtcgacttcatctaattgagttatcccttacctctcatcgaaagatcgggccacaaaccctagcgggttcgcatcaggtggtatcagagcgtggttcatcggtgagagaatttacccttcccttcgtcattaatttttttttcctatagtccagaaaagaccacaaaaaaaaatagtagattagtttttccatgatcctatagaccattgtgccttttcactagtactgcttagctaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccgtcgcagtcacccaccaaatcactttctatttgtgtttgatctgttgccgatagcttttgttagttgccttgtatcctgccaccactagaaaggaaatagaaccctgattcgagtgaccttccttaaaacagtcatatctttttcatacggactcgaaattaggcttataatatatccacggacatttacaaaaaaagttacatccgattctccccgctttgtcgggttcggcaaatttaaaatcgccaaattcctcttgcaaaattctgtttttgtggcgagaagcttcgggacctattcgcatagaactttaaaaaaattctacaagcttcatactttgtccgtttgagataagattttctgtggttggttctagtgtgctcctggttgtgaaaaaaatatcaaaaaaaaagttgtgcctctctcctcagcactagagagagcaagcaaagaaaaaaaagaggatccagcgagcacaccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctctttagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcacagacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgatatcacaagatagcactaggaacaactcatgcacaactctgatatatgaagttcagctcaaacataacagtattttctcttttctttctttcttctttcttcttttcttttttttttctttccttttcttttctgtttttttttggtgcggctttttttttcttttttttgcacctttctgcctttttttcacttttttcttgattttttttaacaaaaactgactcaaggaccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatctgttagaaagagggctccgagagctttccatcaagtattcacgggccgaaaacggaggtcgtatgcagattcggtggccgtttgaagtcagcagtgtagtaggtggccgaatcggattccagcacttggagtacttgatctcgatatcttcttgttcatccataatgtgagcaatggttgcatccgtggtagccatggtcacatcaacaaacttgggatgctttgaaacgggtcatgcgggctagatttgttccttcttactatgcacgtgacttgctgaatagattgcaacaattgagacagggtgcgaaaagtgtagaggaatattatcaggagttacaaatgggcttgcttcgttgtaatttagaggaaactgaggacgctgccatggctagatttttgggtgggttaaaccgcgagatttatgacatcgtagactataaagattacactaatatgacccgattgtttcatcttgcttgtaaggctgaaagggaagtgcaaggacgacgtgctagtgccaaggctaatttttctgcaggtaaaacttcatcatggcagacacgcaccactcctccggccggccgtactgcttctccatcttccacacccacaaccagtcgagcagcacctcctccatctagtgacaagtcagcggcaaaggccgctcagccagcaccgagtgcttcttcaatggcatccacaggccgaatgagagatgttcagtgccaccgttgcaagggctttgggcatgtgcagcgtgactgccctagcaagcgagttttggtagtcaaaaacgatggtgagtactcctctgctagtgatttcgatgatgatacacttgctttgcttgcggctgaccatgcagataatgagccaccggaagagcacattggggctgctgcatttgcagatcactatgagagcctcattgtgcagcgtgtccttagcgcacaaatggagaaggcggagcaaaatcagcgacacacgttgttccaaacaaagtgtgtcgtcaaagagcgttgttgccgcatgatcattgatggaggtagctgcaacaacttggctagcagcgagatggtggagaagcttgcacttagcaccaaaccgcacccacatccatactacatccaatggctgaacaacagtggtaaggcgaaggtaacaaaactggtgcacattaattttgcaattggaaattaccatgatgttgttgaatgtgatgttgtgcccatgcaagcatgtaatattctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaatccaaatgtgagagtgataaaaaagagcaatctgatggcaagaaacctgagacaatcaatttgaaacccaaatgcttacttgctactaaatctgatattactgagttgattgcatcaccttcagttgcctatgctttggtatgcaaagatgctttgatttcacttcacgatatgcagcattctttgccccctgctgttgctaacattttgcaggagtactctgatgtgtttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttacggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagttgggtgatgaatggaaaacagcatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcatgggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccatgcacctctcctccaacttcccgattttaataagacttttgaacttgaatgtgatgctagtgggattggattgggtggtgttttgctacaagaaggaaatcctgttgcatattttagtgaaaagttgagtgggcctgttctgaattattctacttatgataaggaattgtatgctcttgtgcgaactttagaaacatggcagcattatttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatgaaacaaattcgtcatcaatgatgggtttgttttcagagctaacaagctatgcattccagctagctccgttcgcttgttgttgttccaggaagcgcatggaggcggtttgatgggacattttggtgccaagaagacacatgacatccttgctagtcatttattttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattttgtgttaggattgcctatgaccaagagggggcgtgatagcatttttgtggttgtggatcgattttctaaaatggcacatttcataccatgtcataaaactgatgatgcttctcatattgctgatttgttctttcgagaaattgttcgcttgcatggtgtgccaaacacaattgtttctgatcgtgacacaaaatttcttagccatttttggagaactttgtgggctaaattgggtactaaacttttgttttctactacttgtcatccccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctggagatttggtttggttgcatttgcgaaaagaacgatttcctgatttgagaaagtctaaattgatgcctagagctgatggaccatttaaagtgttagcaaagattaatgagaatgcatataagattgatttgcctgcagacttcggggttagtcccacatttaacgttgcagatttgaagccgtatttgggagaagaagatgagcttgagtcgaggactactctaatgcaagaaggggacgatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctaacggccgccacgacttcatgcgaactccgatttgggcgtgcaagtacttcatggaaagcttatcaagtctactttcaaatggatccagccacatgtccatatctattctggagcggccgcaattgtcattttactcccgactattttttgtccatggtgctgcgtcacctcttttggcccaatgggctgtgtatacatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagtgcttgtcctacttgttcttgcttgttctttgattgcttgcaggacgagtgccctcgtggccgggttgatgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggaaacatctaattagcataatacttattttccttccctatttctatgaatgcacgcttgattttagcgcacaaaccgcgactaagggtatcgaaattattcctaatttcagcaagctctacccctagctccgcattgcgatccctaagctctatgttctccttgcagagtttcttcacttgtgcagcgagcttatggatcgagggctccggtgatttcacctcgtcttcttggaattggctgggagccctcacaattggagggggcgtcacgtgacgcttcaccttcataggtggagggcttcgggattccgctgccccctccttctccgatgccgtcaaaggccggagtcgacccttaccatacccaccgccgggagttcgcactccctgaatgcggaattgctcctccttcggagtggatggagtagcggtgggtgtggtgtacatctggagcacctcatcccctgtcttagtgaacagggtgcccacatagcgctcggtgggaggcggcgcggccttcccgtcatcttggaaaaggcgacgtgccttcaaaagactgagctctcctgtagtcggccgtcgtgcaggcgaatcccctcgaatttttgtcgttgtgacatagcgagggtagagggatcgcgctgccgaacgggggggccgaacggggccgacaggggttcagccgaactagggagctcgccgacgggctccagattcgcaggggagcgcggcactattgcgaggagctacgccgacagtgcgttcaccccttccatcgtgtattctttgaccggaatgatgaaccctgagttcctctcaacactcaaggctgttgttggcccgatctttcggtgagttgtgataactacgatttaggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagtggggttccaaagaacaagcagacggacggtctagccgacacgtgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcacctttctttttatgattgcggccaaacgagatagatttccgagatgaggctggatccgttggaaggaggacttcgagagctttccgtcaagtactcacgggcccaaaacggagcacgtatgtagatttggcggccgtttgaattgctctatagtagagcaatatatttggtgcatagagttttcatttgtttggatttagagaaacatgttattgctaatcacactatttcgagtttctctagttttgattggatgaaacaggttattttgaatggactatatgaagaacaccatatggaaaaaccgaggacggttttccgtgaagaaggggaggatgatgtgaccatggctactacggatacatccgttgctcacatcatggatgaacaacaagatatcaagttcgagtcctccaagtgccaaaatccaattcggccacctgctacactgctgacttcaaacggccgccgaagctccatacgacctccgttttcagcccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagctggtggagcacgaccctaggcacccctaggtcgtcctcccacccctatatatagctagctaccccttcagggtttcttgggttttgttagattaaagtttagccattgctacttgcttgcagcgcgcgtgtcggctagaccgtccgtctacttgttcttaggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtttgccggtgttggctctccggtgagattttatgtggaattggatgaagagccgatgaatggaatcaaggatttgccagccattggtgagttagagatgatggagcaagggaattgggttgagatagtgagaagggttgcaaaatgttggagagaggagaaagaataggggctctagttctggtacgactgatctacctccgaactcgcatctaaaacagattcaggacaagcaggggagactaccgttcaaaaatggggctgaacgggcgccgccctggttcggccgaaccctagtgggtccggtaggccaacaaaattttcctgggcccactaaaacctattctaagtacaaaaacgacaactatacagggttttaagcatgcattagatgagatcaccatggttcataatcgattaattcaatgacatccacttcttcatctagaatttcatttggctcaaggaaaatctttaggcgttgatcgtttaccttaaatatgttacctgattcgtcgctgagtgtgattgccccgtgcgaagaggtgtcgatgacgtcaaacggtccttcccatttgctgcgcagttttccgtggccgaaaacttaaccctagagttgaacatcagtactttgtctcttggcttgcatttcttgatttttatccttttgtcatgccaacgcttcatcctttctttatatgagtatgctctatgctcaagttctacgggtagtcgacatgacttctcgtagactatctgatatggggacattccaatgggtgtcttgtatgctgtccggtatgcccacagtgcgtccggcaatctatccttccatcctgttcccattttgttgaccatcttttgcagaatattcttgatttgtttgttcgatgtttctgcttgaccactggtctatggatggtaaggagtggccacattgtgtttggctcccatctcttgtaggaggtctcagaaggttttgtcaatgaagtgagagcctccgtcacttacgaccatcctgggggtaccaaatcttgggaagatgatttatgtgaacatcttcttagcatgcctcgcatctgcggcgctgcacggcatagcctcaacccacttggagacatagtcgactgccaccagaatgtactcgcagttgcgagacttagggaaaggtcccatgaagtctataccccaaacatcgattatctcgacttgcaaattgtatgtaaggggcattgcatcgtgagcagtgattcctccttccctctggcagcttgtgcatcttctgacgaattcttttcaatcttcgtacattgttggcaagaagaaaccactttgccaaatcttggcctgggtgcggaatgcaccgtaatggccaccatagggtgaggcatggcatcgttctatgatcttaagtccttcttcagttggcacacatcttcgtagtaagccatcggagtagacccgatataggtatggctcatcccatatatgatggtgactttcatacttcagttttcgttgattttcccctagtggtatgtacttggataccatgtagtttactatgttagcataccacgggttggagtcgcgaaccgtcatcagcatgtcgtctctcaagaaatcatttatcggctgttagtgcatgttagtgatctgcagtctggacaaatgatctgctatggaattttctactccctttttatctttaatttctaagtcaaattcttggagcagcaaaatccatcttaagagacgtggtttagcatctttcttagtgagcaggtatttcaaagcagcatgatcagtataaattatcaccttggctcctactaagtaagatctaaacttatagatagcaaaaacaaccgtgagcggctctttttcagtagttgtataattcaactgagctcccgttagagttttgctagcataacagattgcatgatgattattatccttggtttggcccaagaccgcaccaacagcaaagtcacttgcatcacacatgatctcgaagggcagagtccaatcaggaggttggatgattggagcagagacgagtgcctttttgagaatttcaaaagattttaggcatgcgtcatcgaactcaatgggcgcatccttggctagcaaattggtcagaggcctggctattgtagaaaagtccttgatgaaccttctataaaagccagcatgtcccaagaaactgcggattcctttgatgttcacaggaggaggaagctgatctataacatcaattttagcacgatcaacttcaattccttgctcggacactcgatgcccaagaactatcccttcacggaccatgaaatggcacttttcccaattaagcaccaggtccttttcttggcatcgttgtaagactttgtctagattctgcagacaatggccaaaagtctttccataaactgagaagtcatccatgaagacttccatgatgtcttcgatcatgtctgagaaaacagacatcatacatctttggaaagatgcaggagcgttgcacagtctgaaggacatcctacggtatgcataggtgctgtagggacatgtgaacgtagtcttactctggtcctccggatggataggaatatgatgatatccggaatacccatcaaggaaatagaaaaaggaatgatttgtcagccgttccaacatttcatcaatgaagggaagcgggtaatgatccttttttgtagccttgttaagtttcttgtagtcgatgcacatcctccatccggttacggttcgttgcggaattagttcattttgagcatttgcaacgaccgtcattcctcccttgttcagcacaacctggactgggctaacccactcactgtatggtacgggataaataatcctggcatgcaggagtttcaagacctctttctttacaacctctcgcattgcattattgagccattgttgaggttccctggagggagtactctcggggggtcaataggaatacgatgggtgcaaagcacaggattaatccccctaaggtcttggagcgagtagccaagaacagaacgatgcttctctaatacggtgagcagacgttgagtctcgtcttcggagagtttatcactgaatataacaaggggcctctctgtcattgtgtaacaagtcgaaaatcttatcagccttggtgatatcaaagtcaaatctttcctctttcccaaaactcctcacccatgggcatagcacaacctttttgcttctaacccactcggctgctgctacttcagtattatcctcttcatccgaaccatacatgtaaggatacacatgattaattttcttgaaattcttcttggcctctgcaaacctatgctcgtgcagagttaccttctgtgcaaggtgagatatgctttcaaactcctggaatgaaaatttctctttaatcggagctatcaaaccctgaaaagccaaatcggctagctgagaatctgttagcagattgatgttttgtccaccatgctgtggttgttctcttgtcaacaaccgaggattggtcatttgcctatgtgccgatgatggtgcagcttgtgcagccggagcagaagttgtaaccggtgccatcggttgagttgatggtgtgttagaagaaccctgttgattgcctgtaatcaaaggcctataatttggaaaagcaccacctggcaaatacactggtcctgtaacttgatgctcagctattgtgccatcaaccactattttcaccatgttgaaagtattgactaagactcctgactgattgatcaaagcatgttgcacagcgtagtcaatccaatcttggaagttgttaaactgtggttgtaatccactaacatttggaccaagatcttcaaccatgccctcctgaaaaccaccacctttgtcgcctggttcaccagcagtacctttatagccttgagatgagcttgaaccaacttcatcggcagcaaccactttcagcttgtatttttggacaattgtcccttggcgggtttctttgaatgaattaatgaacttgtccttcacgctgctcatcatctgttcaagctccttcctgtgttcagccgacaatttgtctagtgtgactggaataatatttctttcatgaacttcagacccgactggatttggaggcttgttttgaggatctgttgacttcgtagcttgcttgtcccctgacatgtttatcgggtcccactgggcatgccaaaagcgtgttgatgtaaaaaacacgaggcctggaagatctgcttaacttcagtgcaggtccaaaaatcttgcttttatgttcgtgagcgtaccagctgatttgatcctggaatcaacaagagataaagacaaagaaaccgtggttaaatccataaatgatagccaatcggctagttgccgatgacatatcatttatctctgagccgatgtcatatttgaatcgatcgacagatataaacaagcaagaaagaactaaatctactcaatcggctgtagatattaacaatatataatccttatgtcgatatatacttaaatgaagtgattgggatagatcgatcgccatgccgagacagtataaaccacttagattgaaatatatattaacaatattatatatgttcatagcatagccgatcagatagatctagcatgtatcggctaatactccgataccacttgatactaagatattaaagcaagtaaaatatatcaaacagaagtgtaatatacctagatgcaacaagatcttaacataaagggcaaatctagcatgtcgattaagcacatgaaatataaggctaaattaggtaagatcggctgaaaccccgataatactctaatcagcaaccaagaagcaggctagagactgagattctaatcacgacttataaggtcaaactcaattgatgcagctataagtatgaaaagaagaacaatatctagacaatcaagccgttggatgtttcatagagtggtggatgtcctgtacaatctaagtcaacatagatatttgacttaatcggctgccttcaataatagacatttagccgattgaaggttagataacgatattgtcgaagattatacagaatatatgacaactcgatgaattacataaacaagattagagtatcataaagatggaagcactaatcccgagaacgcaagccactataataagttttacctcttgttgaagatagaaaccgatgtagctcaacccgaaagtaagaactcgtcgaaacaaaacgaaagtaaagggtggcgatgcgccgagattatattgaacgtgtattagattcattacatggggctcggggtctatttatacccgagattacaaaatatatccatgtcggacacgactcttacctctaacaaactctaagataccataagtctttgcggcagacttttgcccaaacatatctctaaggaaattacatgaaatatcctaattaatagatacaattgccttctcaagactcaatccgtgcatggcaatcctcatgaagcacattaactcaacccgacaacgtgtactgcgtcacattgtcggactcggctcaatcggctaaccttgtccaactcggactctgccgatcccagttgcagccgattcggactttagccgtgccttttcttatcctaccatctaataaggcttatgtggagctcagggtatggaaaagagtagagcattacttgcttcacatatattgcgaagtcaaataatgcatccacggaaatacaagacatactttctagtcaagaatgtgcatgtgtatgtgtatggtgaatttgtgggtggaaaatggaaaataaaaataacttcttttgtatacctcctccatttattctcttttgaattttgggagagtgcatggctatctccttattttcttttcctctttttttttctcatcatcatgctccatacttgtatgagcaccttttttttctttctttttcatagccatgcttctctctcttttttcttttttttgaaagaacattggaggaagaggcataaatgacatggagtatttatttttgtggaagatggacaaaatgaatgacaaatgaggaatgctaacttccggtgtagaagttaagcattggtgggtgtatgtggagtgtatgtgatattgaccatgaaagtatgaaaagcatttcactagggtcacaaaacttgacaacgctcaatataatgacaggcagcgtatgtagcaagctaatcatgaatgatcaacctatggctctagtgggaataaaaatattaatgaggagtttagcatcgttatatatttttttcttttttataaaattcccaagtgcacaacatgaagagcaggatttccatcatcagactatatctcattcatcaattacctagatagcatggggtccctattggataagtcaccacaagcaacaagtaatgagcaaagaataataggcatgcatgctattttcagggaaccaagaactctaattgtaccatccatagcttgggttcaattatcttagatattttagaattgatgatcaaattgaactcaagatagaatggatgtccaaaggaaaaattgtgcaaacctgcgctctgtataaaacagaggacgattcatggtagaggtggttcagccgaactggagatttggctgacccctcattggttctgatcgcaacaatttcccttgtgtggttcgtcatgactcatcactcctggggtgatcttgctttggttacggtgttgatgtgcaagataaccccacacttgtctttttacctgggactctttattgaacacaaaaagaaaaacaaagacacgagtgaagcaaaaatgactcacttggttcgaagaccaaggagccaactttattttattttattatcatttttttatttttttattttatggcaacaatggatatggtgggtatcttggcaggatggagacatgagatgaggatgcacatggtgtatgagattcctaccagataggtcttaccatgatttgaaccgaatgcaagaatgcaacaagttttgcatttgttctacttggctccctgtgcatatcttttctcatggacaaggagtgtgatataagtgtttgaagtttttgtacattgctctttgattgcctttttatttcctgcaaaaggttagtggacaacaaatactagagggactacaaagatttgaaaatattttatcatagcctcaagattaattgttcacatccacgctaaaatgaaattggattcaaaacttaagaagcgtggatccgacaagtttgccaacattttattttatttttcgagagacagtccttttttttatcctaaaaacatttttttccaatttttactattcaccaaattttcgtttaagcacaactcatacaaggctttagttaaaattgcacgaacataacaaaggaacattcaacagtatacttaccgtgcactttgaatggtgatgtgttcatcctttgcatgtctgcaatttactgatttgtttctcgagccctgacttacctccagtgtgaattgaacttgaggactcacccgtcagtttgaaaactttcctgcaggggttatgatgagcacccggcaacgagcgccccgatttcccctctctttcacggtacaaattagctgttgtaaataaataaccaatatagccttgctcagataaaacgatgcagcaatccaatcacgtgaaactctaccaaaatcaacaggtaagctcctcgacccgtgcaacaacaatacaggaacagagagaagatggaactcacaggaaccgaaggaactcagccagaaaaacagatctctagccatgttcttccttctagatccaccagcggcggcaaagaaaatcaatagcagggagatgatgtgagcgccatcaccacagtacgatagggaaaaacaaaccctgaacgactcaaccaaaataaaatcctcccctgttacagggcagatcagcccttaataaaaggagcacgcaggcccagatgaagtctgttcggactcaatatcgcgaccgagaaaatttgcattttcccgaacgctagtgtattaatccccgtcccaggaaaagccggggtacaccatacaaacatgataaaaaaggcacgtctttattatattgataatatttacattattacaaaggcacttcaggcctgacaatcgaaaataaacagcagcggactagcgggcctacggctccatcttcacgggcgctcaactaggatataagcgaggactccacctaggacttcttctccaaagcttctcttactgaaggggggagagatagagcaagaatgagtacaaccacagtactcagcaagtcaatccgggagatgcatgataatgcaagggggtacaaggagtaataataatagggttgggttttgcagtaaagagcatttaaaagacacttagttgctcaaagctattttgtaaagacgatcctagagctacacagtattattaatcaaggccgtggacccacacgaacctgccttaacccaaggcctatgatgattcagaccgaactggcaacccgacctgggtcccagctcgtcccaagccaacccaggccaaccattccatattttagttttgaagaaaattttaagaattaaaccactaacttgggtacattgctaggcttgcccatatccgagggcacggctattcgaatagatttactctgatcagaggtgtacatctttacccacaagacacatctttactccgcattccatggccttggaacccgtcgtaaacatgtgacataacccttcacccatcctagccgtgaacaaaagtaccgacccaaccctgcctacggccagtatcccgggacaggcaggccaggattgagcccctagcaacaggatctagaccgggtgcgccacacgcataggggtgagaccacccgtgtactagtccagtgccatggcatctcgactaacgggcaccgacccgtgtagtcttcatttgcctagacatctcgattaccgagccgcagctcgtgtagccttcatttgcctcagagatatccatcgttgcaatgacttcatccatctctatccatgtccttttgttcaggactagactgagcaccgagttaagccttacccattagacatgtggttagtacggtagtgctttgcaacagaggcccgaagaccggtccttatagtggccgaggtgctactagcaaaaccctgcacctcgagcccagcctaaaaccattttgggagttttgaatagaggggggaggggtgtgttcaattccatcacaagccaaccattccacagtgtccaaatgatatgagaattcccaaagtctaaagttataaaaccacctattgttgcctaattaatcagcgaagcatctacctaaattcatactagtggaaccataaatagagtacccactagttggggttttgtttatcctagggtgaacaaggtaataataacaatagcaataataataaggtcataacaaaggtaaataggcatggctaagtaaaacagtgataacgcgggaatttaagtaaagcggtaatgcaataatttaaatcaaaataattttataaactgggattcaatgtgctcaagggtgatgcgacttgccttgctcagagagaacggccttccgaaccttcggcgacgaccgcgaaccacgcttcgagaaccttcggaacaacagaagctacgtgaagcacacaagcaaagctacaagcctataaagaagcaataacaatacataaaaagaaagcacacagttctttaggttataacaaacattaggagacttgaacgggtcgattcagggttcgtatgaccaagatatgatcatccgaagtttaatgctgttacatggagatttacggattaatatgattaggtttgcaattataaaacatgtgtaagcgctagcctggaaaagataggaaggctgcgccgttgacatgcggaccccacatgtcaacctaaaggaccgcggtagaccgagtacacagagacggtccacgggtcgacggaagcgaaccccgtgtatcaaccgaggcgagtggccgacaaacggactccactagacaccacgcgggctgcacacgtggaaacaacgcggctatcgagcgggcacactaacacggtcaccacacgcacacacgaacgactaccgacaccggtacaagggtaccggggtcgacacccgcacaacgggcacggggcgacaccgaaaggacgaggacggggcagcgagaggaggcacccttaccaccacgcgacgaggcgtgggaacgacaacgacgaacgggcgcggcggagacagctcggggacgacggaggcgaacggcgagggaacgacttcggcggctatccttggacgaaggcgagacacggccggcacgaggtttgacgacgcggagccgaggatgaagacgacgacggggctgcagtggctcactggacggacgcggacgacggacgagaacggcttgacggagggacgaacgccacgacgatcgggaacgacaagaggacgacgacaaagacgaccgaggtcggcgaggaggcgacaagggcagccagcagcactgcacggatgtgaggacggcgcggaacatgccgttgcgaatccgacgacggaggcggcgcagcgagacaacgagccggcgaggaggaacgatgacgatgacgacgaacaccggcggggttcagccgaaggggaggcgatgccaaggacgacgtcgtggctgcgatgccgaaggtggtggaggtgccgccgatcggtgcacgggcgaggagggacgggcggccgaacaactccggcgaggtggatggagaggttcgcgccgatgtgcggcagcttccgggcgaaaccaaggggtggacgaggtggagggctacgtcaccgtgccaagggaggggacggcagcgccggctgacgcatgggcacggcgtaaggggctgccggaggagacgtcgacgaggaggaaggagaggccggcgcgggcgacggcgtttcggcgaaattcgggcgacgccgtggcctggccgggaaagaggacggtgctctggtgccgggagaggtggtggcgacgtcagccggcgcacagggggcgtggcagaggcggccggaggcggaacagtggcggcaacaccactgttgccggcggggatgcacttccggaggtctccgcgggaaacagagggcaggccggcgaagaggaggcggctgcgatgctggaggaggcgatggcacggccggccggcgtgctgacgcggcggcaggggcggctgaagatggccggcggcacgggagagagaggaggacggcggagaggggtggtgaggccacgggagaacgcgggagggggctaaaactggagaacgaatcaagggggtttcattttataggggaggagaggagccggccacgggagaggcggggaacggcggctgaattcgtggccggcggccatggaaggtggccggggttggtgcgggcgttcccgacgattgggggcacgaatcaagggggaaattggggggaattgaagaggaaggaaaggggattaattccccctaatcaattttggaattcccggtttgaatcgcgtggattttggggaggaatggcgctaggtttccgggagacagagagaggaggccgggcgggaggaggaagacgaccagcgcgtgggccccacgcgggcgcgcggtcagcgcgcgtgcggcgcgcgtcgggggggggcggctcaggaggctgggtcggctgggtggggcggggagggaaaagggagctaggccgagggggaaggggaggcccaagagaaggagggagagaaggagagggagagaaagagaggactttggccgcgggccgagagagagagagagagaggactttgggccagacttagcccaaaggaggaaggaggattatttttaggtttttctttttaataaactttggtaattgttgttgttgcttaataaataattccgttgctctgaaaattcaagttaaatttgagggctcattttagaccaaggagaatttaacaaaaattctccgggccacattcgaatttttcttgtacgtattttagtgttaaccaatttcttttcgaattttaattaattctattattccttttagagaatgatttttatttcgggatgaatttatcaggacgtgacactcaactaataaaaatagtaaaatgtactaattactttggtaatccagccgctaatgaccatattaatgatagttggttaattagcctatcggtacaggaaccgaacctatatatatatatattctttgaattgctactgcacggccacttgtatttctccaaccaaaaatgcccgggtcgtggacacatcatcctttccctcttgaaacaaagccatccatggctttggattaattggagacaattctttctttttctttacaaccggaaataccactgacttgatagcactatcttgtattggtttcagcacatgtttacaccaagatgcataaaagaatagtgattactccggccctcatgcgttgcattaagatcaaactaccacggtcttcccaaaagcaagttacaagtattcatcggcactacatcacaatctactttatcaacatagtttccaatagaaaatgcaaccctcaccttgtgagtaattttcagtgtacctgcttgattcatccactgaatataacatggtgcacgaagccttcatgtagataaagataaagcatgcaccaaatctgaactgatagcattagtgaaactaccaccatcaattattaatttgcataccttttcttgtattttgcactctgactgaaaaatattataacgctgcccctttacatcaacactagagccatctcgttgtactgcacgtgcaagcatagataaaccattcttcttttcagcaccatcatccatagatgaatcatcaatatctcgatagcctgcagtaagagtatgatcaagttgtacaccttctgaattttctgataaactctcagaaacatagccttctttagtcatcaacaccttcttctgattaggacaatctctcatataatgtcctctccctccacaagtataacactctacactgcgtgatttataaccagatgcaggagtagattcaactttagattgggatttactcaccgaactagcagcaggtttagactctagaaggagtagtcggcttgaaagacaccgatttactagcggcacttccatcaccatctcgctgaaagaacgtgaacggctagtgtggcgacttgttagttgctgttccaccctttgagcaatgtgcaccatactttgtatatcataataatatgatatctcaacacgttctttcacatcatcattgagaccattaagaaatctaaccatagtagcttcatcattctctgatacccctatacggctcattaacaattccatctccttatagtaagcatccacactaagatcaccttgtttgagttgctgcaagcgtgtatacaaagatctattataatgttcaagaacaaaacggcgagccataacctctttcatatattgccaagtatgtggacgaccaaaacgtaccaattgattccaccaagataaagcataacaggtgaattcaatagatgcaagacgtaccttcttatcctatgaatagttgtgactattaaagatctgatcacaacgcatctcccacgccagataatcctccgaatctccagaacccgaaaaagcaggcatggaagtttttatcttgccaagcccttcatccaacggaacacgagcagatcgacgattccgattgtcacggtgaatatcatcaacaaccctatccataaaagcaggacctcggcagtgaggttgtcgaggacggcgatgatgatcacctccatcagaacgcaagcctagactctcatcccccgcatcatactcatgatgttcaggtggtggacatcgaccctgtctagcatgttcctaacgtggcggtggcaaacgatcgactaacatagcaatactcctctcaagcttcgtgaatttctgatttatacatttatcaaaataatcacaagcactttccaatccatccttaactccggcaggcaagttagcatcaaaaacaggcatagtaacctcttcctcatcagaaccatggtgagaaccaccactacttttagaacctccaaatttaaccatgatgcaaaatctgaaatttagcaaaataactcaattgtaccgtgatgaaccatgctctgataccacttgatgagcacccggcagcgagcgccctgatttcccctctcttttacggtacaaattagctggtgtaaatatataaccaatatagccttgctcagataaaacgatgcagcaatccaatcacgtgaaactctaccaaaatcaacaggtaagctcctccacccgtgcaacaacaatacacgaacagagagaagttggaactcacaagaaccgaaggaactcagccaaaaaaacagatctccagccacgttcttccttctagatccaccagcggtggcaaagaaaatcaatagtagggagatgaagggagcgccatcaccacagtacgatagggaaaaacaaaccctaaacgactcaaccaaaataaaatcctcccctgttacagggcagatcagcccttaataaaaggagcacgcaggcccacatgaagtctgttcggactcaactaataaaaatagtaaaatgtactaattactttggtaatccagccgctaatgaccatattaatgatagttggttaattagcctatcggtacaggaactgaacctatatttatatattctttgaattgctcctgcacggccacttgtatttctccaaccaaaaatgcccgggtcttggacacatcaggttagtccacagcaaatatatgtccaatgtccatgaacatatttactctgagagttcattaatcaaactcgactccatgtctaatttgattaaagtagtctagtttaacctaagcaccatgcttaatttaaaaagcctatggatgtctcgcgaaaacacccaagccagagcatatgcaaatagacataagaaacaaaaccatgtatactcaagtctcattcaaatagagataagtatgagtaaaagatgcggtgaatctttttctgcctttcgtatacctgagtgtacttaccgccagcatgatgtgtatgttgaaacctctggagcggtggtatggtcacatatgattgtcgatttctcctccatcgcaatgtagattgtagcggaggaaggcacttttaccatactaaggcgagctgtttggttatgcacacatctcaggtgcaatatccttgtgccttgaaggcgtgatccgttggcacaatgctgtagagacgtaggatacctctctttttggcaaaatgtgcaactgccaactggagtagagcagcaaacgcctagaaaagaagagggcaactcctcttgcttgtatgcgcgtaggtgctgcgggagcgagaagttgtgcatagctaggagcagacgaaggctgagccaaggcggcacatgagctcgagagagggactagttgtagccaggtagcatgattcctactagcgaggtgtatagttacatttcaaagacacgcacgtaatgcgccttttgatccaaatgtagctcttcagctctcttgctcttttcttcttctcctatttttttcttttcttttatctctcttttctcctcttttttttatcttctttttttttctttttttagcaagctaggactaacaccaacttcaaaccaagatggccttggttgatggaactcatcatgaaaagctcgtcgaccttcccccccacacttggtcttttgtgttgcaagacatcaaaaaccaagtgtgtgatgtcggattctcctatggagcgtgttccaatacctaggatcaccaaagtatacagttgatgtagctaccgagttcttaggcatcgcatgaccctcgttcttaatctcaacctgaaatggttagcgaccaagaatacctgaagctgcatataatcctagaaactggttcttgcttttattagaaagaaagcttaccatgataatccggggtatctcccggcagtgctttgtttatggtcacaagctcgacctttgggacattgctctgcaggattagtgccacaaacaaatacgagatttgcagtatttatgataaacataagcatccacaaccacacttctaaacatgttagaaatgaggaccgagaggtggttgtggtcctcacacaggaaagtggtaataatcgaacaggactctggggattccttctgtgagcatgaatcctacgggattttgaaagagaaactttcaagctcatatgtggaatgttttctctcgtcctccagagtcgatgtcgtaagcttgtccgtggcctgaaggttctccttctcaagagatgcatcgtgcaagaactgggttgtttcttgatgataaataagaacaacgttctgaaggccagagggacaaggcataggtttcatcgagggtgatgaggatcgttcagtttcatgaagatgggcaataggttctgaagaaacgaacgaagataaaaacatcacctcctcgaacggctcatgcttgggatgagccttgattttgctggaataattcagggtgttctcacaatcttcataaagatcatcgctgaattggaatggaatttccggaggatgaattttttcttcttccggctccagcaactggaatgaggattcggcagttgagtcgggttccgactccacgtgaagaggatcctcataggtaatctcgacctccgggatggcttcgctttggctgaaagaatcgttctctaagatcaaatctaagagttatcttccttcggcggttgtcttgtgtgcgaacaatcctccagcggaaatatcgagatttgcggcagactccttgtctaacccatatcgaaaatgttgaaacaacacatggtcgggtaaggacaagtctgggccagattgagttaacagtgagaacctggcccaagctgcaccgagagattccttctcattctgtcggaaagagaggatgtctaatcaaaaattaattagacgggttaatggaaggaaagcaaggcagaatttgtagttaagctccccccattcaccgtggaatttcttgacagacagagtgtaccattgcttcgcttcatctctaagagaaaaaggaaacaatttccactttagagtttcatgtgtcatgcctacgatggataaacatgaacacactagctcaaagtcccgaagatggaggtatg

SEQ ID NO: 30196 - DNA, 686 bp, Oryza sativa
cgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtgcattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgctgctatctaaattccatttaaggtcgtaccttatcgccaagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgcaaaatcgtgcgggaaattgtaatcccattcaccagctcctacatttaattaacaagagaactattgtatttatctaacacctggattatctccacctttcatttgatccctatt

SEQ ID NO: 30197 - DNA, 4604 bp, Oryza sativa
cggaaaacgagggagtggggttgggaaccctcaaaacgaactcagccttagttgatgaccatgcttaattgatatcttaatggaccattttttttaactataagcagcactgattctgaaggatcagagcaattagttattgtatatttgtatctacaatactctttttttttgtgtaaaagcatcaacaacgctcaagtatcaatcaactttatttactgaagtagtagcttgtgtgatattttgcctgtcgatagaaccaatctttcttgtcaatttgagtgtatttcctgtcaactattcaatgttctttttgtattgatttgcatctcaattttttttatgtaacttcaaatttgtaggaggacattgtggcttgtttcaacataaatatggtaaattccctgactatttcatctctatatgagattttggtcctgtcatttaatcaaattcttatgttggatttgaaggcacaagtgctgtgctcaaggggagatgggaattggtacttctacctctggtgcctgggtggtgtcttctgttttggtagtaagttactgcttgctgatctaattattactacattttcttcatttcctatgaataagatcagtggaatagagataatgattttggatttataacagcattagatctacatttatttaattacattgcatctctactactctaaaaagtggactattgtctcccaccgatcgtgcacagcgcgagacccaactcttccattagaaaactggttcagaaaaagaccaaatgggcaatcctctctgtgtgtgtgtgtgtgtgttagtattcgatcctcagcattacatccctagacacgacagccaagatggcgatggcggttgcatggttaacacctcagtgttgcattggggctgggtctgctattttgattttttatactagattttctaccgggaaggatgggtctcactgcacagaatgggtgggaggggaggacaaaggaaactctgcttttccatccaatcggtactttgctggctggtccttgattggcatgtacaattattttgcatgcataatttatgattacaatagttggatgaattatttggtttaacactcggatcaggggggctcactgacgacaaatcagttgggggcagagttggccttgctcctaattaacatagctagaagtgatcctattacttgtgcagacgaggccctccaccaagctgttgcaatgggcaccttactagtatttggcaatagtgaatgagttgtggtgcttttgggttcatttttcagaaatccaaatttgttggactttctggacattatgttccttaatctaaattgtagttaatctattctcttagattgtccagtgatgaattttagctttttaaaaaatttatttagtaggatgcaagctcatagtttacttttgtaaaaccattggtagtaatatgattttagtgatacttgcctcttacactgagctggctaagcttgctcgcgtattaatttgattcctaccagcaatccatattttatgttcgtcagaattatgaagttctatttgatatatggtaaatggtgcaatttctcattcactgaatgaatgagtttttttttttctgaaataagggtggggtcgtcttgctggcttgatcacactagaggcagaagacagcaatgctccccttgatgctcttaagagagttgggaaatctattgcaatgcatatcgttgcaacaaaaccattgtttttatcaaaagaactggtctccgcttcagctgttgaaaatgagaggggcatactccggactcaagtaccttattctgacaaatgctactttctttgcaccggaaaaatttagcatcgccgtaattctatataattagcttacaattgcagaaatggacgtgtgctttacatattaagtgagatatcaggtatcataaggtcataccgtacgaagtgttatgatgttatcttaacagaacaacagacatgggcaataatgacctatagttgagagaaaaatgcatatcttgcgacaagtcctaactcattataattaaaagaaaaggaaaggaaactgttgactcacaatggaattagtattcctgtcacatcgttttatgtttatgtaagcaagacagctgggctgttaaaattcagagatgagctatgcaatggaacacaatgtgaatcacattagaagtttatgataccagttatgtttatttttccatgaattaaatagcaatatcttttgtcatcttctggggacacatggactgcatccatccagaatatgactgaactgcatgcaagttatgtgagatttaatgacatgctactatgaaactttttaggctgaaagctccaggaaatcccaaatggccatggagaaaatggtggaaggccgactaagaaagtattttgaagaagttgtgcatttggagcaaaaatgttgacaacgatagcacaaacatcaaggtgaactgataaaaccttttccttttttataattatgtactagtttgaattgtgaattcatggtacataatggttttgcttcttgatgtcaatattttcagagcgtcctgaatgatttgtcaaaggaagttggtgaaggagttcaaaggtacaatatatttgtcacaacaacaatggattgagcttttttggggttttggtggggtggatggtaattttatctgattaatcttttgcagtagtgcatatgcactataaaccttcttgtcctttaacagcagatgcaccaaacaaactgatggcccataaaaaaagcaatctcttcttttagacatcaattgtttgcaatgtaactttatggttcttgctaattttctcatccgacttcagtttaatttgacctatccctaattcttcattgctttttttttctccccatataatcaactactaaccaaagttttgtgttcatcaggcctgatgagtacactgggtctgaagctacggctcgtgctgcatagtttttgagctggcatggatcaaatgtgatcattgagatatgttgaggttcctcttcttctgaagttagatttattagtctcctgagaactgtactacttttccgcagtttggctccaacaatacggtcatatttttctacaaatgctgaatcaattagttagtttacaagtaaactttctccagagagtattgtaacaattcaaatttaacgaaataatgtttgatctaaacaaacaaggaatacaaggtcacgctgactcctgcaaagctgaatgatccagttttaatttggtttctttatggtctttcttgatctcgatctgatttactacagtaacagcaaatgtgtacatcttccatttatatcacacctggatatggcatattcgggtccatcttgtcatctatatttagatcattgcaaaatatggatatactggcagcagagaccgtgattttgcaatcatattgtacactcctgttgcaattgttcagatgatcacaagttgccaaccagtttgacgtagtgccgtgtgcccgtccatattttcctcaaattctgttcaccactccatcccatagatcagaagattcacatttcgtatgtcatcaaatcagaatgcagatctggacatgaaaaagaggaaagagagaaaagaaaaaggcagcagggttgaggataatgtgctcagagcgtgtgaaaatgaacaaatgaatagtgccaaattattacttcgtgtgctgattacctttctttattcagcttagtagtgccaaattattacttcgtgtgctgcttgattgccttttgtttaattcagctttttcagcagatcttgatcttcaccgggaaaagaaaagaatggatctttgatcttgtcctgtgatctgcaacaccagaggatgttgaaattatcttaacatggtcttttatcggtacttgtgctgattgcacctaattgggtcatttgtttttcttaattaccacatgccaaacaaaagttgtggatgaaatgcaggaagtatacagatcaaagattagctgcctagagtgcagatcagcagaagtttattgaggctcttctgagcacaatttgatttgccactcatggtttgatgaattcctttcaaggcactaaaaactaactatatatgcttggtgacacgtaaggagttgcccctgttttagttgcataatggctagtactatatggcaattatcaacgcaattgtaggagtagaatatattagataaacatattttactgaagaagaggttgatgacttacgcattgtttagcctacctaatgaccaaactcaaaactatatctcaagtcatatcaggtaaaatgtagtgatcacaaaattatacaaaaaaacattatggcgcctaattaactatcttgataacataattacctgaataaaagatttacctgtaattagggcaatgcatgcatcagtacctcagagctaaaataaatcacaaagtcacaatcatgttgttagccgtccaataatcgtgctcaatcaagaacataaacttgcaatgatttgaaaacttatcttatttggttg

SEQ ID NO: 30198 - DNA, 6246 bp, Oryza sativa
aatagctaatagcatggtattgcattaggggaaaatgttagaaaagtttattgaagcactagggcaactcaggtgcattttgggttcaatatgctaccaatgtttgggcagtgccaaatcctaggctaattttggcataccaaaacttgcttctaggtttcgctattatttaggagtctgattttggtaagggttacttaattattggcttcagtccaaataattgaaagtgctattgtagttgtccaaaaatttagtagggaacattttggttgtgatccaaaatgccccttaatttaccaaaaagtgattaaatttttcatttcgaatcaaaggggcagctaagtccctgtttagaagagctcttgatattaattttccttatcccaactcctaatcttcaaggaattatatcctcaaataatcaggaccagatgtacaactatttggctatcagatttataccagatcctcaaggacaggattaaaaggaattggccataattggatgaatgaaatttttagaactatagataatgtgaggaactaatattgtaaaacagatggtttagactgaaatttattacaaaacttaaatatcatggcattgaaaaacacagatttaacgccttggcatgtacctcactagctaaatgtaggagctataagtagttgttgcctcacatctataacactaccttgcactatactcccttggtaaaaaaacacttttggatttgaatatggacgtagcatatgtccagattcaaatccagaaaatgttccttttttttaacagatagagtatatgcttgcgggtggcacccttgtcatgcactggtgcattggcacacccttgcatgagagaaaatataagaagaggtatagatggagtgctaactccaagagtgttacatttatttagggataaggtgagaggagaataaaggaaagaaggagagggtgagccactcttatacaagaagtaaggaaagagaaatagtggtttaaaatgaataaaataaaattatttgcacctaaatctaacatattacatctactgctaagcgagataacagccatcgtcatctccaagagaggtgccacatttggttacccaaatctccatttaaccatccatgccaaaagatttccacctattattgtgccttcgaatatgttgtttcttcatcgccattcaaccattcgtctccctattgttttcctaccttccccgtagtaaaccaagacataggtgaacttaggatatctagttgtgtctctaggacaatgttgccctgccctctttccaccaataccttggacctccttcaattctctagtgatgaagacttttgcctcgatggtgttccctctggctacaaagatcaattctcctccctctttccgtcattgctgcctgtagaacttcgagaggaggtgggcgaggtcagagttgagcaggcgcctgggaaggatgcactgaagtcaagctacatggtgttgagaaggagtcttccaagcttgagaccaacacgtacgcagatcaggactgaacctagagacggtagagcagctcgtttcggtagggaggtagcaatgctgataaggagaggccgagagggagaaggcgcgtgacgcagttcagcttagcgaggaagtagtggtgcttctcggctcgacaaaaaggcagtaatgttcatgtgggatgagtggcagcaacgaccaggggcggatccagcacgggtgcggcggggtctcgagactccactactaccgtgaagactatgagagaccccacgaaggccccactaaaaatttttatcatatgtagatggaaggggggactgtaactttatctagtttgctcagaccctactgctatttctttttggatccgccactggcaacgacgcaggtgggagagctgattctgcttctactactggcatgagacagagtgcaagagttagttatcgaggatagctagtcatacggcatgtcaaatttggtcaaccgctcctctcgtttagccagccggataagataaaattgtaaatagccactctgttgaaacccatccttttacatgtttactcttttctaatagagagtgatatagccaatctcttagagatgctcttaaacttgctatatgagcaaggtcaggcccaatacaatgcaaggccattcatatcaatatccaatttttttaaaaaaaatagaatagattatataatatgttatacatatgtatatgaaaaataaaaaagaagaccgtattcaacacatcataataaacaaataaataagtaatatatgatattatacatttcaaatattagtatattagctctaaaaaaattgcccctttacattttcgttatacaaccttagaatcctagctctgacgcttatatgagcatatacttagagcaattactataaggttcagatgctacgtacctctattaagagtaccacataatattagatgatgaggtggaggagagaagtgaggaagaagaatgagtcaccccttattcaaggggcaacctccacataaacaccaaaaaaaagtgcaaagagagagtgagatagtgtgagagtgaaccaacaaaaaaatatattagggtttgggtattagagacaatatcattactaaaaaaacgattttttatggtgttggtctatgattttcgctggcggaaaaataccaaaaccgccagcaaaattgtaacgagggagtaaggggcatcgacggctagcgaaaatggatctttgacggtgcccgcgttataccagccgccaacaaaaatatgtctattttcactggcggtcacttaagtgcgccgccagcgaacatggataattttcgctggcggttgtgttatacaaaccggtagggaaaatacagttattttttctggcggcccacttaagcaaccgccagcgaaaatagattttcgttggcggtagaaggaccgcttgcatagatggaccaccatctattaatatggaccacgcggcccaccaccaccaccaccaccaccaccagtccaccacccacccggcccctctctccagatcccctccctcccttctctccctcgcaactctcctccctctcttctccaccgtcggcatgcatcctcaccaaccagcctctcctcttctctacccccaccagcactctctcctcctcccaccccacagtaggcggcggcggtttcggcgtggcgatgacgacgcgaggtgggcacgcggcggcgacagtaggcgcggctctctggcgcctgcgggcagcgggtcgctaggaggccagatcccccgactccggaccacggggagggcggcactgacctcgacaccattgaccgtgctcccgctgctagatttgattttttttttctttttctttttctttttgcatgttgttctagatgatgcgcatgttttgatctgtgtaaatgatgtttgatctgtgttgatgatgattttgtatttcgtgtttaaatttggaaataagcagcgaatctagatgtggatttgaaatttgaaatcaatgaatcaatgggcggctgcatgggtatttacgttggcggctgtgcagctgcatgggtttttttttgggctcaatataaattttcactggcggccgatttaacactgtcttaagcaaacggcagcgaaaatggatttttgctggcggctggcttaagacgaccgccaacgaaaatggatttttgctggcggtcaataaccgctagcgaagatcttgatcttcactggcctttactttgtggcggctgcaaattccaccagcaaaaatctaaaatagccgccacgaaaaatagttttcgtagtaatgtatattatacaaattatctcttaattaataagtatatgacatggctaaaaaggtggcagtcatccctactataaaacttactcttaaaggttactctctccttttctcttctctctcagagttgctgcgtatctgttgcccttgccctaactaatagtagcagcagtaggcatcatctctagctagctagggagacaagcgattatgttaccaacctgaatgtccccggcggccctcccctttcccatccgatcaaaccaaagtgctccagtaattcctgacaataaagcgtaaagccactaataagaaacactccaatgcaagtagtaggcccagatttcctgaagaagcacacaccaatattcaagagaaagatgcatagtactctttaatttgtaaatcaagtattggtggcccctcttattacactgacatatctatatatgttttaggcttagaccatgcagattatcttcatatttttttagttggctttattcttagtccttgatactttcgtaggagaagcaatactatgctccgtgaagctacacttttaaaattggtagccagcgatcttttattctattttggatggcgtagtttctataaaataatgttataaattctacatgttttatattcagtattttagttggatatcatcagagtgagatggagtttgttccatgaccacgtggtttttatgtatctcttctcttgactcgttgaccgtgtgtctgttgatagagttcggggatgtaaattatttcccttattaagaataaattttaggtttaaacacagatactaagtaagcagatgaaaattaaaataagagaagaaaatgtaggtagagaaattatcatattttagaataaatttaaatgttaccaaaattatattgtagggcggataaaatatgaagcatgtatttagagcaagtttaatagtatagccaactgctagctacaaatcatctatagctaatgtaataactaattcatacattagttgcttactatactattaatatctggtcctacctatcatacacacattacgtcttggagtccgtactgcagctgggctacagatctgtagcctgctgctcctcccttttcctttatctttttaaaatatgtttataactggtttatagtctgctattgtatctgctcttaaatacgtatgtattcgtgtacaatagtatacttaagtaggtggagagagagacgacagagcacgcggaatgatagcccgatgatcatgcgcggccaaagcgagcgaatcgatccgagagaaagcagaatgaaataggcaggcagcatacagcagcaaaggcaacaacaatatatatactgtatgagagaaaaagaagggaaaaagattgtgggcgcggcgtacgagaggaggagaggcctgacgccgggaaacaggtcctcctgccggcgggacgacgtaccagtgcactgcagcgcggcaggcagagcgcgtagccaacgcccgcccaacagtggtgttgtgcctggctactgctggctttgctggattttccaccttttggtccttttacaaaaacttattctataaatgaatccaaaaaaacatattctaaaaatgatcatttttgcggtgccaacaatggtcatgatagcgccaatgacattggcactgtccccttcatccctcggtgaaagctaactcactaatgtgaagggaatagcgtaaatgttgttagcgtcgatgacctatttgaaaaataaataaaaaaggacatatttgtaaaaaatggacctatttaaatattttttttatacaataggtcccttggcacagaatgacagtcactgaggacttatttgtaaatttttattataaacaggtcctttttcaaaaaattacaaattggtcctctgaattagcttccactgaggggctatggggatggtgccaacatcattggcgctatcatgttaggacaaggcgctacgatgttggtgtcacaaaaaggatcatttctaaaatatttttttaaaagataattatcactgtatgagtactaattactcgtatcacaaaatcacttcaatttttttcatattctaccctcaaccgtctttccactcttacctattgtcatggtcgacatcacatatcaatgcaggaggtccgaaacacaccgtgacgcggttggctggaagattgcggcggcaggtgcgtcacaggaagctgagtagcgtgtgtcggacggctacagtacaaggcttgcagattgataagattagcttgagtccgaattttattagcaatcatgttgagatttgtaagcatatttaaaggcaacatctatctatctattaattattatatac

SEQ ID NO: 30199 - DNA, 401 bp, Oryza sativa
  unsure (1)..(401): unsure at all n locations
tcctcccaccccacagtaggggacggcggtttcggcgtggggatgtctacgcgaggtgggcacgtggcgccgacagtaggcgcggctctcgggcgcctgcggacagcggctcncgggaagncngaatcnncccccgccggaccacggggagggcggcactgacctcgacaccattgaccgtgctcccgctgctagatttgattttttttttctttttctttttctttttgcatgttgttctagatgatgcgcatgttttgatctgtgtaaatgatgtttgatctgtgttgatgatgattttgtatttcgtgtttaaatttggaaataagcagcgaatctagatgtggatttgaaatttgaaatcaatgaatcaatgggcggctgcatgggtatttacgttg

SEQ ID NO: 30200 - DNA, 23725 bp, Oryza sativa
  unsure (1)..(23725): unsure at all n locations
aaaaaaacccagtccccccctcccctctcctctcctcccaccatgggtcactaaaagtccattaaacttcctacaaacgctcttaaactgtcacgtgtactcctacaaatactcctaaaccgccacatgacactttaacaaaacaatgtgtctaataattttatctattataattttattgaaaaaaacccatacccccctctcctctcctcccaccatgcgcccaccctttcactagacgtgcttcctccctcccctcctatccaatctcttctttttttatttagttattaaaatttttgaacaataataaatcttaaataaccaaaattttcctatagttatttgttgttgtccattaacaattaaaaaaatataaggtgttctttaacctataagaaatataaaatttttatcgtatcctaaactttgcatatcacttagaattgttatgtaaattagggaaaaattgataatgtagattatacgatcaatttacaaaatatgcataaataaattaagttagatctattattataacaaaaataagaatacgtccatccgtacatgcttcatcttcccctcctatccaatctctctttttttttcctttagttattaaagctcctaaacaataataaatcttaaataaccatatttttttccatattacgttagatcttagtcacaaaataatctaattgtgattaacatcccaaaacataatacctccgttctaaaataccagtatgtttgttgatgaccaaatttggtagctccatgagtggattcgaagttggaaacgaagccgatttttgaaaaaagcctgttcgggaaggctaactacgaacggcatcggctgccgctcaaatcggctacgttgatattggctgagtactgggcatgatgtaatcaaaccgacgccggcaatcttgggaaagtggccccgcaatcgtcattgggtgggattaaagctagtcattgggtgggattaaagaccttcatagctattgccacacaaggataggagtcctaagagaggcaattgtatctattaattaggacatttttcttgtttccttagagatattttggtaagggcccacctaaagggatcgttcgtattttaaattatgttagagataagagtcgtgtccagaaaggacttaccatgtactttgggtataaatatagcccgaccccatgtaatcaaacaacgtcagttcaatacacttcagcgcatcgccacccttttacttttcattgttcttttcgacgagtttttgctttcgagttgggctgcatcaggttcgatctccgacaaaaaggtatatcttgtcatggcggcttgcgctctcaggatcagtgcttacatcttcatgacactctaatcacatcttcgcaagctttcgagttatcatatttattgcataatctagatcgatctcgttatctgagcttcatcggctagcctctatcatggaaaatggccgataggctcagccttcgactttgatttaaattatgcggtatatctgccatcttgaatgagctttcatcggttcgattagatcttctgccactcttcacgcttaatgttgcatcggttaggttcgatctattaagtactgtcctgaggccttttatctaatctattctttgactgctaatagagatagtgtcggggtttcagctgatcttacctgatttagtcgttttatcttccttcttggttctaaatcgtctagatttaccccttatatgaagatcccatcctcttgaagtagatcaagctccctagtctctagattaggtcaagcttcctatatttcatttgtgctggtatcttggtataaggtggtatcggagtattagccgatacagattgggttcgctccatcggctatgctatgagcacgcacaatctcttctttggagcatgtttagatatggagcgatttatattgtctcggtgccaacaccgatctatcccagtcgctcgatctaagcatgccccatctaatggattacatgccgctgatatctacagccaatcgagtacaccgaacaatctccaagtttttacttgcctacgccgatccaacttaagttgcatcggcgtggcccccaacaatatgtcatcggcagacctgtcgataggctatcgttgatggatttaactctttgttgtttcatgtcttgttggttgcaagatcaaaccatctggcacgctcaggacccgaaggcaaatttcccggacctgcactgtagttaagcagatctcctaggcaacaatgttaaaaaacattacctttattaaacaaaataatgttgattaaataatacataaaaatattttgacatcattatatctgtaatatttaaagtaatcaacaataccataaaataaaatactcttattatgattagcattccaaaaactattactgtagttctaaaatatcaatgtatctgaataatgcaaattaggtgtatcatgacaaatattttgtcaaaataaaatctttaatattgaaagtgaatacattctagaaagaaaggatcaaatgtgttgttgaaaaccgtatcgttatcttataattaagaagaatagggggggcatatttgtcggcattttcctctttagtctttggagttcaaacctaactaatctcagtataaagtatataatatccagagtactcgacccgtataaagtatataatattgaaagtggatacattctagaaagaaaggatcaaatgtgttgttgaaaaccgtatcgttatcttataattaagaagaataggggggcatatttgtcggcattttcctctttagtctttggagttcaaacctaactaatcttagtataaagtatataatatccagagtactcgacccatatagggtttttcttatgtatcaattctatgtccacttttcttatgtatcaattatatgtcacactcaaacatatgtatcatttctacttataattaaactgctattcactaatcgttgagtcaggaatattgatgaggtgattgtttattaaattgactatatattcgagattcaataaacctatatatgttgtcaagtggtaaagacgaaagtcaacttgcaatatagattaaacacaaacagaataggtcaatctcatgaaataaaataaagctgcatcgtaactttttgaaatcgaaaaaaaaacatgtatccataacatacaccctacatataatcaaagataaccacggctaatctcattggcatataacctatgtatttattgattcattaaagcatataaccaattggagaaattattagattaaaaactcatccttaacaaatcagaaaaaatattcgagttattttacctatagtagcaagctatcgtagggtgctcaactttgtagctaacgaggaagggaaattactatgttacccgcttattaaataagggttaatttgatccgtgccattgccaatatgcctatttagataaatgccataacattcgtctattcgtaattgtgccactcaaattttacaaaattggaaccatgtcatcgtcgtcacgttttccatctcccccctcatctgcaaatgggactcacccatccgattcatctttctttcgccctcacttatcttcatccttccccatctctctatcacggcgaggagtgaacaacgcgggcaggacgggagggggtcggcgacgggcgtacattaagtaaacggtggttgaatggaacaattgtactttagagtcacttatattttgggaaaaattgactcggtttatggtataaataaagacatctatggtatacaagaaaaattgttatttaatttaaaatcaaataaaaataagaaatgctaaatattagaaaaagaaagatacatagtataaatgatatatagtttaatttgtagaaaccaactcaattgttgtgacaccatatactttctcataaattcaaaactacacagtttgatttaattttagtttagaattttttatgttgcgtgcgtaactataagaaaatcataactaacttcaaagtaatccctagcaaattggaatatagtcaaaaagtatttcaataaaaatcacccacaaataaattaacattggtaatgaaattttaaacagattaaataaaatacctacgtatgtgcgtgggctaccttcctagttagatggaataaagcaagccaattcaatctgattctctcatctctcattctctgctttctcaagctacccaagccagggccaccaatgtcacattcttatccaattcattcatacgccagggctcataacacctatacaccatttaataaggagacataatagtttttcttcttaaatcataatatgtactaaaaatatataattataattattttaggacggagctagttgaaatctgcgttgtactgtgtaatttaaaaaaaaaagaaatactcaatccgatcctaccaaacccaaaccaaacctgcttcttcagttcttctatcctcttgcaccttatgacaacaagagcatatattggtagtttatctaacccaaccaaatatttacccctatattatactctagcttgatacagtacttcttaccgtccttaattttccaaagccgaattattttgaataacccttgcatcctctacctaccataactgctaaacatagagttagccaatgcttatcgtatcattggttcttcctcgaaaaaaaaaaagttggcaacatcggagatggtatttttttcccctaatacagccaactgccggcctctcagcaactgccatttattatacaattatgtgatcggtgggctgaacacatggggatataagtgattatttgacttcagttcttcatttattttaagcttttccgtgaattgttagttgcatgaaactcatatatagctaattcatattttttttgaaaagaagtaaatttcagaaaatcacatattctattattaaagttaacatgtggcatataactacacattactggagaagtgatctttggagggtcagacgatttccacaatagtcctggttccaacaagaaccaggactaaagaggtttattagtcctgatttattactacaacggaactaagagatttttagtcctggttcgcctcttgatagggcatgtcagacccctgtcgaggggccagggaactttagtcccggttggtaaagacattgcagatccgggactaaagttgcataactttatataccccttcttacttctccagtccgagccattgctacaaaatgaagctttgagggagggaggtgctgccaaaatttttaacaattttttttgtgttaatatacaaatttgaggtctctaaaaggttagcaacttcatcctcctctactttttgcttagcatttacatttagagctatgttttgtacatatttttccctctagaaaatgtgataaaagatgatgagagagaaagtatgtgtagggaataaagaatatagacaatttgtttattttggattttataaatacttgtttgaataattacatataataattctgaaagaataattagccgtaaatgccacccatgtcaaatctaggatttgaacccgggtgggctggttccaccacaaggaacctagccagttgagctatgctcacttcgctacatataattattgtatgaatggttaattataaaactaagttaatttaaaattaaaataagtacaacatattaaatatttgtttacaatgtaattaaaacatgaataatatgtagaatggatttaataataaagattgtatgaataattatattcaattgttgtatgattatttaatgagtttgtatttcgtggattttatatatttacgatttatatgcattttatgtagatggatcggtaacggatgtacgcggaccggcggtcaaaagagtttattgacggcgtgcattattttttgggtgtggccaatgataaaaagtgtaacggtttcataagctgtccatgcaacaagtacaaaaccagaaggagtattccactgcacgaagtattcatggcaacctgtttcagtgggggttcatgtgtagctacaattgtgaccaataaaggttttataaaatcacacctctatttgaatctcaaccaaaattatctatctggaataatattacagaaagaagcgaagagttagctaccaatcaccttaaccaagaaaaaataattaaaatttcagcgacactatattttaaatttttaatttaatgcgtgccaatatatataggaatgggtcctgtaacatcttaattagtacgtataccataatactcatgttatatataggccactgattataatattcagggtttcctttatggaaaaccaatgatatagggttttcttaaatttactctaagaatttgagtgaacttagggaccatagatatcaactttaaaatgaggttagctaatttatatttaaaaaatgagtaaacttcactccacatccgaggaatgatgtagactacgtgggattaattaattaatgctacttataaattgttaagtaaattgcacatcttttcccatcaatttacttctagtgatgaactaattatttgtgcaacgtttcgatcaagttgggcttcgatttttatttttctttttggcagctgcgaaagtagcgtaagatgtagaatgtggatgcttgaccctcgagcaacgcgtcttaagcaacccccccccccccccccaccacattacttaatttctgatatgtatagtaggacgtgactacatatatgaacgttgcgttactccaatttctgatatgtatatatagtaggacaagcaactcaactgtatatgaacttcgtcgtgcattaaattaagtgatcacctcaagtcctcgaagaatattattcgctccgtcagaataaggttataagtgcagtcatgagtttccgtgtctaactttaatcgttcgtcttatttaaatattttttgaaaaacctataagaataagttacgcataaagtactattcatgttttataatctaataacaataaaaatactaatcataaaaaaatttcaaataaaatggacgatcaaagttggatatggaaactcatggttgcgcttattttgggacgaaggtagtacaatggaagtactcctagctagtaactaaatcggatcaggtttaatagtgaaggcaaataagcaaactaatgttatatgtacttactcccatcccaaaatataagtatttttttttacttcaacacggtctttgagatgctactttcatcaacaatgtctacaaaagtaagatattttaaataaaaaagttgcatattgtaatagtttgtttaatgacaaatatcaagtaacatcaaatttacattattgatcttttttatttttttgctattaataatcaaaatttgaaaagtttgacttgccactgttctaaaaatacttatattttaggatgaagggagtacttgataacatagacaacacactacgtctagcagccccaagacactttaataatttcacttcattggtttgcttttaatatattacctctctttctttcctttcacttggagctcatgtgtagagattgtatttcgtatgatggggctgctcattctctccccttaatttttttctccatctgaatttcgtcatatcaccatatgaatttactacggatatgtttggagaccacaaacagtttctctcagaatcaaaaactttcctgagtaattcggtttttatttagatttaaaaatatataattgccgaattaaaaaattctgactagctgtttctcatattaatctaaatctccttcaaacaaatcctatcttatttgttttgagcacgtagaacactaggcgttagtatatggaatggcttgccagcattaaaccgcgcgccgaggtgtcggtgccgcgcgctagcatatagctccagtcctgtgtggatcatcaagcgaatgcgtgtacgtgagaggctgtgactgtgagcaatccaaccacacgcgcaaacatagccgtacgtacgtactgatcatttaaacatgtctacttattatactaacgtataactcgtagtactcattaattcacggatcccaaatgtacattgtatactcgcgttctcaatttttcacccatcctaacacattacacacataccgatatagaaagaatactagaataccctcgttttattaaatcctaattaacacaattattctccaccttatcttcttttaatacatttatattgtactttcacaaacttcaatacaataataattacttaaaaattgagaagaaaaatatcttattttatgacgaacgaaatctgtatgacttgtctcagtgttttggattcttagaatatcaaaaattgtgggtattaattgtgtgcaactatatatagtagtaaaactataagtagttttagtatagaaaattgtgccgttaacatagtgtgtgctttcatgtgatattggtttcgatcgctactacagaaagagctataggtatcggttgggaaagccccattagtcgacacctttgaggtccccgatgaaaaaaaaagagtcagctcgatgtattggcacaagttcccccccccccccccccgcttagcctcaaaatcgacccaaaatcaatccaaaatcaatcatagcaacaacgtcatttatcatcacataaaaactccaaaatcaaacacgcaacaacatcatcatcacataaaaacaacaatacaaacaacacaaatacacaatcaacaacaccggtggatctgcccggcgctaccgacgtcccctccgccggatcttcccgccgccactgatgtcccctccgccggatccgcccgtgggtgccgccgacatcaccgccaccgctggatctgcccaccgaaaacactgctgcagccacctccgccggatctgcccgcgggagcgctgatgccaccgccaccgccgcgggagaagcttgggcgcggagggtgaggaggagggggtagaggaccatgggatctgcccgccggaaatgcctctaccggatccgctcgccggaaacgccaccaccgccgcctccgccgaattcgctgtggatccacgggagaaccttggcggaccaccggatccggcccgcgggagccgctgacaccatcgttgccgcctcctctactgccgtcaagggagagacaaaagggggagggggctgggacgagaggggaggagagggagtggccgagagggagagggatgagtgagaggaggtggcgagtgaataaggacgcccccctcacctcccacgtgtgactttagccactcgtgccccggctctttctctctcggctcgtcccatttgataagtgccggttttttttaaaaaaaaggcacccataatacattacaggtgtcggttaattaaaaaccgacactcggtaaattttttttagaaaaccgtcacctataggtaccggttttttggattttcagcctgtggaggtggggaaaacgctataggtgccggttttagctgttccgggacctgtagtgctaatatgtatgtgtgtttttgtagtagtggatatagcttttgaagaatattatataatttattgggaattgattgtcaaagtttaattacgaggaattattggtcacttaatttccattactgacaaatgaaaatgcatctcatgaaagttcaccaagtgaatactccattatacctttgagcataggactgtaaactgctaagagcatctacaacggtctctttaaatccatctctccaaatgttaatttgactaatttgctaaaaaaaaaatagagagccaaatttacctttcacaataaccgcctctccatctaccctctccaatgtgacaatgggtggcacatgtcaatcaatgtacttctttctctctcccacatcatccccccacccaccccacagtccctacccatcacctcaccggtgacgagagcggagaaagggaggacatagaatggagctcgatagacaatggtgaatgaggtgggcagtggagggtggcaggctctgacatggtcgataacaaaggcatgggtggaagtgttgacgacaacgattgtgccgactgtgcatgcagtgcaaagggcccaacaagatttagcgatggtggagccggcacggagacaatgaaggccggctcaaggaggaggagacactcatggccaccccgagcatggaggggtccgctgactgatggggtggaagaccttgacgtgccccgtctccgcccactagacctggtgacagcccgacgtggtggagtgagggcattgtggtggcagagttctagcgagggcaagtcccgtcaccatgatggcaacggagttatggcaacggagagggcgcaacaaggatggggaaggagccaacaaagaatgaagtcggggcagtggagaccgaggtagaccgatggtggggagggcccatccccatgacatagtcatgcctggcgttaacgaggagggatgtgggctagatgacggtggaaggtagggagcttctgtcgacgaccgagggccaaggggagctgggagccagtagcacatcaggggtggccacaggagcttctgccagtagtggaaaacaaagccggaaagatcaatcgttggagctctagaatggtgggtgatgacacaggaagggttgaaatcctatcatgacgccaccatggccatggtctcctgcgatttgtggtaggcgagtggtgaggcctactattgatatggcaaaatggctctctaagtttggccaatgtgcggtgaggtttggccaggttggcaaggctgttggagacatattttcaccaaaattgctaaattttggcttagagagtcattaacaactcagttcgagttgctccaaaggctcctgctcgactactttttgtttaaactaaatgttttaatgttttcgaatacgtgtaatcaaaacatttaaaccttcactcactaatacatatatggggcaaaatttgctatagaacactctagatttgtagcatttgctccataatactttagctttgtggttttgttataagacactatacctttttggaaaaattccatatattcccctaaactcttgatagaagtccgtctaccatcttgaactttaaaaccgggcatccaaccctctaaactttgtaataccattcaaattaccccctaaggtggttttgggtatttgaaagcttaaatgagtggttttgaataatttatatagcatgttcacgtatcctcaatcatcaatcatagatttatatcatacagttatatcatattagttgtcggagtatgaaacttctctagcgaggaagcgagtactccctctttgaagattcaggcaaggggcgagttttgagttcaagtgtaaatcttgtgaaagatgaacatgggggattataaaggtttgggctgcacgaatgtgtaataccctactcctgtgtgtgtggactacagatggagaacgagttacaaactgtggagcttgagcattagtggaagtatttttgctatcaagaatcgaaccctctatccgttggcctagatcctccttttatatttcaaggggagtccatagcaccaatatattgatgtcaaagtggagcctactccattcaatttagtatgttttgtcttgtcaaagtcttttgaaccgaacagggagggatgttctcccttgttggctgacgggcaaggtgccctaaaataaaagaagtgcacttgcccctgctatttcacagggctacctgggtgcgtcgtatagatgcccccaagctcccccattgtcgatgggatgtgtataagacgggttagtatatgttacttcacattaaatgcgaggcttgacgatgaactgttgtttctaccccagatacttgggggccaaggacggattgttgatggtccttaagtaccaaatccgaccaccaatccttgcataaaagcaaatgaaataaaacattagacttagtggtagtggttattactaatcatttccacaagagttgagaaatattcgtttgtaggtgaattatggacgaaaaccacctgccatgtaatgaaatacatctccaaacaattggacacgagtacaaggattggagtgcccacatgtcaatcaaaaccgactacaattgagccaatccacggtacaacatgcagagggcccaccaagaagcctcacaaccgaaggagtggccgggagatgggaccaaggggtcggccaaaccacaaggtcggccgaaccgcctttgtggtctctcacctccaccttcaacgtggacggccctaattcatcccctattatggttgtgggtggaccaacctcgtagccgctttagtaaccatcataggagggctataagaggagctctcacttcactctcacaacacacaacataagtggagtacaactcactttcatatttaggctactctctcgtagagtagaatataggaaaagagtgaggggaagctccaaaaggagtgccctagatgtcgaagttctctctaggggagttctagaggagtgccggggatgtcgacactatctatgctggagtcttgaaggagtaccggagttgtcggcactttctccgatcttgtatctcgacggatgcttcatttatataagtaagtatttgtgattcccttttgtatttacttttcttatttaagatagattctcattattacgggtttgtcacttagtatttataaagaagcaagttcttggctgagtctagagtagtaatcgataacgtaaacatggtgcctagattagatataaccttcgtttgttgtgtgctccatggaaagtgaggtgggcggcaggtggtgacagtcatgtccctcctttgtattccttcacgtttgggtacatcatagagttacagggtagactcaacttggcggaccaggggagagctagtgcccgaaataactaatagagttgtaccttgtaagggttacggataaggcatacatcctatccttagggttacgcattgtacaaatacatatactcgcaagtatacgagaaggttatgttaatcgtaagaaatttagccgaagtataaggaaaccgtccccttgagtagaaggtgttagagtcctattcagaggggatgcagactttggtatctcgtacatgtgaagtcctctccgagttgtacttggaggtcaaggcacttaggggtataagtacaagcccttcatggggtacgtgatcatcgaatcataatctcaccaccagccgtagcagaagcaatctggagggctcgaagacccacccgccgatcgatctcggcaagttgatctagatagcattactcaacggttttgttgttctctattgtaatctctgtgtttctcttcataatctcatataaactaaattaaggcttttaccttacaaggggcctgaactagtataatatttgtcacttgtcttcttgatgtcgtatcgtgtagatccttgctccgcgtaccccaataccctcaaaatacagtctacgggtatcactgtcgacataccttaacttaatattaacatagttaacccgcagtagttctctctattctaagcctctcgtttcattgttgtccttggatgaatcctattcttagactatacacatacgttctctatgattcggtacccttggaatactataaagtgaagggctatagcgcgcggtatttgtgtgcttgcagatttatatatgactgtaacaaataccaacacatatgttccatgctcaggacaggtgtgagggatgccttgaacaactcgtgatggggaccctggtccctatttctccaatattagtattatattaacatccatttgtgtaagtgagaccaacaaaaaaaatagagtcaaaatgaatgattatgtagagattttaacatatatgtgcaattcatatatcacgtaatcaaactcatccaattatatgtaaattagataaaagccactcttccaaaccaccttagggttctatataaacaatattatataggttaagggttgaaagtctggtttgaaaattcaatgtgctaggtggattttcaatcaaagtttagggagtagttagaccttttttttttccttttttgttatttttttaaaaatctctaaccattattttaatacattctctttgagtggggagataaaattttccaaaaaaaaaatttacccttgtacatgaaatctaaaaatatcttacaaaattcaaaacttattccaaattgtgaaaataaaaatatttgggagggcaacataatgagaactgcaaaaaaaaagagtaaatagtgttgaacaacataatgcttagatttcatcaaacacgtcgtattccccttttccaatcattttagaataggttggtacatattactcactccatcttaaaatatactccctccaccctattttaagtacaaccgtgggtttttttttccaaatttaattgtctgtcttatttaattttttttgtaaaaaattaaaaaacataagtcacgcataaagtactattcatattttatcatctaataacaataaaaatactaatcataaaaaaattttaaataagacggacgattaaagttggacacggaaactttgaatgagacaaatccgagcatgtccagattcagtagtaaaatgtatcccatctaatattagggctgtgtttagatccaggggtgtaaagttttggcgtgtcacatcggatatacggacacatatttgaagtattaaacgtagactaataacaaaacaaattatagaatccgcctgtaaactgctagatgaatttattaaccctaattaatctatcattagcaaatgtttgctgtagcaccacattgtcagatcatggagcaattaggcttaaaagattcgtctcgcaatttacacgcaatccgtatagttagttatttttttcgtttatatttaatattccattcatgtatccaaacattcgatgtgatagggtgaaaaattttaccgggggatctaaaagggcctagattgctatattatgagacgaatggagtaataatttttgcattcagaattcattctaagatataataaattttccacctacattctatttccaactaataccaattcttttattttatttttttattaatttttttctcaatcttttatatgtaatttcatcaattttcttaatattcgtgtccggttgaacggagctaataccagtggtaccacgagtacggaggtttatgccaagcatgttcacatgtcagctgtcaaagacgagacgtgtagcttaccttatattaggacggtacgtcgtcctacgtggaatggaagcagagatggacctgtactgtacacagcacaccggagccgattagcagcaggccagtctagtgtactcccttcgtactacgaaaacgaattaaccaaatataacatattcaaatataacatattctaatacgataaatctgtacacacgtatatttagatttataatattaggatatgtcatatctggtaatagattggttttttatagaacgaagaaagtaggcggtcagcgctgggcgcatggctaaattggctactcctagtagggtgggtggtccgccgccggccggcgactgctccggcggaggataccgacacgaccggccaccgcctcaaaagccgcgcgcgcaactccccctaccagctaccagctacagtatttccccatactcgctgctgcgcaagcagttgtactatgcttcgtaggtgcagcccatagggagaatgtctcctcttttttagtcttaatattttaactgctctttgtctctcaaatgtggatcaaattctcatattctaacccatattttttttttcaaattcaaaatcagataagaatggtgccgaattatataccacttatctcattttatgtcccatattatttcctatgtattagatattaactatggagaaacacttaaagtgttaaatagatacaccaagtaaaaaattatacaatattacatttgagcttgtaaaatactccctccatctcaggaaaaactaacttttgaagattaattgtgacaagtatttatccagattcatccctaaaagttgtttcttttggagacggtgggtgtaatgattaacatatcttttattatgtttgtaatgtttgtaggtggagttataatagattgttcatatgtgtttcataacataggatatgagggcatatcctaacccatattttactgcgtttcttttttttcctcccacgttcttcctatgagtctcaggtcgagcggtcggtcggaaaatacccttcccattttcatccatactctccatcctaaaatgtaatagttcttttaactacattatctttccaaccaattacaatattttatctttaaataaatttcacaaaactacagatactttggttaaattatcacaaaactatagatttaagaagatgtatcacaaaactacagatttagtactaaatttctcagagaactacagatttaagatagggtattgcaaaactacagatttagtaccaaaattatcacaaaactataggtttagtgtcaattcaatcacaaaacttagacatttataactcaaatataacactagtgctaaggatttaaactccaatagttgtactaaatctatagttttgcgatactccaccttaaatatgtagttctctgagaattttagtgttaaatatgtagttttatgaaacatctccttaaatctgtagttttgtgataatttgactgaagtatttgtagttttgtaaaatttactcttttatcttttaatttcctcacttactttagtttcttaaccaatcatagttctttttcatttaattttatcgatttttttaaaacctagtttgagacggagatactagcttggtagtattatttggcaccgtaaaacttgtttagcgcgtcccgtttcgctgtttttttttctccttggtctttagtgtcgaccttagttttttttttttttaccttaataggaccttccggtttatttgcacctggaagatcgaagaaggccctgctgcctggtcgtacgagcacgacatgttttggtacgagtaataatctgttgttgcctgctcgtacggcgtgtgtaggagtaataatctgttaagaggtaactgttactagtaattctgtccactggattaggaccaaattaccacacctgacgaagacacaaatctcttttatacaggtttagtattaattagtactcgtaggacataatatacaaaaatacctacctctaatacttatccccgttattatagaatcatatttttttctttatttttaatccactctttattttttttctatatgtgcctcagggtggctcattctcttgtccagagcgtttaataatcttcaagtcccatttacaatgcacatattctacagaaatcgattaggtttttatctggagcaattttaatcctacttagagcttacaaacttattatagtcgtcatgataattatagttttatataaaataaccgcaaaaaatatacattcagaacaacatcaatatttctcacacgatgacacggataagaagaaaagaaacctactcctaagggcatgtccaacaaaaggagcacccccaacatcccacatgagcaaaagtgatgaaggaccagactagggatatgcctcacattgtaagccataccatctcatttttacaattcagcacctgtcagtcggtcacattttgtatttaaacccttggattatttttattcacatataagtccaatatttcaagtataccccccagaaatcataaacatataaaaacatcaacccctcctctcctcaccatatttccccaatttctccggcggtctcttccccggcttcgcctctctctccctgcacctcccctccccgatggcgccgcctctccccggcccggccttctctccccatcaccggatcaagcggcggtggtggcggatcgaggcggctgctgcagatccacgcagcggcggccgggatcgagacggtggccgcggatccacgcggcggcgaccgggatcgacgcggtggccgacccatcgacatggcggtgcttggtatcgatgcggcgatggccaggaccacatcccatcaatctccgatgcgccgctgcacttcttctcccccaccggttagcctcgagctcgccggatccacacggcaacgacggcctcgaccttgactgtgatggcaatggcgcgggagctcgagttgatggcgagctggagcgacggcatggggcgacacagctacccaacacgcatcctggtcgattcctccgagcaaaaatgcgatgcctctgagaagggcgcgtggacctccagcagcattcgcgcacccctacagggatgcggctccttccgaggtgacgtgaatattcgctttcagaggtgtgagaccacgctccagggtggagcgctaggcatgccctaacatgtcttctcttgaattatgaaaaaaaaatttacagggtgatcatcatctcaatatgctcggtcatcactggcttatatagctgtgggccaccggatttcgcgaaattccattttccaccggtgcccgaaacgaaaggggctgtcagaatcgtaaaccctggctgtggcaatggcatgaccaaattgttagcttgcagtctcaaaaaaaaatgtgagcttgcaataagccattaaaacccactaatccagccaagtaatgccgatttttaccccacctggacctggacaaggtgcccccagatggaggaagccagagcaaaccaaaaccaaagtgggcaccaccagcatcagaatgccctttattcaagggggccccacattgtcagcagctaggctagtaacaggtcatcatgcctgaataggaagaggcaacaaccaattgccacactttcttgcacaaaaacccctgacagatcacaatatcacatggcaagtgtagcccaagaaaacccacaagaatgccatggagaagaagcttctgctgcttctctctctctctctgtgtctagtccaccagcttgctgtatattattaggtgcaacagggcagcaggcagtggtggccaacaatagacaattggacaacctgtttcctcctcttcggctctcctcctcctcctcttgccttctcttcttcttgttcttgcccaatcctagtagaagcgcctaacttgtcgtttgctgtggcttgggttttgagagccggaggaggcaggattgatttttccatgattgggttttcttgattgattggcgcctgctgctgcggtgcggttggtccaagaaccgggatttcccggcgcggaatccggtcatccaagaggtgagatgatctttctttccttgccctgcttctctcgcggttctttaggcgttcttggcgtttctgttcttcaattattattattactatttgttaattttgaagaagtggagcgggattgttcgcctgttcgttgcttttggcgagtgtagaatcctgaaaattttaatgaggtggatgtgagagtctgttctgttggtggtgatttttgtcccggccgtgaagaacaaccgctgctctactgggtggttcttgatttggttttggtccgttctgccagtgttgcttgttctttctcaactgcgaggtgtgagcatggcgttaaattccatcttttagtgtttatcctctaaatttctgaatttttgggggcggttggatggttacactccatcccgtatttgagggcaaagacaacttctatgttaaattctgttttgtttctctgtcaattggtcagtcagtataaatttggcccgttcttcacgccagtgaggcgaaaattgttcaatcggttcaatcttcagagaatttctttatggaaaaatcacaacttccgattagtggatcaagtctctttctttgcggtttttcccctgcaaatttttatgtcaagttttgaggcggtagcagcagcagtcgttttcagcatagaaatatgcacattggaggtatcgaatattgtttaatttgtttggtagttttgctgaggatattcacccaagaacatagtcttcccggtcagaaaaaataatctgatatattagtggcagtcctcttctgaagtcatctcagctgaaatctagcctgtttttcttgcgggtattttgtcgctggagttttaatttagaagtttaaattaaagttaaggttgtttatatatatacgcttattgctcctcaccaattagtacagtgaattaacaagccttaatttctttattaatctgatatacattgggggtgaactgctaaactctggtcaaaggctgcttgcctgaccacacacttctttttttctgcaacttgtgacaggtcaagtagtgcatgttacacggtttcttccgagtggtgcaagaactagaccttgtttaggcttaacgtctgatttgtttttttttaacttagaaattaagctacactaaaatacctagtagtagcatgtttttggttttggtcggttgcacattgtggtgagacaggaagtgcataacactnttccattattagaaaaagattaagatggttttggatgatttccttngatttgggggtgctaaatagtagtagtgctgttggattacattttcgcaaaatacttttttgacctgcttttgctgtgccatgccgatagccgtgcacggtttgtctgggctttatcagtgcacaatttttatggtctttaatctgtggttactctctgctagtggtttattacccagctgtaatcacctgttcatagcgtggagcgttttgttaatgcctatttaatggagtgattcattttactttcctgccatgtcttggtaactgcaagccagatgtagtagtatattaaaagtttcccctcctagttttgctggggaccaagaacattgtccagcttgtctaaataccaaaagaagtcttcccttgcaaagagagtggaagtgtgttttgcactctgaaagtctagctggcatattctcatgatacttttctcaatttctactccattccaggtgcatctgaatagataagaagagaacataatctttgggcattctctgtggttgatctctgaaaaaggtatcaaacagcctgcaaattaggtctcctgctctttccatcaaaatgtcaggtatcattttttttcttatcttattatatatttgtgatgggttgctgatgaaatggttgctcattagtttactaatgggtgctattgtgctttgtgtgtaaagttcggcgccgatcagagagtatggagggcctgttctcgtttgacgagaggaaagatcgaaggtcagatgtggagaactcggaggacgagcggagaaggctatccattgggtcactcaagaagaaggcactgaatgcatcaaacaagctaacacattcactcaagaagagggggaagagaaaggtggagaatcggccctcattcacaatcgaagatgtcagggatgaagaagaggagcgtgctgtcttttccttccagcaggagctttttagcaggaacttgctgcctgacaagcataacgattaccacatgttgctgaggttggtgttggaacaatgctgaaagattgagagctactgaagcatgcagttgtttgtttctttctttcttcctttctttttttcttttgtgctgaagctctttctagttttatttgcaatatgtgtctaaaagttgtatgccttcattatctctataggtttttgaaggctaggaatttgacactgagaaagccattcaaatgtgggctgagatgctccagtggaggaaagaattcggcgcagacacaatactagaggtgaggctaaacggctaatgctgctattaattgatacataaaaattgaaaatttaacttcgccagatacttcctgaaggatattcaaatatgttggtccatgtacacattgttttgtttacataaataggagattccatctggcatcttaaactaggagtgcttttaaggtatagactatagagtgatgagtagtagtacgtattttatccccaagctcaaatcggtttattttgaaaggataactgatgtctacaaataaatattgcaggacttcaattttaagagctagacgaggtccttgtctattatcctcagggttaccatggagttgacaggcagggaagnccggtatacatagagagactaggaaaagttgaaccaaataaactgatgcacattactacagttgaccgctatataaagtatcatgtacaagagtttgagagagcattccatgaaaagtttccagcatgctctattgcagcgaaaaggcatattgattctactacgaccatacttgatgtcgatggtgtggtatgctgattcttctcatatctgaaatcacatttgtttgtgctgcaaattctcacgaattattttattacaaactgtaatcctaataatgttcctactattcattgccaattctgttgcagggtctcaagaacttcagcaaaacagccagggacatgctgggtagaatgcagaagattgacagtgactattatcctgaggtatgctacttttgttaatttccttgatcaatccaaggactaagtttggtttacactttacctgtatactcagacactgcatcagatgtttgttgtgaatgctggtaatggtttcaaactactctggaatacagtgaaaggcttccttgatcccaaaactgcatcaaagatacatgtgagtatgaatcctccctggagatattccttttcctgctcttgtccaaataaatatactatattttaatggagcttcgtttataggttttgggaacaaaatttcatggaaaactccttgaagtgatagatgcaaggtaagctttccattcagaaacattttatatggtttcttgatcataatgattttgtcgtcatgtctttgatttaatgcacattgttttgctatttacagccaacttcctgaatttttgggtggagcatgcacttgtgctgctgagggaggatgcctcaagtctaacaaaggcccatggaatgatcctaacattatgaaggtaatttttgttgatttatttcctaaaaatatatgtgcttcttcttagtaaggtttaatagtggttcaaaatttggattatttttgttgcttttgaattgtgacaagtgacaatatgataatgcctagttgatttagattacttaacttactacataaaaaccccaatatctttgttctcggcatgcttaaattataaatagaacatgttatataatcaatcattcaggattctctctctctctctctctctctctctctctctctctctctctctcttctgaagaaagcacacagatctccttatctagttcaaacaatattttcaaaagaatattttttttccatacatgttatactgaagtttatagcagcatcct

SEQ ID NO: 30201 - DNA, 4145 bp, Oryza sativa
gattaattagggttgagattagaagagagagagagtttggtcgtctgcctctttccttctctttctttatataggcgacactggtggggctcgggggttatctcaattagtttaggattctgttttctgtaccgatcacataaaaaacaaatttatctcttagtttgtttcttgtcaggataaggaaaccgatggtttagatcctctcctaacccttatcgacacaagtcgcgaaaatcaaccaacattctccccttgattttgagacttacttacgagttgattaaataaaatagctccccaaggcaatgtgtcttcaacaacattatgcgtcactgagacaacaagacctatagctcactatagtactcaaataaactcaagcttaacttagtgggtgttgattgaaaaatttagtccccctcatccaggatctcagtaaggctctaatttacatatatactggccagaacataatcttaattaatcttaattttatgagcctttagagtatggatccattagcaaatgcttagcttaataattcgatcctgggacatgtctttcacaaccatatcaatgtgttaggcagaaaacacacaatatgttgctactagaatagaaaactgtgtttaattagtgcacaactcactaaaatcaatccaagggaaagaatatctccaacttatgagacgttctaacctcccctagaaatgtgacatcaattacaatgtcacaatttcaatgatgtctcatcttttgtcattacaggcaattattataatagtcacatgatcatccaaaagaacaaatatgactgtcgtgcacaaggacaagaccaatcactttattatcacacttaatgtatcatgttctatttggtaaaataacggacatgacccgtttctcatatgaatttaaaaaattaaactagtaaagtttctcttaatagagtgaacaaataagacattattgcaattgctgtgaaactaagtgtgaggtctccaacaacacttcactttcatcttcactccatcagttactctgagtgttcactcccctctttgctaccgtttggacggtgcgagtttcctgtaatgagttagaaacatgcacatcggcattgagtcaaactcactaagtattaagggaaaattcatcacaagggatttatttaatttcatttatacctttcttgactaaccacgctgtgaagcgtgtgcaatttctctgccaatgtccatctgacgcacagaagtggcagtagggacttgtacttaaaggaacagctgaagtggaggccttgatcccttcttgcttctgctcaccctctggctcactattcttattagaggattccccttgatagacctttttgcctttatcaaaggcattagtgaggttgagccggtctttaatcttctgcttttcagctttctggcgctcttcctcttccacggagtgtaagatcaattcttgtatggtccactcctctttctgagtattatattttgttttgaatggatcatagttaggaccaagagatctcatgatgatgtgcactaaaaatccatcagatattttcatatccatggatctgagttgatttgccatatgagtcatctcaaggatgtgcttccttataccacttttgccattgtaatgactagtgatcatctcatttacaagcatattggcatgagtgtcaggtgcaaattcaaaactttcttcaatgtttgccagatacatcttaatgtcattatagtcaatgattcctccaataacttctggagagatggcacccttgacataaattaagcacattctgttggacttctcccagttggctaacttcttattgtaggcccacatgagattatcatattcttcctcaattatattgagttcttcggccagttgaggttcctagggaggatcctctcttatggctaagtcataatccaacatggctaagttaataagcacattatttctccattcaacattcaacgtaatttgatccatcacgaagctgaatagccttaagttgtcctaatgctgaaaaattaattattaattaaacattagtaatgcaattaatttccattggcttaattaatcacatacaaataaatcttaattttcataatcaaacaccatagggtagaaaagattatgaaatggcagagaataatgaattactgaaaattaatatcctaaatcaaattaccaaaatcaggtagatatgatatagggcataatgctattagtaaatgacatgaaattaaagtccttagccatatcaccgttgggcagaaatggtaaaggaattaagcttagtaacaaattagagatcattgatcatatcaccgtaaggcacgagtgacggaggaattaatgcactagtggcataagtaaaattctaagtcatatcaccgtaaaggccaaaatgacaaagaaaatgaaaataatgattgacgatacttagatgtttccttaattacatcaccgttgggcagaaataattaaggaaataacaatcttaatgaaatcatctttctttctagataaacttcccgttggttccattaatctagaaataaattactcagtattgcaactgatcttaaataataagcattgccaattgcataaagttaatttacattggcttaatcgatcatatgcaaaataaacttaaaatttcatagtcaaagcaccattggtcataaataattatgaataatcttaaaattaattcctcaattatatcaccgtttggtagaaaataactaaggaataaaaaattataattgacacgcaattataataaagtgggttaaatataacttcacatcttaatgctttctagtcgaatttctcgttggttccattcgactataaataattaatatactaaggaaatgaccatcataatgatgttgacatgaaatcataaatactttctagttaaatttccattcaactagaaataaattaagtggcttaaggaaataataatcttaataaatattgacatgaaattatattaacattggtcaaatataatatcatatcattaatttctttctagccaaacttcccgttggttccatttaactagaaataattttctaagtgatcaaataattgaccataattttccagaaattttaaaatagctaagaaagctcataaatgaatttatggaaataaataaaacattaaatggcgggcttaaatataataatgcggccaatcatttccttagccggcccataaaaaaggctaaaatcaggataaaatttagctaataaagatataacacattatgagaaattaaattcgtgggcttaataaattaaaaataaaggcccactcttatcgaaaatccggcccaaaacggaccggcccattatgtgcacgtgcggcgcttaggcggacgcggcccatatcggcgcggcctatgaaggcgacgtcccgacgcggggtcgatctttgctgtccgatccgatggacggctcggattgatcctgcggcgatgaaatcgccagccggtggggggaaagggtttccaaccctaaccctaatctcttccctctctttgacggctctctcacccgggcgagtgagcgagcggcgacaatggcgacaagcaccgcaacggctccatctcggccggctgggggcgtgcctgaagggcagcgccaagccgtgtgcaatggcgtcggcggtccggtgtcacaccccgaagttctcctcccaagcctaaatttaatttataaatgaccctaagaaaataccggtgcaaagcaagagtaaacccttttaaatcaatgcaattaataatcggaattggcatgtggaatttttcttgagttctacatgtcgaaattcactgacaggattttttagtggaattttcagagccctagaaataattttaaccaattaaaattgagcaagcaatattttaattctggggaaaatcctttttcctttttctttttctttttcctcccttttttcgaatgggccgctggcccattctctcctttcctccccctcctccctgctgggctggccgcaggccgaggcccagccaagccgctcctccctcctctcccggggtcgccgacaggtgg

SEQ ID NO: 30202 - DNA, 6135 bp, Oryza sativa
ccctccccttccctatttaagcttctccgtcgccctctctcgctttttccccatttcgccgaactctcccgagcctcccatcgcttccgcgccgtgcaaccacccgccgccgccgtttcagatactccggccgccactagccgccgctaggcttgtcgccgcaccgcgctgtcgccgccgtcgggttcgcgtggccgagatccaccccgtccacccctccttcgtcgaggtccgccgccggagcgccattcccatcgtgcgacggtcgtcccggtcgccgtccgccgcgtgtcgacctccctccgtcgctccccgtcgccggacgccgccgtcccctccgattccggttcctccgacgctccggtgtacttcgaaatagtcgccgaggttcctccagcagcagagcaaggcaagtcatgcttgtcacttgaacatgttgatcctatattgcaaatgctctattgttttccttcaaatactgcatcgttttataatgttactatgggatgtttacctattgtcatagccatgctattgttgtaccatgtttctttgtcaacttggggttataacctgattagagtttggactaggaattgcttagccatgcttagttcaactagttcacaatggggaaaatcatattaatgtttagactgttggttctaatggttttgttggtttagtaacaccgctttggtgttggttaattaaaataaatcacatggtgggtcgtgggtgcatggttttgctggtcgcacccatggcagttaaggaccggttcgcgggatgccctggaagaacttatcgtacttaccacaagccagcgtgggcaacggctgggcttgtaacgtagctttcctctagccgacgcatccaggcaagggtgggcgtgatggagtttggatgggccctgcgacggcctatgcggcttccggattcacctaggcacgagaggggactgcccgttgccttgcgaggagtgggggtgaaacctgaggtgtggtgtgcttggttagagggggttatgcgaatggtcctgtcacagcctctttccggtatgtcgtggtggcatgtcggcgcacggaaacgtgttgtggggctgtgtcttgtgggtacagttgtaattaattattacaactgtttaaatctttcaacttctgttcttaaatgctcgctttatgcaaatgaaccactttagctcttctttgatgattccctgcatcatgctctgttcttaaatgctcgctttatgcaaatgaaccactttagctcttctttgatgattccctgcatcatgcctctattccggcatgacttgctgagtacagtgggtagtactcagtcttgctctacttttcccaacccccagagtgcgagtatatgtcggatgaaggtttctccgaggagtaggcttcgtccgtgccgtcgaggatgcctgtggagtggtgttcccgctgcagttctagtcaaggcttagctcctgttgtctttctttctttcccgctgcagttctagtcaaggcttagctcctgttgtctttctttctttccgctgcatttatgtaaagacttttatgatgtttgtaagacttggaattctattcgggaatttctgggcgtgacaaggtgtcccgccttcccccaggccgggaccgcttacatctgatagctttcataggtcatagactgccctcacagggcaacacatatcttttctgcacactttgtcctcactcgtgtgcacccgggaagaatttcccggtcggtcacccatcccaaattgctccaggccaagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccccaggccaggaacgtcctctcttggtcacgtccatgtgtccagtgccaacgcatgtgccatgctatgtaaccactcccggtctacaccagccatgcgcaccatgcctgcgcaattgcgacacgcgcccgtgaaaccgcgagagtcggctctgataccattttgtaacgtcccgcctccccccaggccggacccgcttacatctgatagctttcataggtcatagactgccctcacagaccaacacatatccgtgaaaccgcgagagtcggctctgataccattttgtaacgtcccgccttcccccaggccgggcccgcttacatctgatagctttcataggtcatagactgccctcacagaccaacacatatcttttctgcacactttgtcctcactcgtgtgcacccggaaagaatttcccggtcggtcacccatcccaaattgctccaggccaagcacgcttaaccctggagttcttcggagattggcttccggaaaaagcttccggaaaagaagttgcaacttgttgatatgagtattctattaatcctattaagccctaggccgggatgttacatccggcgaggcggcgcggaggcgacggtgaacgtcgacgcggccggagctcgtcggcggggaggggagggggcggagtccgaaggcagccgccaagccggcgcttcccgtccctggcgagggacggtggagggacactccaagacggcgcgcgcacgggaagaccgacgcggccgcaaggaggtgaagtggcggcgatgctgcttccggtttagggggcttcaaaatccggtatgtcaccaaacccgagcctaattttcttccatttggatttaattcggactttgtgacttagggttcttccccaaagaattagggttcttcatttggggattttaggccgattggatccggcttatggggatttcgggaaatttcaatcttgtttattcccatatgattaaccgtggggagtttcaatcttgtttatcccctaattcttgtttgctgagtactagccgaaaccttagtttcggtctaggaattttgagtgcgggaattgggaatttccctttgctaaatttaggggaatttcaatctagtttatccccttcttagcttcggcttagggttctgagtgcgaggaaattgggagtttcaatatgtttatcccaatcccttttcttctcttaatctccactgatggataatcaaaatcgaaaacttgaattaaacagcttcttcaataatttgcttctcctactgatggccgaaaccaccagtataaaagggcttaatacttaaagaaattaatccaatctaattcaaaattgctcatgccgaatcaatcttgtatttttataaggatggcttctaatcacagggatgatgtgattatgagggattgagtggactaaaaattaggctctgataccacaatgttggagttctaattacatgatcttaagctttagtctataaacaatcacctcttgcttatgcggaaaaataattgatctacttacctgagttagaagccattgccgttcttctttcttcttcttgcagagatgcctcacgaaccccttccagtgcctagatcgatcgggcgattaattagggtttgagattagagagagagagagtttggtcgtctgtctccttccttctctttctttatataggcgacattggtgaggctcgggggttatctcaattagtttaggattctgttttctgtaccgatcacacaaaaaacgaatttatctcttagtttgtttcttgttaggataaggaaaccggtggtttagatcctctcctaacccttatcgacacaagtcgacaaaatcaaccaacatacataggcataataaagatacatatatactgcacacaatacaggagtcataaattgtcaaaaacaggcttctcactgagagtgtgatgaagactgattttatagaagatttctctcgttttctgacgtgcacgcttcccgaactactaaacggtatgttttttgtaaaaaaatttctatagaaaagttgctttaaaaaaatcatattaatctatttttgaaatttaaaataattaatacttaattaatcatatactaatagctcatatcgttcgttttgcgtatcttcccgatcatctctttcaccttctcattaaactcagccttagccatacgaaaaatggggtactctgctgttttacctagcagcacaaggcttgtaaattgtaatgccttgtgctctcccgcaaccccattttaatggttcaggcttctctcataattgatttttcaacgataaagacaaaagaagttgactacctgtgtagacctttcacctgcacatggaattaatctgtcactgtaaaaaaacctagatttgtttttattccatctggacagagtagaatatgtcacatccaattctaaatttattttttttgatagagagagtatgcaggattctattgtatcatagtcctaggctgggttcgttgttgtgtgttgggaatacatttctagcgcacgaaaaattgagcggtccattagcatgtgattaattcagtattaggtaattttattttcaaaaatggatcaatatgattttttaagcaactttcatatagaaactttttacaaaacacacaccgtttagcagtttgaaaagcatgtgcgcggaatgtgagggaggtgagttggaaagttggagaaagaactcagccctagcgttgttggtcatcctattggacccgctattgatcatcgttttggtaagctgcaacaagcttagctaatcagaggagaccctctccttgggcatatttttacttctactactcaacctatggggtattaggaaccatttccagattcataatttatataaatggactcttgacattaaaataatcaattaaggtatcattagttggatttccaagattaagaatgccacttctatcaaacagataaatttgtctctcgaactatagctttaatttattttcaaggatggtcaataattagatttctactattgcccataaaattgtaggtcctgctcattcagcctctatcataaacaattgttttttggtatgggggaagtcaatcattggctccacaaacagtggtgtgtacatgtggttagggtaagtgctataatgcttcatatgttacccttaaaagtgacacatagaattgggtgatgaggtggagaagagagatgatgagtcactcctaaatcaagaggtagcctccacacaaactccaagaaggatatgggagtattataggtattggtatttgtgtattaggggtgacattgtatatattacctcttaatttatgagtgaataacatagataaatttggaggtagcaatcacatctactatagatcgtgtcactgcaatcagctaaaggaacaaagaatgagaacacacggatcatgatttgtcttggccacttgatgtctcgacctacggagtaacatcctcggccttgagctgaccttgtcagtcctcgtcacatggacactaacgagaataaaaagttaatatggttcactaatagaacatagagccatatacaacacttatactaaatgcaatatccataggtggaacaattatcccttacaacttgatatggattagaggtctatgataaccatgtaccaaaatgatgagaaagattgtaaacaattatcatggtgattgttttcacccatcacatatccttcaaaatttgcagcatatgctgctaaatattccaacatccaactatgttggaattgctagttctgggctatgactctgattgcttatctgtccatacccctttggggcatattgtgattgtgtagattacgtgttatagacaactttgtgtagttgtctaaagaatatgttggttggcaaatcttggttggttggcaaatcttgttcgtttggcgactccgatttttggtaatgccatttatctaagctaagtgtgtaaagactagaaaatctgtcaaaaggttgattttcctttgttagctcacatcctaccaatgaaagcaacacatttaatgcataaacaaagaaaatgtaggatacatttcttcccttccccaaccttaacaaataaagggtgggcaaggctagtaggt

SEQ ID NO: 30203 - DNA, 8324 bp, Oryza sativa
  unsure (1)..(8324): unsure at all n locations
cccattatttgttaaggttggtgaagggaaagagtgtatcctacattttcttagtttatgaattaatgtgttgctttgaatagtaggatctgagctttcatagaaaaataaagttttttagaggtattctagtctttacacacttagtttagacaaatggcattaaaaaaatggggttcccaaacaaccaagatttccaaccaacatattctttagacaactacaaaatctcgaatagtctataccccgtaatctacataatcgcaatttctcccaaaggggtatggatagataatcaattagagtcatagcccacaacaagtacttcatatttagcagcatgcttcaaattttgaaggatatgagctgggtaaaaaaaatcatatatgtaattgtttacaaccttttttgtcgtttcgatatatggtttattatagacctctaatctatatcaagtagtgaatccttcctcctatggatattgcatttagtacatgtgttatatatggctctatgttctattagtgaaccacaataacttattattttcatttggtaatcattgccggagccatggattgttatttgtaacaatctagccccaagttagtttttatgacaatatgctagttgggagtttggtactaatcatgcacattatgcattacaaagagttagatctcaatggtgattcacgtggaaatcatcacccatagtctataaccgtctgtaacaacgatatagcattgtaggttccattaacaacgatatagccttgtaggtcccattatcaacccgaaacattacttaagtaacgagcaaaattccagtgcatacagggcaggcttgctaggataaaaatttcatgctncatgtgtatgcgtcatatacagaaaatgtcaatcagctcaatattacccccacccttgtgaaaatccagtcaaaccaacaccaaatgggtgatgcatgtgtttatcagccatatagggaaaacctggacacatgatgtagttctctagttactatatatgttgtttgacattaactggtttgaagcagctggaagttacacacacgcgcgcgcacgctatttgctaaagtgatgatcctctactatcaatagaggcgtttattggagttataatgttaaatggcgacttttcattatattgatgcaacattgttcaatagagtgcgtagtctatgtgcagcatacaactcaacaaaatggttctatttattttccatggatctactgaatctcaagcttttaataagttgtaccgtgaaggacaacaaattagggtgtgcaactataatcaattgaagactattacaatttataaaccagataacacagtcaggaggagagaactataaagtaacttaggtctatggtgtggtagaaacatagccaacaatgatgtctcctatgtttgaacaaacatactgttagaaatatggtcataattcagcatattttaatccagaaaaaagataataaacatgacatgtggaaaccgaaatgatccagtgatagtgctaaacatgaaaatactagtaacaatagtagcatcatctagtaacatgtttaacactaaggtgattagagtaatatacccagagaacgctcctgaggatgagacattgttgttgctgttgcctacgttggtgttgttgttctcgcctcctccagtaccgctgccgacatgtccaccgttgacgcctcccccagtcaacatgttgatgaagatgaagtagacattgatgaatagtgagtagtcgcgccttgcactccccaaaaacctgatcgcccacctgtccgtgcaaacgtcgtacctgtccgtgcaaacgtcatagcagtgtgtggtttcgaaggcttactctcctaatacgtgtgcacacactcgtcaggatgggattaccgtagcagcaacaacattggaagtggatgaaacgtgtgtgtctcttctcccattctcattttataggagaaatgaaagatgaagagtaaaagagtcatggaataggaagatgaatagagtaactaattgtcatcaactatcctccactacacaaccatcaaccaaccatcaattaggagtaattgatattggttaccaattcattaatcaaatggattaattctcaaaacttttcatcccattgatatcccataagagaatgaatacacataaatttctagcatagtgagccttggaatttatttgatttaattggatcaattacccaattaaatctaacacatattaggcaactatgatcagatgcaaccatggaacatgtagattgaataaaaataatatcactatcatatattgttaggactttggtactccaaatgaatactgcaaacacaaatccagcattactgaatgactaaatatccagtgtttttcaggcagtttgataacaatggttgatacacaaatcaacacagtggttgatacacaaatcagtgcaaaagcctattgcatataaatttgtcgctagcaagccagacccttgagcgaacaaagatgttctgaccaaattcttatcattcaccaaattttgataatgcaacttggcaagaatgtattgaaagcaatgagatactctggtaacccataaaaaagatgctcgcatagtgaaccacactgtaaattaaatgaaaatcctgtataaccgagcaattgacgatatttatttactagttgatccataaacaactcctacaacatagatgagaatttctctctatagtctaatcggccatgattttacatacattccttatgttttcattcttcatgcttgtgactcacctgctgtcggtgaaatggaaaccagggtacccatttatctggcaaaaggatcattatcaaataaatagcatgctcagaatatctttaaaaataaaaaggtaaccctagagtgacgtagctaggggcccactctggtgggtcccgggcccacctaagttttcatatatgggattctccctagctgaggaggaatactgcgtgtatgactcaaatctctgagcataaaagtagcttgggacctggcttgggtcccaagcataccccaaatgcgtcttaagaatatagcctatggtctgcctcggacctggccctgtcctaggtcccagtctcaccttagtccttgtaggttctacggtcctcggcaaaaggggcgtagaaatctgcaagatttatatcttaagagaacaagctaaggtatgcttcgggcccggcctactcttgggccccgggctcaccttagttcgcatgagtcacgcactactcgaggatgatgagtgccaagacatacaaagcataaaggtgtaaactgaggtttgcctcaggcccggccttgtttcgggccccgagctcaccttggtccttatagggctcactccctctgcctagaggagcatcgagacgtacaaatcttggaatattccttcaccaacgacatcttcgagaaactcatccgaggattgccaaacttgccgggaagttgggcgtgctccatagccagctgtgaggcagtatgccccgccataattgaaacaggatcatgggggatccccaactagtctgaagttgaaaggacgtggacaagacaccagcgctgagtcacctaggactagtgacgccttggacacgcgtcacacatgcctcgcaccacttgatttatccaagcaagtggagaagcaacggtggcactgtttcgggcaagtcgggtctcgtcaggcccaccacgcaccacgtggcgagcacactggtgagatcctaactgtctcagatggagcccggggtaatatgaatcgcaagactcaaagggtttcttgaagactgtgttagggaaccagccggcgacaataagacagctgataagacaagactaatagtagattggtaataatgtgagcccctccttggactataaaaggaaggggaccatatacagatgaaagggttggattcttttagatcagtactcttgctttgtagcctgaaaaggtctccattgtacttagctgatctagagaagacaacgaacaccaacatagagtagggtattacacctctgggtggcctgaacctgtataaactcctgtctccctctctgtgcagggtagtcgggccccgtgaacccttcctgattgcagatagtccgtgcctctcaccgcaaaccccctggttggatctttactctcggggaggggtctccactccccgctgtctgagggactaccccctcgacacctgcgctggtagaaaccctacatattccgacaaactgataatatttcttaggatgttgtaaaaaaatgttcttaatggtgagaaggtacgtgcttgttctcttgttacctaatgcacctatgctgatagaggcatggaagttggtcgctcgactggcctttcatgatatggagatcaattaaactggataccattatatctttcgagaatacaaactggagaggaaaaatacagggaaaactaaagactttttagttaagagttaggacaaaggtcactaaataatggctcgaggaatagggtcaaagggaagcaggacgccacctgtgaacatcatatctgtagcacggcgtgtttatatttctttcagggataatgaggatgatgacatgaagaggaagagatagaggaggacaagaaaatacggatgattattgtaatctggagagcaccttggaactttataccttcacattttcttaagtaaatttcacgaaagcttggctgatactgttcaagttgcacaaaatcacacgtgttatgttacgctagatattgtggtgctagagcaaaatttgacagtacactaggttgggataaccattttacaaaggtttagggtgtacatagtcactgctacctatgacgggcaatgaacaggagcctatcaaagataactatagtcatctttcacaggtgtaaagctcgcacatgtcactgatgacccctcattggtgacgagtttggttgtggctcgtcacagatgtcctatgccagaccacaaatacagcccatcaaagataagtagtcatcgatgatgggtgtggctaggcggaaaagctattgggcgcgcgcgttccgggagtgcctaactaactattttagactctaactaactaaattagttttagataatgacggtaattaagataaaatttttctttttttggaagatttttttactaacagattgaaaacttttgacttaagatttaaactttgaattcaaattttgaaaattttcaactctaaatttaaatttgtaagacaaaatttgaaaactttcaacttagattttaaaactttcactcgagatttaaaaactttcaacttgagattgaaaattttcaagtccatatttgaaaattttcaagttgagatttgaaaactttcaacttgatattgaaaattttcaagttcagatttgaaaactttcaactctagatttgaaactttcttcagattgaaaaactttcaagttaagacttgaaaactttcaactctaatatttttgaaaacacgtgtcctaacaattaaaaaaataaggaaaaacacgaaaaaatagcgaaaaagatggaaaaataaaaggaaaacacgaaaaaaatagcgaaaaaaactgcgtgggaccgccagctggcgtgcgcgccagttccgtaactagcgcactcgcgccagttagcatgccctgtggttaggaggccatacctttgctatggggtgtatttcggcttgtacaagtgagtgcctcagtgatgggccattgggctctgtcacccggttttatattagtggcctagaatgtcacaaaatcacacattaactaatctgacgtgctactacattataatgcaaaaaatgcttaacttagatggctatcactctgatcaggtgaccaaagaactagcaaatttgagatatgaccaatatagtacatgttagatgattaaggcctgtgtagttcccacataaaaattttacatcatgtcacatcgaatgtttgaacacctgtatgaagtattaaatataggccaaaaataattaattgcacagattgcgactaatttgcgagacgaatcttttaagcctaattgctccataatttgacaatgtggtgctacagtaaacatttactaatgacggattaattaggcttaataaattcgtttcgcggtttactgacggattttgtaattagttttttttattagtgtctgaacactccatgcgacaccctatataatacctgatatgacacgcatatttgcaactcaaatatttccatctctatcaaaatttctattgttttttaaaaaacaaacaattaattgtcacctagatcatcccaactctataaacatgacaatcttccttcatttcactatcttggctatgcttgggtctgattttgataacaattttgttaaagttccttcggtgggggcaactggtggtatcttgattgcatggagaagcaagcttggatccattagttccggtagggttgattcacatagtgcctcagtccagttctgtcccaagataggggtcatggtgattgaattgtgtttacaggccacaagatgagatgagacgattcttttccttcatgatctttggggtattctgttgcattctttgggtcctaggctaaatcgcaggagatttaatcttgtttataaggatgcacagaagaataatgattgtttacacccaaatttggcacctaggattaaaataggaaagattgccaaaatttgtaagtctaccggtttcctccgagtgggccggtctgaccgccgtgtgttgagcggtcagaccgccggttgagggccagtcagaccggcggtgtgtggccggtttgaccggcaggtccgaatccgattgtgtttcgtcgggtctcgaggtttccttgctcgggaaggaatgtttcgggtttcctttggtttctaccccgagttggacgtggaggagggcctgtagagggcaagaccaacccctatataagggacatggccggttcattgtaaaaaaccaatctacaatcaatcaatcgaatcattttttcatattgcttttagttttctcttagtttgtccatctttgtcggtttgcgccataaaccgtccgccgatgctgcgagagtgcgacatctctttgtaggtttgtcctgaaaacctttcgttttgcccacgagatgggtagttatttagaaatcggctccgctagccgatttagttatcaaaacccatctaggtttagctctttgctagatcgaggtggttggcgactctaggatcaccgcaaggcttaaggtgctgcgatcgtgcttgtcaacttgtcaaaaaagttgccaacaatgataatctcaacagggccatgatagggacgtttaggtagtcaaggaaatccccttgcatgttagaaattatacttggtcaaataatagggactctcttactcttgtcaaattggatagaatgatcttttgctcagtagaatgggagtcacattttcctaatcatgtcctacatattgctgcaacagaggattaggatcatcgccctttgctgctagccatctacaacatttggtatctcctaaccaaagtacttttataaaaggttgatttatccaagataacgtcatgcttgtgcaacaaacggcaaagttcttgcaatctcaaaaggagccaagaattgctctcaaattttacacgtgtaaagcctttcactctgcttttcggccatttttacttgaagtcttgcataggatttagccaagtttagcgggatgttttaagtaggttgttggctaggttttctactcaggtactcttaaatgtactcacaacgtgtcaatttctcaccggcatgggcttcagcaaggagatctcgtgtccttgatgctcttcatcttggtaacgactaggtttctcacatgttgtgtcagacggtcccatgccccttgctcctgaatatgtaagacgtttaattgggccttcaaagcccattaggagtctgatgacgagaaacgcggcggcctgggagttcggcttagttccagtacaggtccaaaacgcttttaggtttagggcgtgccagttagtttgatccgatcaccaacaagaataaacaagaaaatcaatcaaattagaatacgatagccgatcagccagtaagtcgatgacatatcgtgtgaacctagccgatgcgatctgaccgaatcggctgtgaggtgtaagatgaatgaaattaagtaaacctaaaa

SEQ ID NO: 30204 - DNA, 26740 bp, Oryza sativa
ccttcaatgataagaagataaatcaaatatagtaccattaatactcgagaatacaaattgataaagaaaaaaacaggaaaaataactagagccttttactaagaacaaaggtcaccgggaagctgagttgaagaatgatgttaatggatgtggaacctaccggtcaatatatttagtacaaaataaatcctacataacatgcatttgaaagaaatttaaaaggtatagtgccaacacaacaccatgcatatttagttatgattttctcagttcaatcctaccagcgattatttcttctctctttgatttgggagggacgagatggttacaggtagggacggacctaggttttgcggagatctgggccggcacatggcatgtttgggccaagaccaccattgggtctgttcggttcagctgggctgtggctgcacagccacagcgctgcagctctcctagcataatcttgcttcctgagtcctgtagctacagcgcttccgaactcacccattatatggtgaaagtttgctggacctaatgggctttgtttcctaggcttcgggcaatggcatgtgtgtcttgaggcttggtctgcccttaacacaggtggagcaggagcccaaaccaagcccaaaaactagattcgccactagacctgggacatgaacctcaacaaatctagtcgacgacttggattgatacccaattaataacaatttgtaatgtaaattttatattataaccatatgacacgtgaaagagtgaaaaggtactagccagcccacactattccaacccaatagcctttagcccataaagtccaactactaccaactctcctctgccctaatttgtctctcacagtcagcctactcccccatcccacaccgtgccgcctccccctcacgccgcctccattcctccccaacctcatctcctccatcctccccctcatgccatccgctttcctcccaaacctcaacttcaccataatgtgctcccattcccctcaaattcaaaatgtatctcaaacaacaaaggcgtacaagagatagtcgtagagcaaatgaaggctagaaagtaatggtgaccatggtggagactagagaacaagatgaccattctaagaagaaggatttacatcatgcaaattaaaacccaaaagattttcaaacactaaatcagcaattcttcactcaatttcacaactaagacgaacaaagagtaaaacaagaagaggataacaagggatcgtagggattgatcggtctgactactcaccgtttgaaccccatggttgtgcctgccctttgatatggtctctctctccaatgatggtaatactcaatgaagacctactagactagctcaccctttatttgttaaggttgggcaagggaaggaatgtatatatccattggtaggatgtgtgctgacataggaaattgaagattttgaggggttttctagtctttacacacttagcttagataaatggcattaccaaaaaccggggtagccaaacaaccaagatttgccaaccaacatattttttaaacaactacacaaagttttctataacccgtaatctacacaatcgcaatatgtcccaaaggggtatggatagataagcaatcagagtcatagcccagaactagcacttccaacatagttggaatatttagtagcatgcttcaaattttaaaggatatgagatgggtgaaaactatcatcatgatagttgtttacaacctcttttgtcattttgatacatggttatcatagacctctaactctaatccatatcaagttgtaagggataattgttccgcctatggatattacatttagtatatgtgttgtatatggccatatgttcttttagtgaaccatattaactttttattctcatttggtagtcattgctggagccatgaattgttgttcgtaacaatctagcctctagttagttcttttatggcaattcactagttgggaaagtttggaattgatcatgctcgttatgtgctacaaatacttagatctcaacgatgattcatggagaaatgatcacccaaagtccataaccatatgtaatatcgatatagcattgtaggttgaaagaaccttgatgtcacctaagagtggtgaataggcgtttaaagcttttacgtaaatgaggaagctagactttttggatattccaaactattttcggatatttccatattatttttggatattctgaaaatctcagatttacgagcaagctagtaaagcaagcaaaaaagtgtagtggtacaagtaaggaaatgattgcacaaacaacaagtaaactactagcagcatcatcaattagctaagatagatgagtgcgcgagatatatcaccaggattcttgtaagacgatatgctcccgaagttcaaatacttgaggggattctactctccgttgaggagctcataatgagccaggtcttttccaaccctatccttgtgaggttgcacaaatgtactcctccttccactaaaggtatctcttcccattcggaggtgagatcgtaccttcacaaactccctcggcacaccacaaacaaattggtgtctcgaggttgactcctagtcgtctaggtgtcctcaactaccaagagtaacaaatgcaacaaagatttcttggagatgaattgagtgctcaaaagatcttcacgaagtcaacaccaagcactaaaataaactcaaatcaaccactctcacaaacacatgaaatccaagcttatagatcggtggagaggaagaagtgagaaagcaagactcaaagtgaatctcaaatcaacacaagataagcaatggagccaactagcttgaggttggagggtagggacggcaattttacccacgggtctgggtatccacgggtatctgtggatacatggcccgatgggcacgggcatgggtgtaatattttgcccgtggccacgcccactcgagacctgagaacgtagcagacagttgtcgagtattattttttacccgtaggtaactcatgcccgacccggtacctatgtattagctaatttttgcctacctagccatctcttaattctcacaccctttctcttggctcatttggctcgttaactagggacacatatatactcaactaataaaccctaacctaattccccattcccctctcctacccccatacccacagcggaggccggcagtggcactgatgcgggaaggcggaattggcatagtcatcatcctcgtcctcgtcacatgcagccgctgtggtgctctgcgatgccatgaccagcgacggaggtggaggaggagcggtggagggacgggaacaagctaccattgaggaggagcccgtgttgctgccgcccgtatacgaggctccccgcgtggaggcagtgcatggatgcggtgctcgccggagggatctggaccgcgacgcggagatggcgaggcgaggaggaagtgggatggaggttggaggagagtacgctcgtgagtcgcagcggtgggcatgaggcaacggctcacgggcacagtgggtactcgttgggcatgcctgtggttgacaggcatgggcacggtcacggggttttgcccgatagactttacgggtgtgggtcgtgcatgggcacatgggtctcgggctgggtatggatttgctctgcccgtgcctgacctgactcgttgccatccctagggatggggcctatttttggccacaccctcatatctgcccgaaaatcaccagagagcaaaattaactttcagaaatttctaccgtgattttcagaagttgctatagtgttttcgcaagtttccaaaaagtgtaaaaaattcagcatgagcatagtagaaaactgggcaaattagcatgttggaaattctgaaaatattttcgaaaagaaatccaaaaatcaccagataaataaactttcggaaatttctactgtgattttctaaaaattccgaaatcaccagagagcaaatttgttggtcatatcaattttggaaattcagaaaggaacttttggaaatttccaaaaattcagcgaggacgagggcgaggctgaggccgcaagggcgtgaccagcggtgaggcagtgaccacgccgaggcaagtgccgctgccgagctagcagctgccggctggggcctgcctggatcatctattcatctctgcatcatcaagtaatttgacgaactagactgtcatctcatctctgttattagtctgtaaaagtattttgattcttgaatgattgattggttggattgattattgaatcaaatacatatgtgatatgtcttttcttttgtttataaaaggaagtttttgtttcctcaattgcttcaattcctcatcatgtcttccagcaatagaaaatatgattcactgactagatgaagcagaatctcaaaagggtgcttttgatagctttgttgtaagagaaactcaggatgctactgttgctgacggtcatggtggtgatgtagaagaggtcgaggttaatgttgcccaaggtgatgcagtagaggcaaatattgatgaaggtgatgtcgataatattgccgatgaaggtcatgctgctaacattgccgaagaaggtcatgaaactcatgatggtaatattgccgatgaaggtaatgatgctaatattgccgatgccatcaattgttcttttcatgatggatgctaatattaaagttatatagttgactaaaagtatgccatgtttatatgatattagatatatgaaatttccaaaatttacggccccaattatcattttatttaggggccccagatttctggagatggccctgagaatttctctctctaatctaatcagtcatgatattatatgcggtcatcatgcattcattctttatgcttatgggtcatatgactcacgtgcggctattagaaacccctcatgatttggacgaaccaagaagtctcaggatgttatttgtaaatattgtaaccttctttttatatatatttaatatagcgcagtaggagcctctcctgctgtttcccgtcaaaaaaaagtctcaggatgttctcttcgtacccaatgcagcagaggcgaagccaggggatctggaggaacccaggcctccccaggccaataacaaccctcccccacccccaccccctcttctctttttcacataataatcatctttttatcacctagtggccatgttcagctgctggttcgcggctgtggcgcagccggcaccaacagtgccgcacgcacgcggcgcagttgccgtagcaggcttgctaaacaggcccagaatgtcaagtgtaaaatttgatatggctatggtatactgttcaaccatgaactaaaccttccatgctgtaatgtacctctacataatttctaaatgagtaaaatacacggccaatccttaaagttggagcgaggtgtcacttaggtccatgatcttgaaaaatcaaaattaggatctgtgatcttgtttaagtgactcattgaggtccaaaggtcatctgaccgggttgactggcttacatggcggaccagagtggtaacatatttgcatttcggtccctcctccccgcatccaatccaacgggagcaccggcgggcctgggaggccggcggcagacgagcacggtaccgtcggcgggcagtgggtggagcggcggtgggcaagcatggcggtgggctgcggggggagcggacggcgggagagcgcagtagcgggcctgggacgccggcggcgggtgagcgcagcatcggtaggcgggcgacggatggaacaatggtgggcgagggcggcgatgggcgaacacgacagcagttggcgggcaacggagggagtcagagaagagcttgcgaagcaccgtcgccatgaccattgtgggcgagcgagcatcaggcagcgggtggtggtggtagtcttgtaggcatcctactcctgctacaactccatccaccgtctctccaatttgccgccgccgccacggacagcgtctttgcagctagtgtgccggtggcgccgcgcctcaccgatggccagatttgccggtctcccttcctgcgggtcgtcggcggcagattcgcggggcgatgcctcgccgccggagtgatggatgccgagctccgcctagtcgctggcgctagatccagccgcagctgggacgacatccaccggtgtgcgcgccgccgcctggcacggtgacgtccacggccttagtgtggccgttgatggcttgctgccttgccggagtgcgccgagtcgacggccgatgtcccaccggagaaggtagagctcctcaagatggcgttcgatggcctcgctgcgccattcgccgtcttcctcgccgacggcctcgctgcgccgtttgccgctgcctaccagcttaacgcctcagcggtgccacctcatcgtctactgcagctgccccgatgtcgagggcacccagctctgcagcctccttaacgagctctaccacaagcccgtcgtgcccgctggcatcttgctgccgcccgacactggcgacgaccgcgaccgctcggacatgatgcggtggctcgacaagcagctagcgaggtcggtcgtctacgtcgcgctcgggacagaggcgccgattacatcgggtaccgtccgcgagctcgattcctctaggcgctacgcaacgccagcgagtggctgccggaggggtacgaggcgcggcgtggtggagatgaggtgagtcccgcaggtgcgcgtgctggaccgccacgtaagcctgtcaacccggtcacgcgttcctgtgtgcaccacacgaagaagtgattggatcggacacgggaaagcaaagagggggaggggtgcaaaatacaaatatgtttccacgctggaccgccacgtaagacagtcaacccggtcagaggtcctttggacctcaacgagtcacttaaacaagatcatggagcataatgtcgatttttcaaaattgtggacctaagtgacacttcgctccaactttaaggaccggccttgtattttactctttctaaattattagtcaatacttgcaagatggatatattgttgctcatttgcctggatgttgctcatttgccttgatctagttttttttatctgattgtttatctatttatctagacatttaactcagataatattatcatcacttgtgatatgtctccctagaacccgtattgctgaaagtgaacagtaaatctaaaaaaataggtccttgagaaggtacctatttttttatagtaaaattttgctacctcgagttacctagtacttacttgtagataataagttttacactagaaaatgtgatacctcctactaccttctgaaggatgataaattatcattcttatgataatgtttttttatgttgatatacgatatattacctttgggaagccttaaaatttgatattttttactatattttctaattgttatgatcacttgtcaagttgctcccctcatgcttagatgctggcttccccagtgaatgcaccactgatgatagaggcatggaggttgatggcttgactggcctttcatgatatggagatcaattaaactggataccattatatcattaaagaatacaaaatggagaggaaaagtacaagggaaactaaagccgttttactaaggacaaaggtcactagatactaggtcgtggaatagggtcaagggaagcatggaccttacctgtgaaaatcatatctgtaacacattgtgtttgtatttcttttggggaaaatgaggatgataacatgaagtggaagaggtagcagaggacaaaaatgtggatgattattgtaatctgatgagcgccttggaaacttatacctgacatttttgaagtaaattttaggaaagcttgactggtacggttgaagttgcacaaatcacacgtgttatgttacaccagatattgtggtagaggcttacagcctagagtatcacgaaatcatacattaaccaatctaacgtgctaatactacataataaaaataaatacttaacttaggagtactccctccgtcccaaaataaggcaacctgtgaccactcctaatacaacgaatctagacaacccttcgtccagattcattgtagattagatgaccaaagaagatgcgaccataagttctcaactcatcttcttcattttccacatgcacgctttttaaattactaaacggtatatgttttgcaaaaggtttatatagaaaagttactttaaaaaatcatattaatctaatttttattttttatagttaatacttaattaatcatgtgttaatctattggtccattttgcatgcggaggggaggggttcccgacggaaccagatcgtctgacatagagcgatctacgccagagggacatacaacgcacgcccgccgttcatttgctatctaaaggtgccaagcgagcagagagtacagagtgaagcgagacagcctcactttcggcccactccaataaaatcagcctgctaaaccggaggaatcggcgacgccgctaatgcttctgcatctcacagccgcagccccaccgcctgttagttgattagttgagtctgtttctatctccatgcatgtgataatgatcagtttagttgtgataagataggattagatattatctcttcctttatatttggtatcacatgctggtttctctcccgagttggcgcggttgttgccgatctcgtggacttctttaatcgccacggtgagggctattctcaccatatattaacgcgtaagcaacgcactgatcgaaacatgcgattgtttcctgccaaaatcctcacatggtatcagagcctgatccaatctaatctagcgatgttactcgatggcgtcctcctcctacaccaccagtagcgccaatcctctccagggaagcttggtgagtgagaagcttggaaaaaccaaccatgcactttggaaggtgcaggtctatgctgcaattcacggcgcgcgtctacaggggaacctgactggcgcaggaaagaagctagacgccgagatcgccgtcacagttgatggcaagacggagaagaaggcgaatccggcatttgaagattgggaagccgtggatcaacaagtcctaggcttcctcctcacatctctttcaagagatgtgctcatgcaagtcgcaaggtgcacaacggcggctgaagcatggacaacaattgattagatgtactccacccacaccagagcgcgagcgatcaacacgtactatgcgctcaccaacaccaagaagggaaatatgatggcgcttggtgacgagatgccggcaagcaccgggcgacctgttgaagaagaagagatgatcatgcacatcattgccggccttggcgagggctacagcgaggtcatctcagcaatgagtgcgcgccccgaaccaatgaccatgggagaattatactctcagattgttaacttcgagggtcgcatggcactctaccgaggaacccaggagaacgtcgtcaactttgcaagccgtgaaggtgccggcaatgaaggaggttgcggtggcggcaacttcagccgcggcagcagcggaggtgctcccctaggcggttgcgggcgcggcaacaatgccggaggtcgcgggcgtggacgagcaccaggagctgcagatcgccgaccaacatgccaagtctgcttcaagcgaggccacactgccacagattgctggtataggtatgatgaagactatgttcctgataacaaacatgttgcagcagctgcggcggcgagctcctcccatggcatcgacaccaactggtacatcgacaccggcgctacagatcacatcaccggtgagttggaaaaactcacggtgaaagacaagtacaatgggaatgagcagattcacaccgccagcggagcaggtatggatataagccatgttggcaatactgttgttcatacccctaatagtcacaacattcatcttaaaaatgtgctatatgttcctcaagctcagaaaaatcttatatctattcatcgtctagttgaggataactctgcatttcttgaactacatcgtgattattttttgtcttaaggatctagccaccaagaaaacgctccttaaaggaagatcacattgcaggctctatccccttcccaagccatccttgaagtatgcttgcaatgccaccaagatctccttccatcgatggcacagtcgtctaggtcatccctcctcgtcagtggttagacaggtggtcaataaaaataatctcccatgtttagatgtgtcaaatgagtcagtttgtaatgcttgtcagcaagcaaagagtcatcagttaccatttcctgtttcatctagtgtctcccaacaccccctagagcttgtcttctctaatgtatggggtcctgctccagagtctctagggagaaagaagtactatgttagtttcattgatgattttagtaaatttacttggatctatatgctacagcataagtctcaagtctttgaaaagtttcaggagtttcaggttatggtagaacggctgtttgacaagaaaattctagccatgcaaactgactggggacgggagtaccaaaccctaaattctttttttttcgaaaattggcatagttcatcatgtgtcatgtcctcacacacaccaacaaaatgggtctgctgaaagaaaacatagacacatagttgaggtaggtctctccttactatctcatgcctctatgccattgaaattttgggatgaagcctttcaggcagccacctatctaattaatcgagtccctagcagagttaatactacccccttggaaaaattatttcatcaaaaaccagattattcggccctacggatttttggttgtgcatgttggcaaaaccttcgtccctataataaacacaagttgcaattccgctctactagatgcgcctttctcggttttagcaacatgcacaaaggtttcaagtgtcttgatatatcctcaggccgtgtatatatttcccgtgacgttgtctttgacgaaacggtgtttcccttctccgaactcgatgctaatgcaggagctcgttttcagtctgaattatctctcttggcacctaatattattagtggggatgaacaggaattccattcatgggctaatccacttgctaatctgcctaatatgtctcacaatttgcctcaagatgctgcaacagatcaaacggccacagaagatccaactggcgctgactcccatgatgatccctgcgcccgccctgacagatctgtgcatcgctcccctgcgcgcacgcctgacgcgtctcctgtccgccagtccagtactgccatgtcgccacaccagcattcgcctgctgctgatcgcattgttttgcaggggtcaccgtcgcatcgggagacaagggggcagcagtcaggcacagcgacgggtgatgggacgtcgggcagtcctgcaacagatattgaaacacctgacaccaatgacattgatactgacgatcttgatgtcacaggtattaatcccgatgccgacactatactgcctcattttcaacagttggagattcaggaaccacaacaggtccatcccagaacaaggctacaaagcggcatttgcaaggaaaaggtatataccgatggcacaattaaatattcctgctttactagttcaggtgaacctagtgatcatctagaggctctaaaggataaaaactggagattagccatggatgcagaatatgaagcattagttaagaataacacttggcacctagttccacctcagagaggaacaatgtcatcggggtgcaaatgggtgtataaaattaaaagaaaggctgacggttcactagatagatacaaagctcgtctagtagctaagggattcaaacaaaggtatggtatacattatgaggatacctttagtccggtagtaaaatgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaatgtactctccggaattttccgtgaattttcggagctcgagaaatagttttaatagcacaaagatcattgcatcaattaaaataaaaagaaaacaaataaaattttcccctctttgtcttgggccgctttcggcccaagatcttctccctctccatcctctcgggcccagccgccctccttttcccctcctcccttctctttgggccgtcggcccggcttgccccctcctcgcgcaagtccgcttcgcctccctcatcctcctcctcttcccgagccgccgacaggtgggccccacctgtcggggtcacccccaacctccagctcgggccagcaaccgccatggccgcccgagccgtccaacgtcgccgccgtttccgcccacctcctccaccccccgcgcgcgcgcttgtccgtgggacctcgccgcccacgtccgcgccgtttccccccactctccccgcaaaatccggccacgtcgccgcctcccgcgtctctctctcccccacgacgccgccccacttcccctcgaaatccgccgctccccggccctctcctcgcccccttgagctataaaatcaatccccgtggactcctcttcctttttccccgttttcccgagtaccccacgccctctaccgagctctccacgccgatccccttcgccgccgctcgccggcgatctccagccgcccgccaccgccgctcccgtcgctgccgcgctgcgccgccgccacctatagcatcacagtgcctcgccgcaccccggcatccactccatctccctcctccaccgccggaaccaccttcccatcgcgaggccgagccactaccgccacacaccgccttcagccggccgctgccgccgcgttagccgtcgccgcacctcgccgcttgcaccaccggcttcgccgtgccttgccgcacctcggcccccgctccgttttcccatttcatcgccggaaccacctccccaccgcgctccctctctccaccactcaccgacgagctccagccgccgccaagccgcgccctgccaccgtcggcttcgctgcatcgcgtggtaccccggccgctcttccaccttcgttggagaccgccgaatcaccgccgtcgtcttcgccccgtgggatgctgccgcctccctctgctcgagccccatcagccgcctccttcgccgccatgcccctcggtgagctccgccgcctccctcttcgcctcctccgctcgttttcgccgctccccggtcgccccctcgctcgtcgggccgacgccgccatcaccattgtcgtcgtcgtccttcccgcgtcggtgagcatctccctcctcctcccctccctttctttttctctctttgcccgccggccgccgcatgcgtgtcgccgtcgcgccgcgccgcgtcgccgcctgtgtcgccgccggtggtcatccggccgcgcgccgccgtctggtcgggttggtcggcgagccaaccctcccctccgccttgcacctctaccgtggactcggtccacggtgggctagatccttttgcccgctgacgcgtggggcccgctcttttggtggacccggtccaagcccgcacctccttgacccgctgacgtgttgggcccgcctgtcggcgccggcgccccttgctgacgtcagcgaataacatttcctttgagaaaatatttaataattgcgcaataaatcgagtttaattatagaaatccatttaaatggctcaaaacttctaaaattcatatctaattcattcgaactccgaattgagccattcaaattgcaaaattcatctaaaattaagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattctccttgagcatgttgatcccaatttataaatgttttaccgtttacaaataaatatgcatgttttgctaattacatgggatcagggttttcctatctgctcgcttgtgccatgtttacttgatatctatcctttgtcaaacttgggtgataaattgactagctcgtgttacttatgtgacctagctagaactatatgcttagccatgcttaattaccactagctcagtcgatgggataattgcagtattagacattctagtatcttgttgagccgcgtgctcgagacatctggccatgttacatggtcataattatccaactaaaatgcgactgaatggtgggctgtgggtgcatggttttgtgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttatgctttatttacgtttggagctgtttattacttgtcgttttgtgtaccctggctggtcctggacagggatttaatacacaaaatagtctggaaatttgggctaaatttctgggcgtgacataaaagcagccacaattaggataatatgccgtgtctagaggatggagtcttagacaactggatgttcagaatgcgtttcttcatgggtatttagaagaggaggtgtatatgcaacaacctccagggtttgaggatgtcaccaaaccacactatatatgcaaacttgataaatctttgtatggactaaaacaagccccaagagcctggtttgctagactgagtcagaaattgattgaacttgggttcagtgaaccaaaggcagacacttccttgttcttcctgaataaatgggagttcactatctttgttcttgtttatattgatgatataattgtagccagttcatcagagagggcaactgcagctttacttcaggatctaaagacatattttgccttgaaagatcctggagaactacactacttttcttggtattgaggtaagcaagatacataatggtattattttgacacaagataagtatgctactgatttactaaagaaagtaggcatgataaattgcaaaccagcagctactcctttgtcagtaagtgaaaaaatgtctgttcatgaagggtctcctttgggtccaaataatgctacacaatatagaagtatagttggtgctttgcaatatttaactcactagacctgatatagccttctctgttaacaaaacctgtcagttccttcatacccccacaacagtacattgggcagctgttaaaagaatcctgagatatataaaacaatgtactaagatgggcttgaatatacataagtcagggtctacattggtcagtggattttctgatgcagattgggctggcagtatagatgacagaaggtcaacaggtgggtttgctatatttattggctcaaatctagctagtgtcatggaatgctaggaaacaaaccacagtgtcaaggtctagtactgagtctgagtataaggcgatagctaatgcaatagcagaaattatgtgggtgcagactgcttgctgagttagggattaaaagtccccgtgcaggtaaaatttggtgtgacaatcttggtgcaaaatatttatctgttaatccagtgtttcatgcaagaacaaagcacatagaggttgactatcactttgtcagagaaagggtaagtcagaaattgttggaaattgattttgtttcttccggtgatcaagttgctaatggatttactaaaccattgtcaactaatcttctggagaagtttaaagccaatcttaacctaaccgagaagtttaaagccaatcttaacctagcaaggttatgattgagagagggtgttagttgagtctatttctatctccatgcatgcgataatgatcggtttagttgtaataagatatgattagattttatctcttcctttacatttgttatcgcatactggtttctctcccgagttggcgcggttgttgccgatctcgtggacttctgtaatcgccacagtgagggctattctcaccatatattagcgcgtaagcaacgcactgaaacgtacgattgtttcctgccaaaatcctcacaccgccatccgaggacgcggcggtggcttaatttcgtcggcggcggcacccacgtccggcgctgactacgtggcccgagcagtttcacgctatgtttactattctcattagtgaagcagtgagccggcgcctgccacacttagaagttagaacaccatccaactcaaataagctcgtcgcatgcatgctgctgcatgcatctctgggaaacagatcgaaagacacaagtcatggcagagctgtattaagttactgaaccagtgaagaaattttggactgcatcactgcatttgttcaataggaaattaaagcacattgttgggtcaggatagtaatcactgcagaaacttgactacttcaatttcccttgagaagaatatcagacttgacataatgatgcaatgatgcaagactcgtgggatttgagtcgagacgtgacagtcgaccatcggccaggcagtcatgtgctcgagtggcaggatgctgatgggtggcggggcaggaggtcgagttgaagtagtacgaggtgctattggtccactcgacgttgtagacctggttgccgatcgacttgccggaggcgactgacaaggttgaggttgcagccatgggccatgctggcatatcaagagcaccttgtgaaactgctcgggattcggcgtcagcgtcatataggagagccaccgctgcggccctcgaccggccggtgaaactgctgcggaaaaaagtacaccgaaggtccccgaacttgtcatcgagttaaaaaacatcctcaaatcgtaaaaccagatatccgacatccctcaactaattaaaatcggtcacaataggtccttttgtggttttgattatggttttatccgacgtggcggctgagtcaacgtgggccccacatgtcaggatgccacgtcatctctcccccctcttctctcccctcccctctctctctctctgacttttcccggctcgccgtcgctgggatctagctcctcccctcgcggcggacgcggacgtggactttcctggctcgccgtcgcttggatcccctccccccgcggctgacgcggacgcggacttccctggctcgccgtcgccgggatcccctcccctcgcggtggacgcggacgcggacttccccagatcgccgttgccgggatcccctcccctcgcggcggacgcggacgcggacacggactctggcacggtcgcaatctgctcacgcgtggcccgccgtcgtgccgcctcaccccatcctcgcgcggccggccggcgaggggagcgcggcggagaggatggcccgcgcgacgtcagttccccagccgccatcgcaggatccatggaggaggaggaggcggccgcttgcgagatcgcgcgccttccggaggagctcctcgtggcggtgctctccctcacctcgccgtggtctgccgtgacttccgcgccgccgccgactccgacgccgtcaggtcccgcttccttccccgcgacctcccgtgcctcgccgacggtgagctctccctgccgctgtccatgaaggagctcttcctccgcctcttcgctgcgccccttctcctcccacacgaactcacggtgagatcccttgcagtggcggcgccgtcgccgcttcctcctcctcgccgctgggctactagccccggccgcggcagcgtcgggccgcccgccatgactgaggagagaagtgagagagaggaggaagagaggggtgatgatgtggcatctgacatgtggggcccacactgattcaatcgtcacggtggataaaaccggattcaaaaccaccgagagacttaaaagtaaatggttttgtaagttaagggatgtcatatatctgtttttgcggtcgagggacgattttgtaacttgataacaagttgatggatcttgggtgtactttttccaactgctgctgcagcgttctcagctatttctcgcttacctgttagtggaccgattctattacagtggaccgaaagcgaggctaggttctctccgctctctcggcaccattcgatagaaaatgaacggcgcgcgcgcgttggacgtccctttgacgtagatcgatctggttccgttcccaacccctccaaaagatacttattactcctctggtttgagaatacaagacgttttaacttttatcaaagttaaactgttttaagtttaactaagtttatagataaatatagtaatatttataatactaaattagtttcatcaaatcaataattgaatacattttcataataaatttattttgggttgaaaaagttactattttttttacaaacttggtcaaacttaaagcagtttaactttgaccaaagtcaaaatgtcttgtaacctgaaacggatggaattgatgattagacctaaattattctcctgtcgttatgtgcttgataagaaacttggatccatatcaattctagcgaatataatgctgctattgtttctgttgcactggcaactggcaagaatgatcaattttgtgctgaaatgcgcttggtttgtcacgattttgttgccctcattttgatcttggacattgcttttcatgtttgcggttggaataggaatttgtacaaattcataaatgtgtgcttatgcacaattttggttctaaaacaaagatgaagaatatctggaggtgctctttttctcctgaacataaagataaaaatgaagattaagtgtttgacgcaaaacgaggtggtattaacgtatgattaattcagttttaatcattacaaacttaaaaaatagattaatctgatatttcagagcaacatttatatagaaagttttcgtacaaaacgcaccgtttagcaatttaaaaagcgtgccacaaatatccaaaattttattaacctttttagtggaaacgaacggattaatgctagtgaacatgagcacgtcccttgcacttctctaaaggaaagacctatggtgaaaaaaaaaactgaaggcgcacacggaagcttaattagaaattttgtgatgtctagaaatttatccctcgcctcagcagaattgtagcaaacctatttttggtgattctgaaaagacattcatactagactatgtaacacaaatttttatggttcagtatcaaccaatcattaaaaagaaggaattaaacttttcaaaccaaatcttgaatcttcattctaagggcctctttagatcccctagcaaaagttttcaacctgccacatcgaatgtttggacacatgcatggagtattaaatataaacgaaaaaataactaattacacagattgcgtgtaaattgcgagatgaatcttttaagcctaattgctccatgatttgacaatgtggtgctacagtaaacatttgctaatgacagattaattaggcttaataaattcgtctcgcggtttacaggcgtaatctataatttgttttgttattagtctacgtttaatacttcaaatgtgtccgtatatccgatgtgacacgccaaaacttttcattcacccctatatctatacacagcctaagcttctactccctccatccaaaaaaaagacaaaccctagtttccgtgccaaacgtttgactgtccgtcttatttgaaaaaattataaaaaaaattaaaaagacaagtcacgcataaaatattaatcatgttttatcatctaacagcaatgaaaatacgaattataaaaaaaatcatataagacggacagtcaaagttggacacagaaacccatggtttgccttttttttggaacagagggagtagtcctctattcaaatataagcaataaaaaaatcaggccttaaaatccaattgcaacgtcagatcaatcgtttctcgaatgaaaatcgtgttcccaaattcacactccaaatttgccattcaaatccctccacctctacaaaaatttctactgttcattcgaaaacacaaacaattgtttattggatcatcccaactccatacatatatactatatgatgcccgcggatcatatatcctaactccatacatatatactagatgatcctcgtgcttttctgcgggatatatgttagatattggagaaatgatgaaatgatttagtttgaaatattatgaaaatgatttgtcaataatgaattagcatgtgtatgtttagttttataataaaatagattgtagatataattactatatgcttgcatattgagttttgtgtgcttaatgggttaatgtagcatgcttgcatgtaggttttaggagtacgaataaatacaatgcttgcatgttatgttttaggtgcttaattagtagcttaataaaaagaagggatatgaaaaatcgacaatctttccttcattttattggtctgaatggcccaaaattaagtgcagccaaagcaatcccagcgaacacggccacaccaagggaccccaagatcatctccatggagctcaccgtggacacctcctccctcttgacatgcgccgacgcggcggccatcaccttcctcaccatctcctctgcggtcgccgcgtcggccgccgcgagccgccggaacccctcgctgttcttgacggcctcgatgccgcgcgcgccggtggcggcgacgtcccggacgacggccgccttgagcagccggaggccgagcctgtcggccagcgcgtacgtgtcggccgccgtggccggcgtgacgcaccgggccagcctgtcctggcacgcctggctcagcgcgtccatcctgtacaggtccgccgcggcgagcaggtgctgcgccatgtgcacgccggtggcgtccctctcgctgttcccgggcagctccggcagggtatcgtcgtaggcgaagcgcagcatggcggcgaacgcgtcgggctccatgtcatcgatggtgatggtggtggtggcatcgtcggtgtcctgtgtctcccccatggcgcgcgccgccggcccgtggagctccgccagcaacacgggcgaacgcgcggcgagcacgcagcggtgcgcgcggaaccgctccccgcggacgacgaacgtgacgtcggcgcccgtgccgtcctccagcatgcggcggaggccgcgccgcagctcgtcgtcgagcggccgcgggccccgccgcagcacctcgtcggcgtcggcggcgaggagcacggcgcactcgaccacgaggcggtcgccgcggagcaacacccccgacgcggcgaggtcgtgctgcaggatgaactccgggaagccgaagcagccgcggcctacggtggctggacccgggccgaacacatggtacccgcagcgcgtgtacgagccgtcgtcctcgccgccgccggtcatcccgccgcggcggtagacgagggtgaagtcgacgagcacgcggacctgctccctgtggtcgctggagacgaggcggaggaagacggcggcgtaggggctgccactgtagtagccgccggggaagaagaggatgtcccagaggtggccgccgaggctgaagagaccggagatgacgggcttgccggagctgaggccggagaaggaggagtacggcgtgatggtgaggcgctgcgtcgacgccgtctcccgggtgggcgcccgatcgccggacgacggcgaaggtgcggccatgtcgagttagattggaattcgattttgcttaggtttgtcgtaataattagtaggaaaattttttgaagaggaagccgtgcttcattgatctttttgatcatggcgaattattacagtgtcctctagatatactccaagattatatcaggaaacataatatcactgtattttttttcattactactccaaattatacccgtacgttgcaacgggtaaactaaaatacccgtgcgttacaacgggtaaactaaaattataccaaatataaaaatattagatgattgagtcccactccggtgctttctactcggagtagaaagtaatttgggccattggtcgtatttaattgtagggctgagatctagttctactcccaccagtattagtattagtggaagtagaaatatggaagggtgttttcgtcaagggaaaaaaatcgcgtaggggtattatcgtatttttcagtctcttacccaccctatccctatccgattcctctcgcatcgtcgccatttcaccacttcccgtcgccattcccccccatccccgcttccgccgccgtccatctccctcgccgcctccgtcgcctgtcctggcgtctcctccccctccagcgccgtcgccttctctgctccctcgccgcactcgcccttcctcgccgccttctccaccgccagcgcccctctgtcgacgtccgcctcccccgatattggcggcttccctccgtcgaagcccttccttgtcgccctcgccgccttcgcctccgcccgcgtctccgcgccggcttgtgagcccccaccgtcgctgtcctcctcccccgccctcttgtctagcgagtcgcgtgacgtagccgcccctccacccgcctccgccggcgcgcgatgagtcctcttcgccgcgtcgcctccccgcgccaccaccgccacgttctcctccccatggaccgacgcacccttctccactccacctctgtcgccatcgacctagccgcccccttctctgaagtgtgaacatgcccttggcaaccgatttaacccagtgtaagcgatactctattagttaataggagtactactaactgtgtcatattaatcacaattcaccaattctattgtcttgaattgcagttttttttggttaatttacaattttccatctttagtgttcagatactatgcgaggaatcgagaggagacagccgagcttcaggtacattctgaatcctccaatcttaccatacttttcttaccaatattcagttatacggtatcagaaagacaacgaagagaagttggtaaagagtatcatcttctaatgcgagattactcatttactctgttgcttcagccttcattatagtgctcacctaagcagcatcttaatataccaaccactactgttatgattttgcagataaaggttgtttgttcttgaatccattgtattgtatattgattatttgattgaatggttgggagcagggtcagtttgcaagacggtggcatgcgcgaaggggatccgtatgccggcgaaggggttatcggtgttcaggtgcgacattgtagcatacgcacgtcggtgacgtcgatagctgactgcgctgagtcatcccgaagcgtaaggtttcatataccgctccttctcaaatggattgaaatatgaattatgaatattatctcaaaaaggcatcaatgtttgggatccatcaaatacccaagtagtatctaaattatttaataagggtaagagagcatagtaaggtaattgtggtaaatgtttgacagataatccatttatgtcgtggttggtagcagtggacgatctttaatgttgttcagttcggagttgatcaaaattccggctaagtcctgtcgaaatgttttcacttccttctgcataatgcaaagggagtgcattttaaatggttttttgtattgggaagcactggtgcaaaatatgaatagaggttgttgtagttgcctgtagttgaatttctgggagataagatccgctccaatgctccatgaacttaagggtgtacaggccacacgagaagctacaagaatttagtcgttaggctaacatgtttgcgtaattgaataatgtgaatatcatgtggaagagtttgagtcacccacccgtctccttgctttggcaagttttggactttgttgtactcccattcggtaatattgaaatcaggccaatcgtgttttaactgtgggtgctgattctctgtcccgtgtaatcccctctcaatagctagcagctggaaagttttgtgcaacgttggtacggttaaaacatagcaaaaccaatttgaattatacaagtggaagtgtattgcttaccacacgccttagatcaggtcgatctttactgattggctttgcgagcgaatctagtatttgcacctcacatcgcttggcgttaagaacggctaggtaccagtgtgtatctttaatattaattgggaggaaaatctgcatatgttcattgttcaacactaagatagagtcataaattgaattagccattacatagatagagtcataaattgaattagccattacatagatagcttgaataagtattcccatgtcaaatgctagatagtcgcgtgccatatctctaatccatcgtttatctcgaggtttgcttgcttcgacatgcgctccctctacatttagtagacctgttttcatggccatctctaggaaggccttgccatctcccctgattcctttctctttatagcggaggcataggatgtatgcatccatgacctgaatttgaggttagttcagttatataacaaatatagttataaaagaatagtaggcttgttaaataggcgaacttacatcatcattcaagaattctggttgtgttagtactttcattcttatccgtttaacctccacttcttcaatatgcaccatcactttgttatcctccgtgttattaatgtaggtaatgaacgggtcttcttttttagtcaactctacgaaggttggacaaattagtaatagatctatagaaatgttaaatggttagtcattaccttctgaattttttaacattgtttggccattcgtttttttttcttcttttgacctcgtaaggcgttctttggtggtccgttgtctatgtttttttgcgtaagatattccttctctatgtacactagaaaagggtaagtcaaatcagtaacacacaaacatagaatataagtaaaaaattatggatgatgtagagagttcatacattcggatatttcattcagtgtttggttgtcttgtttcctcttcttttcaccccgtaattcgcctgtgtctggcatgtaagcttctttattcgtttgcgcttgaaaaggagtaaagttagtaccattgacatgagcatatgcaactatgaaatagcatagtacctattgttttctttgtctgtgcttgggttttgattatgtccttctttttacctcttgtttcgtagatgaagtcagtccgattagttggtttgtatgttcttcctgtaggacctgtaagcatcttcctgctttgattgctctagttactattgtcctgttaggtaataaagtgcacgttagtattatgataagttgtagtaacgttagtgagagaaataaaattcagtttaccttcgtttcacaagtcatgtttacattttgatttatataggactcttcgttatgatttgatacatgctccctgggatcaatttgttcttgttcaacatcctgcaatagcgtcaaccttttttttagcggtgttacgtaagtaataatgattaacagtctagcatatgatctttacctcaaacacatgcgtactatcttttcgctctgggcattttgaatcattttccatgcaatctagtatcaatgatcgcatacgtggccaaaaatcctttgtgaaatcgtgaaattatcttgtaaagtttggatgctttcttgtaacctttcttgtaaagagatgtcggctgattgttcagtggatgttatagagtgtacctgaatagcacaagtgagaaaaggatgtcaa

SEQ ID NO: 30205 - DNA, 2946 bp, Oryza sativa
ttctctctaaattttaatatgcctttcagtaactgatttagtgttagactagaccagtttagttccctcatgttgtcaacgtcgtcgacgagattgagatattctgagcgcacatatctttgagttgtaggacatatgaaggatccaattgagaaaagaataaatctttgaatgaagtggtcatcgtagctcaaggagttgattattgcttcccgtaatgcttgtaaagtaattgttgtttggccttccttttttacaggttgaacaattctggtttattgatttttggtgcctcaaatatgtcatctctttttgatggcagtccaagcaaacaatcaacatcatcgagtgtcatcgttacgaaagtaccattaatattgaatgctttcttctccttgtcatagcttcttgcaatctcattgcacaagtttcggtcaatatgtatgttgtcaatctttagcaagttgccaagacctgaaccctcgatagcttccttttgacgtagacttagatggagtattacctcgtacatggcatgtggagagcaaactagagttccctaattaacagaaaagataataagagtttagtccatgtgaaaatttatgcaagtgctcatatatatgattgcacattaccaaacctagagatcaattaatcctgctagaaatcaattagaaatcaaaggaaataattaatcctgctctggcatgttactcgtctgacatgttgaagtgatgtcctccatcactgttctggcagtctatatggccctctctataatttgttcaatgttcattcttatgtgcaggattcagtgaggttgaggagtttgaggggagcaacatgagtgaggtcttcgagggcaacatagtactgtcaggtttgtgccaccttcacccatgaccacatccctcactttggtttgaaagtttgaaagtgtgaaattctgaacatatagtggctaatatagatcggtcgtcgaggcgtggtaattatattgaaatttccaatcaattctaacatatattcagtataattcataagatctcaattgggttgaagattcaacaaatataattaagattgtctggatggaatatcatgcatgattgtgtttctaaggtagatggtcacagtgtgtctgtgtgtggcgtagccctgctattttacttctttaatcatgaggccaacatttccggattcaacataaatatgcactgcatgtttcctatttcattgctcatgaggccagcaccatatttcagacagtaaaaaagataggctcagaaagcagtataaccgtttctaagagtttgaattgttgtagtattaacaaaattaacaaacagtaggtgctaatgaagtgctgtagtgccattgagtttacatcatctccgcacattgttggctgaaatttaaacttgtaatcttggaagaacaggcatgcaacccattataaccagtatctgaaagttggtttcttatattacagagtaaatcattttctttgttgtaggagattacatatcatggaacctgtgctttcagacatctgtgtataccctgacagtgaccaggattagatcttcatttttagacagtctaaaactaaactaggtcaccaacggaaacacatatgaaaacattgagcctctctgaatatgctacatctaagttttacctctttagatttgtggagaacaccatgagtttggataaaaatataagaaatcctgatttccttaattggttgtagataaattattttatacttaagtcagcgatgacccctatttgttaatgccagatcttcgacacgaatcttacactttgtttttgttatgcaatctatataaattctcatcataatatggctatgataattacttgtatgataattgcttcgttatgattctcagaaatcctaactaattctcactaatcaataatatatatcccaatacatcagcacacatgaatctttgctactgcagggcgtcgccagtgccattgtcagcttcccgccacaaacgcctctggatctcaaatccaccacgtcgaagcaggggttggtcaggccggcagaccatctacggctgcgcctaacactccccgcaggtacattgcttcatcccattgctcccataggcttttagttttttttttttttggcaaaaagtcgagacaaaaagttatatgccctaatggcatgtggatgtcatgtaattactaaatttttagcatgctgaatatataacatggatatgttgctttggattaatatcactgtcttctcaaaaattaggtgccattctgttcgttttttgtatggagtatgacaagtatataaaatagttgtatggagtaggacaggtatataaattaggtgccattctctttttttttatggagttgtacaagtatattttttgggatatcttgccgtgctgtgtactctgtgtggctgctacatcctctatacaattgctccagagactagccagagcttaaaagaggcacacagtaaaatcaggggagagactatattcgttaataatctaatcatatgtgctgtaattatcgttgcgccttagacctattgcaactttggcttgaggagtctaagatttcgacaactgatgtatacaagagctgaaagtgaatgttgtatgtaaaaagacgtacccgttttttcttatgttggcttgtgcccgtcgtcgctgcatgaaattgttttcgtttgctccccgtcggcggctcgtaatttggcctcatcttgttatttatttcgtaatttttgtccagaacatgtgaacaaaccgagaactgtctcctatatatatatatatatatatatatatatatatatatatatatatatatatatatatatatatatatatatatatatatgtatgtatgtatatatgtatgtatatatat

SEQ ID NO: 30206 - DNA, 14847 bp, Oryza sativa
aaaataatccgtttcgctataatatacgagcgatcgaccgaaaatttatgaatttcaaaaacaggcccggtccagacggtcggcaacatgattttttattcgtccaaaataatccgttccgctgtaatatatgagcgatcgaccagaaatttatgattttcaaaaacaggcccggtccggacggtcggcgacatgattttttattcgtccaaaataatccataatccgttacgctgtaatatacaagcgatcaactgaaaatttatgattttcaaaaacaggcccgatccggacggtcggtgacatgatttcttattcgtccaaaataatccgttccgctgtaatataagagcgatcggccagaaatccattctttttaaaaaaccgacctggtcggcgacttaattttttatttgtccaaaataatctgttccgctataatatacgagcgatcggccggaaatttatgatttttaaaaaatgacctggtcggcaacttaattttgtatttgtccaaaataatccgttcccctgtaatatacgagcgatcgactggaaatttatgattttcaaaaaccggcccggtgggcaacatgatcgaccggaaattgttttcttacaaatcgactcggcccggaccaactcgagtacgtacgtgaaaaccatgttttcggatatcggtactgttagttttaaaacctcgtgtgttaaaaacggaataataggagagcgttaatataacgcacgaagttcgataatttccgacaagattgtaatcccgttgttgtaggaattcatatttatttgttttctaaaaaatcgaccggaataattgttttataaaaaatcgaccgtcccggacgtaataattattttgttcgaaataatccgttccgctgtattctatcgcacgcccaaccgaaaataattgttttctaaaagatctaccatccattggactagcctgtaacctagtaacttaacttgttgtcatcagaagttcagaatattagaaaggattaaactaatccaaaagcatgcacaggggaaacacttaatatgcacatcttgagaaaagattaaactaatccaaaacaaaaacaatgccaataatacaaaagatacaaagtttgtgagccacaattacctaattggttatttgtgtgcaatgtctcacggaatggccttcgtctcttagatggagctcattttgccctaatctcttcaggatcaagtactctcttctctaatggctggttactagatgaaaagtgagttggcataggaccaaaatctccagccacgatgttctcatcggatgacgatcctttatccaaaatcccctttaagaaatccatcgccttttctgtctgctagagttcctagcggcctcgaagaaagcatcactacccagatttcggaggctacggtaacgaaccatgtgttcagaccacacattaggatcggcattcctgtctgacctaaatgtcgcctttgctcccattgtccacctatccacgacacaacaacgagagatggtgtcaaaaccaaggaacttgagtacaacaaaaatatgtgagcaagggatgtcttcgcactccatcttccgacaatgacattccacaccttccaaagcctggcctttaaaagtaaccctcacttcatcccacacctcattatcgtccttcaaaccaacagcatacaatgacgaaccatcttgattagtcccactgatgacttcaagtcctgcaattagccgtatctgtgcacggattgtcttgaacacgactgcagtgtatatacgggcaacgtctttctccaatgggtcggcgtctattctacaaaaagggaccgaattggtagacttagcgtccaactgagcctccttcttatgcaggcgttgtatgcacaacttaacatgtttgactaagcacattagtgacatgtttctctttagaagggtgtgaagctttgagttcagtgactcactacattggttgctgtgcatacccaacaagtatttccaatatgtataggcagctgcccacttctcccttagtcggtacatcagagcgatccattgtccatttcccgtgcctgcattctccttaaaatcagcccaacgtctctcgaacttgtcctcatccatattctcataaattaattttcttagctcgtcgagttttggcttacgaaggtgacgactcatattctcctctatatgccaagtacacaatctatggtaagcacccggcattaccttactgatagccttcgccattgctaggtcgccatcggtaatcaatgattttggatgcacttgacgcattgcctccaaaaaagtctcaaggagccaacagtaagagttgacatactcatttgatagaattccgcacccaaaaattgttgtacttatgtggtagttaactcctatgaaaggaatgaaaggaagattgtacttgttcacatggtaagtgctatcgaaaataacaacaccaccaaaagcagcatagtctaaacgtgattcagaatctgcccaaaacacattcctaagacgcccgatatttcaacacatcttcagcatcatgacccttgatattctttatctcgtaccgtgtaaagaaattataaaggtccttcatcacaaaaccaacctcatctaactcatcatggttattctccataacctccatgatttgaaagggcctaaggccactcatgcgaagctcgaccgcttgggctttcttaaaatcactcatcacatgatgaactcctaaaaaagcaacatggtcaggatttgcaagttcgtgcgtatgttggttatcaaactccttaacaaaccacacccccttctcctcgttccgctcaatctcaagcttagctaagcaaccgcagcgggtcagtgcccgtggctcccttttccgctctgtcctctcaaagtgctttaactccctgtacccttcacatgagcatacgaattgcctccatataatctcaccgtccttccgtttcaagttgtttttcctcacactgaaacccttcccctttgcatagtctaaatagaatttgtaacattcctccttgcttgaaaaaaccacagtacccatcattttatactcttcctgatcctctagaatcacatagctcgaagtctcagacctcacctacggaaaagtaaaaaaaacaaacagatcaagcacccaaatatataagcttacgtcctttatacctcataagtatataaaaaaaagaacaaccatcaactgcataaatacatgccattctaaactattgagcaattactacagttcccccacaatggctgcaaattttgtacgtactataaattgttatactaaaatacattttctgaaaatggttgttcagagataatttttctgttttcatttcagctgtacagtcaaattttgtgttgcacatcatccagtagtttcagtaatctgtttcttttttcagcacctctggagaatgtatgcatttgtgtatttcacaatgacttcggttacatgctcctctctgataattctaccattgttgaaacccttataaaaggaagattcgaaacggagccaggtcattgcagcttattaagacctatttgtagtcagatcgttgccacaattcctgaatctgttttgcaggtcatgtggattcctatggacataatcaagttagctgacaaactagcaaaagaagccaagtccaatgttaatgcagcccctgtctatttttgtcaaaatatatcgcatttgtcttatcctaccagaagatgtcatgctaaatcatatctaaatatcaatggtcagttcgccagggcagcaagccatacatgcacagcaaaatcaatttaatattgttcatatttccttcaaaaaaatatttctttcaaaagttattgttcatatttctttcaaaaaaatattgttcgtcagtttcatcgttcatacttacaactcaacatacaaaatcaatttaataaatctcctattcgatttacaagctagtttacacagacattaacaagcaagtatatgcattaatagaggagcaattcagacaagttcaccactgaggatatgaaggggaacagaaagccaggttgggggggggggggtggggatgggaggagttgatacctgatgatttcgccgtgcccagccgctggccgcgccaccgcctgcgtcggacagatgcgacgcgtggcgccaccggccgcgacgccgcctgcctggaggaatagccaccgggcgcgtagccgcctgccggtgcctgcctccgaccaaatgcgaaccgaagggggagggtgaagagggcggggagatgtacggcgacggagggggcgaagacggcggcaacagaggaagcgaagacgaaggtgacggatggagcgaagacggcggcgagggcgggggaggcggacggcgacggaggggggcggagaaggcgacgcgggcggaggagacagacggcgattgaggaggcggagaaggcggcgacggcgagcgatacggacagcaacggaggcgggcaaggcggcgaggccgggggaggaatggcgcgacggaatccacacctgcgatgcgaaccgatgcgaacagaagaaaacatcccataccaaatttacccctaaaggatattagaagattacttacctaccctttaaaataaagggtccagattaattctactcggagtagaatacttcaagtatattgtaccggagcattcccctagatgattagggtttagttttacatgatatgagcattttaagaaaatctattactaatgaaataaaaaaagaaaatccattactaatgaaataaaaaaagttcaacttaagagacctcaagtgaacttatttcgtgtggagcgtacacgcggcccatgaggcggcctatagtgtgggcggcctgaaaacatattcggggataactttagggacaaaaagtgaacttattctatgaggagattacaagcagcccaatagtgtgggcggcctgggaacggcacccggcccgacgcaggagaagctggagtcgtgcgatctgatggacggtcctaattcattgcgacctatatataagttcaaaaggtccaaaccctaaccctaaatcatttccccttcctctctctctcagtggtgccgcctctcctcctccagcgctcctcctcgccctccccggcggcgccgctctctctctacctcccccaccggcggcgccgctctatctctccctcttcttcctgaccgtccttccccccttctcttgcctccctcgcgcgacggattcggcaacggcggtgtcggcggcgaccgtgggtggatctggccgcggtggtggcggccaaggatgggtccggcggcggaggctccctccgacccctctcgcctccctcccatagcagatttaacagcggtggtggcctcggcggctaccgcatgtgcatctggcggtggttcggcacggcggcggacccagcggctgctgctcctcctctcaggtgtggcgacgtggccgggagtggtgatgggctcaggagcggcggcgggctcgggagccagtcacggcggaagacgactacggcgacgacggcggtgaccacaaggaaggcggctgcgggaggcggctaggcttagggtttggattttacttttgaattggacatgactacgacgagacggtagctggattgtcgtaaccagcttacctcactcgttgctattagtacacctaatagtgcctttctttatttcttcttatagaattttcttttgatttactcattcgaattacgatctgattgcaccgctgtgttcataacaattaaatctttaaaacaagatctcacataattatattttaataaaaaatgataaattaattttataatatatctaaattacttttagatttcaataaattacttcttagacatataaagtaaattcaataaatcataaaaataatttaagaataacttaaaagaaaaagaaagtaacttatcacaacaataagagtaaatctattgtggggtaaagaaatatatcaatctagaaattatatttaataaacatattgtagaactaaccaataaagtaaagtgttcattgaatgtctaaaaagtaatttaatcaaatatagaagtaattattgcatataataaaagcaatttacatatataataaaagtaatttacaacataaatattttttccatcataatataatcatgtaagatcttgttataaagatttaattgcaacaaacaccatggtgtaatcggattataaatcaaataaatagtttaagagaaaattctataagaagaaaaaaagatatatactattgggtgtactattagcaacctagagtactcttatgtatgggtgtctctcgttaaggctaaaccggagtgttctcggtttagattttaccttttgaattgggagttgattttgtggggattcttgattttgatttgggattgcaattgagtgattttgtgattcatgtattttgggaattggtggcaaaggggtggggagcaatcagctgatctactcagggtttttttttaaaataaaagacggactcggactcaaacgacgactacggacaaaacgggtgatcgaaagccctacgtattttttaagtaggtatatagatatggaagaaccaccaacacatactacattcataccgttgacacctgcgttcgttccctggagttgggaacgttcatctcaagcacgaaaatcagagcagttcattaacatgtgattaattaatactaattaattaagtattagtaaaataaacttgaaaatggatcaatataattttttaaagcaactttcctatagaaattttatgcaaaaaaacatagtttgaaaagcgcgcgcgcagaaaacgagggaggagagttgtaactctcaccgccgaactctctaacatatgctgagatgaaagctaacggcaatttcttgatctaactttaaaaaattccttatgtgtcccttaaaactcatctaatccctttcatatctttcatatttgcttggtccttttgtaccactgaatttttactttgatcactaatatgcctcagctgttacggccctcccatcgcctcccggccccatactcccgtcgtcgccatcgatccctcactctcatcgcccccacgagcagtgatgtcaatttcggttccctatcggcaagcaaatatgttagccgaattttccagggctttttttttttccaaattttacgaatttggtgaaggtttattaaaatttccgtgcaaaacgaaattgacaacctaaatacttgatacctagtatcaggtctggtatctaaggatatcagaccgatctagataccaagtacctgatacctaggtatccgatacccaataccaagtatcaagtatcaaggtaccatgtaatcgatacctgaggtatcaggtatcaggcctagtacatatggaactaaactgaatactttggcttactacttgatacctagtatcagggacttgatacccaggcatcaagtaccatatgggtgacatgtatgatttgtgggtatcatgtcttctacacatctgttcaagctattaactctatatactagaagagtgtcagagcaggtctctagtgtgatctttggctgcataaaaatgtttaccaaagaaaagctagtagtactttagtacataagtctagtatatagtagtactattagtacaacagcatacatacagaaatccggaggcaactctagcctctgaccaacttagcaatgctaaggccccctttgattcaaaagaaattcataggaattttagaggatttcattcctatatgaatttttcccacaaagctctttgaatcaaaggaatgaatcctatggaatcctataaaattcctatggaatgcctcttaccatacaagttttgaaggaattttaacaagaggtagaacctcatggaagaaatcctttgagtctttatctcttctcaaattcctgtgtttttcctgtagtccaatcaaacggtcatttctatgtttttcctgtgttttgcaatcctctgttttacacttacattcctgtcagaattctatgtttttcctattcctccatttttcattcctgtgattcaaaggggccctaagtttttctcacgtcacgcctggcccgccttcgcatgctctcagaacatatctaaacatgaaaaagaacggttcactcataacttatcccattgtttagacagtatcccgtttcctagtttttctcctttagcgtttccttcgataaccgggggatgctttacatccgatattacggttgagggccccttttattcaaaggaaattcataggaattttagaggatttcattcctataagattttttcctatatagccctttgaatcaaaggaatggatcctatagaatcctatgaaattcctatggattgtcttttcccatgcaagttttggaggaaatttaacatgaggtagaatctcatggaaagaatcctttgagtctttatctctcctcaaattcctgtgtttttcttgcggcccaatcaaatagtcattcctatgtttttcctgtgttttgcaatcctctgttttacacttgcattcctgtcagaatcctatgtttttcctattcctccattttttcatttctgtgattcaacggggccctgaaagatgtgaatcgatatcgggctagagtcgagggtgacgaaacacacttgttccgctccacttcaccaaacaacccaaaatgcaggcataaggaaaaagtacatcagaggtccctcattttgtcaccgaattacaaaatcgtccctgaaccacaaaaccggatacaacgcatcccccaactcacaaaaccagtgcaaactaggtccctcggcggtattgtctccggttttggctgacgtggcgcctacgttgctcctttcactaggtcttagttccatgtggcaatgacgtggcgcttatgtggcaatctgatccaaaaataaattaaaaaaactggggcccacatgtcagttgcatgcggcgtccaggagggagcgcgggacttgcggaacggctggcgggggcagtggggcacccgctcacgccgccggtcttcacgccgctcctcctctggctcctaggcagaggggcgctttttcttctcgcgcggcttgggagttgggggttagtggacgaggccggcgagtcggggaagctgtccatgtccatgaggcggagagggagcagccgtcgacacaacaacgagggtggggagcggcgcagcgaagcgggacgcgaggcgagagagatggtggtggagcagccgatgattccaagagaaacgccgttgcaggagccgttgatctttgccgctgccgtcgacccctgcggcggcgacggcggcacggtggaccacctcttcctgcatgtgctcagcggtgatgtcccacgagagcgcatccctctccatcccggtaggccgtcacgctctctgccctctcccgccacttccgcgtcctctcgtgacccgtcccagttcggccgcattgactctggcgaccttccccgacctgctcccgtcgctcccggcgaggccgtccttcatccgccgcctcgccttcgcattccagcaccgcgggtgtcctcctccgccttctcccgactcctcgacgccaccgccgaccgcggcctttccgagcttgccgtctgcctgcaccgcaacgggttccttcccaagaacctcctctccatccgctccctcaccgtggtctcactcaactcatgcgggttgcctcgccggttatggaggaacggcaggtgggccactcaagctgtgcgggctgccagtggcaacccttcaaatcactcaaactcacacttgatcggaggtggaagatgatgaacagtgaaaacaccagctgtttgatgcaggaatttttggtgccgcgtagaacgttgcagcgtttttttggggtttacttcacttctataaagcaaattacatgcaaactaaaatcaactgaaaaactgggagtgccatagtggcctccgtcatgtgtgccaatactccatgagacgtgctcctggccaaaacacacgacgctcacgctgcaacatgcaaacgcgctcatgcaacatgcaaaaacgaaaatataatcttcggctgcacatgattaaagaacgctaacacgggcaatgccggagcagacgctggagatggacatcggcgaggaggccgcgccgattgacaacgaggaggctacgctgcaacatcactggggcggtggtgcttggtgagtaccttcggcggcggcggccacgggcgccgaatggatcacaccgccatgtcgctggattgggtaagaaaagaagaagaccgagagattggggaggagacgtgggtcccggccgtgctgctcggccacgtgcgactgtcgagggcggcggggaggccggcggcgagagacggagagggaggaggcggggctgacgagggggacgggcaggccgaggagctggcctgctccgcccaacgccgtgtagcaggagagagaagaaatgtgaagagaggaagggggagaagagggagaagaaaacgagtatgacatgtgggccccactgtttttaatttattttttaatcggactgccacgtaagccccacgtcattgccacatgtaacaaaaacacctagtcaaagaagccacatagacgccacgtcagccaaaactaggaacaatactgctgagggacctaatttgcactgtttttataagttaggggatgcgttgtatccggttttgcagttcaaggatgattttgtaactcggtgacaagatgagggacctctggtgtactttttcccaggcataaatgttctgcattcgcgtttgtgggccgaataagtggaaacagtagtacgtgggttaattttgggtcgaacttcaacgctttgcgggctgaacgcacatgggctcgatcgtcctttctggcccagttggggagtgcgacccacctttccctggcctcctcgcctcgccacttcgcccgccgcctgcgcctgcgccgccggcgacctccatcccgtccccgcgcgagcagggtccccggcgacctgctgcttcctccgccggtgagctccggtacctaggcacacaatcctctccagtgtaacaggagatggtggagcatgccactcttgaatcctctaagccgcgcgccttccacccacatccgcagcttagctcgtgtcctactctcatgcctccccaccggcggcgaccgcctccggcgtttgaacccggccatccatgcccgtgccaccgtcgcaggaagactcgacgacctcttcctcaccaacctgctcctgcgtggctactccaatcttggccgcctccgtgacgcccgccacctgttcgatcgaatgccccaccggaaccttgtctcctggggctcggtcatctccatgtacacacagcacggccgcgacgattgtgcaatttccctcttcgtggccttccagaaggcctcttgtgaggtgcccaatgagttcttgcttgccagtgtcctacgtgcgtgtacacaatctaaggctgtttcgcttggcgagcaagtgcatgggattgccgtcaagttggacctggatgctaatgtttatgttgggactgcgcttatcaacttatatgcaaagcttggctgcatggatgaggcaatgttggtgtttcatgcactccctgtaagaaccccagttacttggaacacagttatcacaggatacgctcagattgggtgtgggggagtagccctagagttgtttgacaggatggggattgagggtgtccgtcctgataggtttgtactagcaagtgctgtcagtgcttgctctgcacttggctttctagagggtggtaggcaaatacatggttacgcgtatcgtagtgccacagagacagatacatcagtgatcaatgtgttgattgatctatattgcaagtgctccagactgtcagcagctcggaaactgtttgattgcatggagtaccgtaatcttgtgtcttggacaaccatgatttctggttatatgcagaactcattcaatgctgaagcgataaccatgttctggaatatgactcaggctggctggcagccagatggttttgcttgtacaagtatcttgaactcatgtggctctttggcagcaatatggcaaggaaggcagatacatgcgcatgtcataaaggctgatctggaggctgatgagtatgtcaagaatgctctcatcgacatgtatgctaaatgtgagcatctaactgaagcaagagcagtatttgatgccttggctgaagatgatgcaatttcatacaatgctatgattgaaggatactcaaaaaatcgtgatcttgcagaagcagtgaacatattccaaagaatgagatttttctcactaagaccaagtctattgacctttgtttcactccttggggtgtcatcatctcagttagccattgaattgagcaagcagattcatggccttattataaaatcaggaacttcattggacctttatgctgcgagtgctctaattgatgtgtactcaaagtgttcccttgtgaatgatgccaagactgtattcaatatgttgcactacaaggacatggtcatctggaattcaatgatttttggccatgcacagaatgagcaaggggaagaggccataaaactcttcaaccagcttcttttatcgggtatggcacctaatgagttcacgtttgtcgcactagtaactgtggcaagtacactagcaagcatgttccacggccagcagtttcatgcttggatcatcaaagcaggtgttgacaatgatccgcatgtttcaaatgctcttattgacatgtatgctaagtgtggcttcattaaggaagggaggatgctgtttgaatcaacatgtggggaggatgtcatttgttggaactcaatgattacgacttatgcacagcacggtcatgctgaagaagctcttcaggttttccggctgatgggagaagctgaggtagaacctaactatgtgacctttgtcggtgtgttatcagcatgtgcgcatgcaggttttgtgggtgaaggattaaaccattttaactctatgaaatcaaattatgatattgaaccaggcattgagcattacgcttctgtagtcaatctttttggtcgttctgggaaactgcatgctgccaaggagtttattgaaaggatgccaatcaaaccagctgcagctgtttggagaagtttgctgagcgcttgccatctttttggcaacgctgaaattgggaggtatgccgctgaaatggcactcttggcagatccaacagacagtggcccttatgttttactgtcaaatatttatgcctctaaaggactctgggctgatgtgcacaacttaagacagcagatggatagttctggcacagtgaaggaaacaggatgtagctggattgaagtgacaaaggaagttcacacgttcattgtgagagggagagaacacccagaggcagaactgatatattcagtactggatgagctgacgagtctaattaaaaatttgggttatgttcctgatacttctgaccatactctgttgtgtgagactggttaatctagtaatctacttgttaaggcttctacacagatttcatttgccagagtgtcttttactgactgcaactttgagtgagaacctaaatggcaaatatttttagaccgatctaagactaacagcttaagtgctgtttatgccttttgaccagtggttttgcacataatatcacgcttgctacagacttgttctttgagaatgtttgacagactaactggcagataaccattaaacctgaagaggtttccagtggtggggatagcacggaccaaaaattagaaggatctgcaaggtgtggtatgcctgtaattgttttgctgtaacgccatttcatttattagtagagttcttgcaacgacatctttatcagtttatcttcattctgttatcagtccatttctttttagttaaaattttctcacataattatcatttatacctgaagttttcaacttgtgtcctgacaatgagatacacctgttgggtgcccaacggatatcaacgatggttcttcaggtccactttcatcattgtctgccctttaacttgtctgtgctccacaggatatgacatccagcagaactttaccctggcattgttttattttgtgtgaccactgcccatgggcctaaatgtatttctattcaagggaaaccagttgagaggaatgtttgaatatacctgatgttttgtaaatttccacttatatccactcatcacttcacttttgttcatcagtaagagaacaagaatatgggcatcttttcaacaggtacatgtagaataatttggtggatgctgattcttttatcggtgatttgcggaaaaagtcttattaatcgtagttacatatggtttatcttaggttatagccaacgcactaacaatttaagtcttaactgctttgagctctatctccaaggaatcaatatattgatatgtcaatagtggcatgttgaattgcagctactaagatggaatgccagattgccagaacatatgtttaactggagtacacggtgtaaggtcatatttctcacacctgcgtttcatttgattctaacaaggagactgatttaactgtcctgaattttagctttctgaacttatcatcaatagtagtgtaatact

SEQ ID NO: 30207 - DNA, 1119 bp, Oryza sativa
atgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaata

SEQ ID NO: 30208 - DNA, 10481 bp, Oryza sativa
aaaagcatatcaaaagtcattttggtcttcctaggggctttagaagttgaagctccactcttattctccttccaaatgccaacctccggcttctttggcactatcgtcttaggccttggttcgccaatgaccactccttttcccttagtagattcggcttactccggccgaatcaacaccttcttatcattgaaattaattgtgttcaccagaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatataatttgtttttcttgtaaaagataatcaaagattttgtcacacttggccacatcaaaactatatttaacctcactttgccgatctttgcgaggagtcggcattaggttagagcaaacaaaaggcttgtttttattagtccatgaccattcggcaacatatatatcatgatcaccttcctcctcactatcactagcctcagggtaatcaatcacattaacattaggctttttgtcatatgatctaacaagttttttattatccttaacccggctttcttgagccagagccctttgcataagttgactaacatcaagaaattgttggtgtcacgcccggaatttctatccaaaattccaaacgcttacatgtgtgtgaaccctcgtccaggaatcagccgaggcacataataacaaattgataatagagtacaattattactctaattaataagcgtataaaatgtcattacagaggtagatagttcctctcaaacaataaagatctaagcagcggaaaataagataaacggcgcagacggctccactccacaggcagcttgaccaaagctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttagtaaaacagttaagtaattaaaccatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgaatcttaagttatcccaatagtgagctaatgtttctaagcagggctaagcaattatatctaatatctagttgaaccaatataaataaagctcaactagtcaaattataataacccaaggtatcaaggaataaagtaatcaagaacaaaaagggctataacaaagaataggttaaacccacccaatgacatttgaaaataaatgcaatatttgaatagaaacagtagctttaaacgggatcaacatgctcaaagggttgtttgggatctgtgtgacttgccttgctggccttggaactcttcaaactcttctccggcgaaaacggactctccggaaacgacggaatctaaacagaaaagagcaaaaacaccaaaacaacacataaacaagcttgaacagtacatgtggatatttttaacatgtagatctcaattttagaaaaatttagagacttgaaccaactaaatcggagctaagatgaattagttatgaatttttgaagattaaatcggattaaaacacttatatagattttaattgaattatgacgcaataatgaattatttttgaaaaggaaaaggaggattattgcgtcagcgggctagggttttggtggaccgggcgcacggcggcggttcacgcgaacggacggccgagatcgacttgatccaaaacggacggccgagatcgaacggtccacgaccggctcacgggagagggcgacgatgacgtcgacgatgacgtcaccaccggcggcggcggctcggcggctcagacggctcggacggcgcacgctcgctggcgaacggcggcgcttcggcacgaacggagggcaccaacgggtagagcgcgacgcggcgaactcaccggtgaccaaaagagcagcggaagaccaacggacggcgacggcgacgaggttgaaacggcggcggtcttcggtttgacgacggcgacgatgctccggcggtctccgactgtggcgaagcagcggacgaggacggcgacgacttggcgaccacgacggcggttttcccgagcgacggcgacgtctggaacggcggcggcgcacggctggagcgacggcggcgacggcggctcgaagctacacggcgctagggcgcaacggacgaggggaggcgaaggcgagggtggcggcgggtagaggagacaccggggaagcttataaaggggctaggaggcggcggcgaaggcccacggcggccggcgacgagatggaaagctcgagctcggagagagaaaagccgatccgattcgaactcgaatccaacgatttccaaaccgatttagccgatgtttccaaaggagaaaaggtagaggagatctcggggatcatttcccctcttttgattcggccggagaaggaaaggagcggccggatttggaagggaacggcggcggcggcgcgctagggttcggccgggcgacggcggctcggggaagacgaacccccacctgtcagcgagcgagggcgcgcgcgcgcggcggcggactgggccggactgggccgaggagagagagaagggttttgggcccaaaagaagactttttaaaacctttttcaatttaaattatttcttaaatgtaattccatttattaaaaatacttccttagctcaaataaatcccagaaaaatctaggaattatagaattaagcaaagtatttaatgaaattttatctgggcccattttatattggaatttattaattaaaattagatcttctcttcaagacttttaaaaaataaattctaaaaattccatttaaacaacaatttatatattttgaattttcagggtgtgacagttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaatcacataacctaagctcagtttctccagtatagaaataatcatgaaatttttcttctaattgagcccaagtatgaatagaatttgccggtaaagaagtaaaccatgtaaaagcattaccggacaaagataaagtaaacaagcgcaatttaaaaggatcactattagcctcaccacattgcgccaaaaattaacctacatgctcccatgtggtcttactatcctcaccactaaacttggtgaattcgggaactctataattacggggaaacggcacattatcataataatcaggatacggctttttgtaaaccctagcacgattcctagtttcaattcctaataatctcactaattatatcctccatattattaggcccttgttgatttggcggtggatttggtggcctaataggttgtgtttgtggcgcaatatgattatattggctttgtctagtatcaggaggataccccctagtaacgtcattataagcattaggaacatgtgggggaacttggggattatttgcagtagtagatataggaggatcaaatgttctaagatgatacaaataactagcattagtcattggatctattccctgtatcggaataattgcgtcggtctgaccggcccagggcccggtctgaccggcatccagaggcgtggtcggaccagcctgagtcccggtctgaccgccggggtagtacccgttctgaccggctgtctggccggtcggaccgacggctatgttgcggtctgaccggccgtgtgcgtcgctccattggttctactacccgtttgatctataggaggttggttagcagtggtagaggccttatcctttgacatgtaatcggccataagagggccgaatttaacccttaaaaactcatcaaatttaccctcaaaagttgcatctaacttatctttaaaagcaatcatagatgaatctattgtagatgctacttgttgttggatagattgtgatacctcatcattgcttaccaaatcaggagcgagcttaggacgtggcccgggcttgatgatcacgccttgacgagtcctagtgcttgccctcatcaacgcctcccgtgtgagctcgttgatgtactcctccatagctttgcggtcttctccttcgaagtcatccaatgtgaccggtatcatattgatggctccacctccgtcttggatggcggcttcgtcatgacgaagtcgaaattgagttgacgatgaacggatctcctccccagcggagttgccaaaaatcgtgttggcaacttttttgacaagttgacaagcacgatcgcagcaccttaagccttgcggtgatcctagagtcgccaaccacctcgatctagcaaagagctaaacctagatgggttttgataactaaaccggctagcggagccgatttctaaataactacctgtctcgtgggcaaaacggaaggttttcaggacaaacctacaaagagatgtcgcactctcgcagcgtcggcagacggtttacggcgcaaaccgacaaagatggacaaactaagagaaaactaaaagcaatacgaaaaaacgattcgattgattgattgtagattggttttttacaatgaaccggtcatgtcccttatataggggttggtcttgccctctacaggccctcctccacgtccaacttgaggtagaaaccaaacgaaacccgaaacatgccttcccgagcaaggaaacctcgagacccgacaaaacacaatcggactcggacctgccggtcagactggccacacaccgccggtctgaccggccctcaaccggcggtctgaccgcccaacacacggcggtcagaccggcccactcggaggaaaccggtagacttccaaattttggcaatctttcctattttaatcctaggtgccaaatttgggtttaaacacatgcccccctgcctttttgatgaacaacgtgaatctaaaagcatagaacatgttttggtcttaggacgataatccaattaccggccatagtacctcctaagcgtcttgccaaacgctcgggaagtatttcttcaaatatttcccgttgattgctcgctgaaaatgctccccttgaagtgtctccaaaaaatatgcgttccctcgaacaatgccgcacactcgataaggaccctcccaactaggagaccacttaccgaactccttggaccgagtacccaaaggcaaaattgtcttccaaaccaagtctccaacttgaaacaactttgctttcaccctcttgttgtacgccttggccaccctcttcttctctttctctatctcttccaatgccttcaagcgcttgtcgatgacttcatcaagattatctcccatcaacgtcttgtaatcttcacttgacaaatcattttgcttgatataacgaagagaaccaagatttacctccaccggtaaaatggcttcttgaccataaaccaactcaaaaggagtgactttagtagcaccatgtttagatatcctatgcgcccacaatgcttcagaaagcacctcatgccacctctttgggtgttcctcaatcttctttttcactaacttcaacaatgtcttattactcgactcggcttgtccattagcctgagcgtagtaagtagaagaactcaacaatttaataccataagattcggtaaaactcttcacttccttagacataaaagaagcaccttggtccgtagttattgtttgcggaataccgaatctatgaataatatacttcaaaataaagtcaattacctccgtatgagtcatattcttcaaaggcacggcttcggcccacttggtgaagtggcttcggctcacttggtgaagtaatccgtagcaactagcacgaacctatgcccctttgatgacgaaggataaatttgaccaatgaaatccaaagctcatcatcggaatggccatggtttgattatggggttcaacacggcggcaggcgccaattgaacattgccgaaccgttgacaagcttcacatcctctataatatttgaagcaatcatcaatcatcttcggccaatagaactccgctctcctaagcaatcaattcatcttgtgggccgattgatgagttccacaaattccttcatgtacctctcccatagccactttagattgatcttcatctaagcacttcaacaagacaccatctatatttcggcggtataaatcctcatcaagcaatgtgtatttgaacgcttgccgcagaattttccgatcaaccttaagtgtgggatttttcaaatatcgaatcaaaagaattctccaatctccttctgcttcctgggcacaaatgtccgaattcacagttaattcggccactatattgattgaaacgtgccccccagcgctctgcccagaaccggtcagactggccacacagggccgttcagaccgctcagagtcgccggtcagaccggcggcatgcggccggtcagactgcccctggtcaccggtcagactggccgagcaatgccggtcagaccgcccctggtctccagttttgccaatttcgcacaaagatttaaaatcaagcaccggctcttctaatatcagaaataatcccttcttcacattatagccagatgcttgttgtgccaaattatttgctctagaattatcatgcctagcaatatgtctaatagcaaaattatcaaaattggcaataatatctaaacatgaatcaaggtacctatttagtgatctgtccaagcatttgtagactccggcgacttgttgcaccatcaattccgaatcaccaaaagcctccacgtatttagctccaaccatctccataacttgtaagccgaacaataaagcattgtattcggcttgattatttgtacaataatactccaaacgaaccgatgcttcataacacatgctattaggtgaaaacaaaactacccctatgccttgaccttctttgcaagaagaaccatcaaaataaatcttccaaggtataacttcaactaagccaacttctccctcataagcaatatctatatgatggtccactataaaatcacatacaatttggcctttcatagatttcaatggttcataagccaaatcatatcctctcaaaagctaacctcaaatcggctatgtatccctccataccatccgatttgacaacaatatcatcaatgtagatctctaagataatgcctagcaaatcatggaagatcaaattcattgccctttgatacgttgcaccggcgttcttcaacccaaaagtcatgacaacccactcaaacaaaccaacaaatcccggacacctaaaagccgtcttgtacatatcctcttccgccataaagattttattgtagccggcattaccatctagaaagctaatcaccttatgacccgaggcatcattaatcatcatgtcggctataggcataggatactcatctttgggagtggctttatttaaatctcaaaaatctatgcaaactctaatcttaccactccccttcttctccaccgggactatgctagaaacccactccgcataacgacatggcctaataaaccccaccttcaacaaccgatcaatctcctctttgactcggtcatatagcaaaggattaaaacgacgaggtggttgcttataaggcctaaaacccggtttaattggaagccgatgctcaacaagctcacggctaagacccggcatctcatggtactcccatgcaaagcaatcaacatactctttaagtagctcgataccttaaccttataataggctctcatgtttttgtttacaaaagtcggccttggtttagttccatcacctatatctacttcttcccaaggatcggccgatgtaaacccttttccaaacttctctacttcatcaaaatcttcaatggtttcaccaatatcgttctttgtagaccgatattcttgcaccctcttttgtaaccactctaaattagcctctttactcattatacaaatttatatggcttagccgtgctacactagccggctttacagagataggtacaaatttgccatcggagatactaataaaatcatagctagaaagatccctccccgacaagcattggatattcccatgacgccactcaaaagtagcatcggccattgcaacctcggtcgatgtatccgcttgcacaatttcaacatcattgccgtcccattgaattaaacattgatgcaaggtagaaggcacacaacaattggcatgaatccaacaacgactcaaaataacattgtagttaccttgcacatcgacgatgaagaaagcggttggtagcgtcttgtttcccacggtgagctccgccgaaaagataccctttgcctccgttggttcaccattgaagccattgagaatcatgttggtcttcttcaactcatcatcctcacgccccaatttcttgaataatgagtacggcatcaaattcacggtggcacctccatccactagcatcctagagaccggcttcccatcaacatggcctttgagatagagaggcttcatatgacggtttgattcatcgggcttctcaaaaaccgcatctttaggacctaatgaaagttgagcaacctcggcttcatccatagcacaaaactccataggcaacatacaaaccatgttgatatccatgtcttcttttggagatgattcacttttatcaaccgattgtttctccttctcttctacatcaaccggcttttccttctctatggatttatgcctccataccggtggtggtcgcaactcattgaatcttttatctctttgttcttcagcctttttctctcttatttcttgagcccgaagacgttgcaaccttctcttttgagtagccgtcaaatccttaggcatccatctaggattcggctctgttccaggaggtaaataatgtcccctaataattttgtttgaaaacgatgaagccctcacatcgccctttgcaattctcctgttaaaccggcgctggagcccggttagaccggccgtagaccaccggtcagaccgaccagatgcgccggtcagatcgacacttggcgaacggtcagactggcctgaggcgtcggtcggaccgctgtcgggtcggcggtcagaccggcctgatggcccggtcagaccggccgcatggctgcggtcggaccggccagaaggcttggtcagaccggccgactgcgaggagctggtttcggcttcggattttttgtttgaagatactccaattccatctccagaaggtattggcacatcatgagaccccactttgatggtaattacttctgaagtccttgcctccaccttgatgcgctttccttccctcctttcttcattggcccggttcctgccataaaaccggccattatttggtgaagacaaacgctcatgaattggccttcttgatcctccccacccttggttgaattgcattggaggcatatgattgaacattggcggcgttgccccccatggcatgtaataaggataaggataacccggcggctgcattggataagaccccatgacatgtcttgtggatgatgatatggaggtgaatgcgaccgtcttggtgaa

SEQ ID NO: 30209 - DNA, 505 bp, Oryza sativa
accaccaccaccaccaccaccaccaagaaccggtcgccccggtgcgccattaccccccaaaacgatcaagaaaccacaaaaaaaaccagaccaaaaaagaagaacaaatctcccccctaatctacacctcacgacatgagagagagcttgcttgctagtgagaagattactttgagctggagttgcttaagccgcaccccagctcgcatatggagctagacgaggagatggatcgatcgatcgatcgagcgagcggaggcgttgctgctgctactgtcgccgctgctacacactcgctcactctccggtagtagtggtattaatgtgtttttggctaaaaccccggttgattagggttaaaacctcggtcgatttggtcttatctgcgcgtctcgggggttggaggaggagtatatttaatggagcctatgaacttatgatatgagaggtcgtctcaagctaggtcggggggctattgctaatttgctactgctgctgatgggat

SEQ ID NO: 30210 - DNA, 9087 bp, Oryza sativa
gacctccttggactcttgcacaagcatgtcacgggcaagaatgcgtccgagcaaatcatgaggtgtgagagtcttgtagtccggacgctcacgaatgatggtaaccaaggtagagttccttgaagtgatggctcgaaccatcttcttgaccacaacctcatcggtcatgtccttggagccaagtcccttgatctcattgacgatcttgctcaaccggtcatacatgtcacttcggctctcaccatccaacatcacaaatctctcaaattgccccttgaggatctccaccttggactcacgaacactatccgtgccttcatgcaagttccgaagcgtgtcccaaatcactttggcactctcaatgccatccacacggttgaactcacttccactcaaggcactaagtattgcattggcggcttgagcgttcttgtgctcgttctcatcgtcctccttggtgggatcttcgggattctgcaaaacatagccttttttgactattctccaaatagatgggttaataaacttcaaatgcatcttcatcttatgcttccaagcggcatagtccgtaccattgaaatacggagctttgccgctataggtactcacataaaatgtagatgtagttggatagtcataaggaaacataactcccttatcaccatctttgccttcccccgtttggcccgacatgatctctccaagtggttaagcctaattaggagattaggctctgataccaattgaaagggtcaattaggcctagaggggggtgaataggctaatttaaaactttatgcggaagctaaaactgagttagggtcggaaagtctgatccacagtcagactatccgaaaatatcaaatagtctgatgttggatcagactgtctgatccactaaaggaacactacaagtagatctagtgcacaaacaagagtatggcgcaaacagcgactagatctaaagcggcacaaaagcaaagctaaataataggagaagagatatcaccaacaatgaagttcaccgagttgttcccggagttcaaatccttaaggggattctactctccgttgaggagctcactaagagccgggtctttgctaaccctttcctcaagaggttgcactaagcactcctccttccactaaggggtatctctttccttgtggaggcgagatccggccttcacaaacttctcccggccaaccacacgtagatcggtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccactacacaaagaacaaagagggatttgagagagggagagagagctcaaagatccaaaacactttagcaccaagctcaacccaaagtgaatgtgaatgaatgagttgggtaaccctagaaaagggttaggtggggggtatttatagaagcccctaaaatgtggccgttgggagagaatcttttcatcccacctcggaaagtccgaggtgacatcggatagtccgatgtttttgacccccaagcaggccagagacagagaacgaaattctggaggatttcggacaatccgatcgatcggaaagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcaattcaaaatagagaatgaagttctgagaaatttcagatagtccgacgtatcggatagtccgaccttatatcggatagtccgatattttttagccaacactcagaccgaagacagtgagcaaagttctgtgaaatttcggatagtctgagcatcggatagtctgatcaacatccgatagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcagtcgcctgcctgcctaccgccgcttgtctagctcccgcccctgcaaaccgatgaagggaagagatagattgatgatgacatgtgggccccacatgtcagtgggtcccacaatatatttttttttcttgtgaatgacagatgggtcccacatatattggtttaattcgaatgccacgtgggacgaagaccgggtcaattttgccacgtcagcgccacgtcagcaaaaccactctccaaaaccgccaagggagtcaaattgcaccggttacaatagttgggggagtcgtcctacccggttttccagttgaggggtacgaattagattttacctatatttaagggagtcaaagtggactttttccaaactcgtaggtaccctccccttctctcatctctattacggtacgctgtagcttaaaagcggtgtcgtactccttttaagtccaccgaaattcctgatcgagtgcatttttcgtataaagggtaccgtttctgactgtactatttttaaattttgttttttttctaatttctttctaaattgtattaatatcggcactgagtagtttaaataataaatatggtcaattattagccgatcaagcgtcgtttccgaagagaagccattgattctgaccgttttcacccatgcttccaacctcctcacaccacgtgcagcacacctacacatgtactccctccattcgaaaataaacgaatctagtacatacatctgttcagattcataatatttggatgtgttacatccattgctatgttaatttttattgggatggagggagtataacataggtataacgattttgctatatatttgttgataatatttttttctaaaaacttgataatgtaaatatagcataatcatagtgtaattatattgtaacttgttgtaactacaaattagttttaaaccgttcgatttgctttaaaatttgtgcaatggaggtaggaaaaaatcacaacccacgcatatgtgaggtgattcggtacaattacctccgttttcactgaattttcatgtcgcctaaggatttttaaaagttacgtataagttaaactatagactatagttatatgtaagtcacactgtaattacatcacgattatactataattacatctgtcaaattttttagttaaaatttgacaacaaatgtagagctaatccctatatacatagccaccatatatattcaatgttttattttctaatcacatttatagtttatccctacttgcatgagactggtctattacaatgtaagataatgttatttgtagtatacttatcccctcatcacacttagatgcgttctacagatgggcaaagagctgaaaagtcactcttttttcgcacaaacacatcctaaactactgaacgaggatttttttaagaaaatctacataaaaattggtttaaaaattacagtaatctacttttaaaatttaaaataactataaacatgtccgtgcgttgcaattaggggtggatgtcgagctggctcggctcggtctcgttatcctaacgagctagaaacctagcttggctcggctcgtctgcaagctcgagctagctcgtttagctcgcgagctttggggacaatagagaaattagccggtgacctcagggagaagctcaacctcaccggcgccgtgaccacggggagagcttgccggcgaccacagggatgagcttgctggtgaccacgagaggagctcaacagtggattggacgagctcgacctcgccggcactgcaaccatggggaggagcttgacggtgaaggaaacgagctcgagatcgtcggcgaccacgggaagaagctcgacggtggatgggacgagctcgacctccgccggcacttggaccgtgaggaggaatgctgggggcgagcggcggcgtcgggcgcagcgggcgggcggcgacgtcgagcgctgaggccgtcgggcgctgcaggcgggcggcgacgtcgagcgctggttccgtcgggcgttgcgggcggacggcgacgtcgagactcgagcgctggggagagcggcgcgagcggctggagcatcccacgcgaaacgcgacgcgaacgcgatgtttgtggcggcggagcgatggagtgaggagagaatagatcaaagactcgagagacatcatcagtattagggtttgctctaatctgatgggcctactgggcttgtgggctttgtagggtgcctgctgctgctggttacaaaagctcgttacggctcgcgagcgtctcgttatctcagcgtctcgttatctctaatgagctgaaaggctagctcggctcgttagaaaaataaaatgagccgaaccaagtcaagccgagcttgtcacgagtcgagcaagctaacgagtcatgagcttttcgtccacccctagttgcaataggtaaaggctatttcaatcatattattattagttttttaatgtaaaaaatagtatattggatttttattttgatagtattgatatctaatttgaattttttatggggatgatggccatatcctatacattgttttcttatgatttggcaagaattctaaaggaaataggagtccgactctcgtcccaaattaacatgaaagttttttaaaaagatttcttatatgacttcttacgtattttcaaaaggtgaacaaacttaaaaactgactcaaatacgaacaacgtatcaaaatatcagcgaaaacattttcaacttttataatagtagagattaatactccattaatcatatgctagttttgcatatcttttctttttctcctctcaaacgtatgataggatatggtgtaccctgttctttctacttggttacgtcaatttcttttttgatggatggagtacagctcaataatccgtagttcctccaatttcaccagttcgactatccacgccatatcctcttccagtaaaaaaaaaaaaaacaatcttcttccagtaaagctgggcgcaatgcttttttcttaaaaaaaaaagagaaaaaaaaaagaagtggctgatgcaagtatgcaacccaagtcgcgaaaccgcgtgctactcttgctaaacggtttcagcccggattccgtgggcaccaccaccactcgccggcagatgctgtcacccatggcaaaatcgtgtcgacatatatgacctgggcacccccacttgccgacagatgggccccactccactgcggggcccgcaccctcgcatgcccgcctcacgattggccggcgggtataaaagccggtgaagtgagtggcgtgtgcgctctctctctctctctctcctactgtaggccaccaccaccgcgaccgcacgagtcaacctcacggcagccaagcgtttggttggggggatcggaccggcggcggcggcgatgcagtcgctgcaggacaaggcgtcggagtggaccggcgtgtcgacggggaatgcgttcgccatcgacgatgggaacgtcttcgaggcgctgggcggcaccacgcagccgttcgtcgacctctccaccaacttctacaccaggtctcgcttgctttcgctcgctcgccgccgatctggttcgttcttcttgctcgcgatttcgggggctctgattcttgggggagtcaacagggtttatgaggacgaggaggagtggttccggcagatcttcgcggggtcgaagaaggaggacgcgatccggaaccagtacgagttcttggtgcagcgcatgggcggcccgcagctcttctcccagaggagaggtaactaacttgatttcactctgcttctctctcccactcgaaagctcagctcgtacttttgcacatgtggtggcgatgctcggatgtctcaactctcaagagggactgatggttgggtgcatcagctagtcgttggctgtggaggaaagagttgagatatgaggaaaattatcgttttacttgttgagaaaagttaacccagatttagttacaagctaatagccaagttccgcaacaattccactagttacaagctaatagccaagttccgcaacaattccgcaacatattttcttgggtacagttggtagaatttagctcactatgatttacatttcttgttctccttttactttagtatcattgctttttcatagtacttgccgttgccggaggtgaatctcagattcagtacagtgatttttttttttgagcaagagagcagaccctgtataaagatcttcattgttctgtaatccaattgtataccagcactgatcagtgatcaccagtgaattttcttctgatctcattcttttaccacatccatatgatcagcaattcagcattcaacaacatctagctgggagctcataatggtttagtgagatgttcactcttcaattggctctgctgatttatcaccaatctgccagttgatctatattggcgcaagaattgtgtgatgatgcccaataatatgtgcttgtacttagtgtttcgcgtaacttgcccttgagtaaattttggatgtgttctctgattttcctctgttacgaaccaatagcagctagatcactctgtcactgtgcacatcagcacatgtatcaaatacaaccgcctgaataacttgttgacctaaaatctgcctatttgatttttctttgtaggacatcctgccctgatagcacggcatcgaccattccctgttacccaccaggctgcagagcgatggctgcaccatatgcagcaagctgtggatactactgacagcatagacgctgccacaaaaaccaaaatgatgtattttttcaggtctgtgctacagctgaattcttgcaagcttacacattttgtcctaggatcttaatactgctctcttcctccaggcacactgcatacttccttgttgccggaaatgagatgacaaggcaaggccatggaacttcctgcaagtgcaaacatggagaaagcaaaccagcagaataacgatcgattcatgcctctggccagtaaggcatctggataataaacgattcgagcctttagcagcctatcctggtgttatagaaaaaaaaaaccatggacgatggaattcagaccatctattcattcacaaaaacagttgagctaactgttgtaggcttacagccactctcgaacacggagcaacccaaaattgatagaacctgcctctggaggaagttgcaaacttgcaatagttatatcatactctctatattgaacaacggatgtgttattttgcgtctggctataggctatagcatgtgtctacagacaggggggagagagcaaggtcctctgtttgaagagtttctagcaattgaagagaaactttagctccttcaaacagtacatatcattatttagattcttaataattatggaatctagaaaataaactaggaaccaacatctttagatctcagaagcttaaatttctttagagaccaatcagttacttctccgaaccttaaatttcttcaaataaggtctgagaagggaagccttggctgaagtttctcttatataaccgcactatcgttggtcccaccctcttgtagagttgtaggcttgcacattagtgcctgactgcctgtaatagcacttattatgatataggatgtgaacaacaatcattatcacattcgatgtgaacttggaagcctcgcataacgtaacggagtcggtttgggtgacattgcctagctatgtcacaacatgacattgggtaaatctggaccatcataaacaaatccaacggatatgccgcctgggcgcctgggtccacctgcaggtgcaaaataatacccaatccatccattccagcgcgtgacggcatcccagatccatccatcgcgcacgcgcttcgccagtttgcctcccgtcaccgcgagccagctgggagactcgccgccgccgccgtgaccggagaccgccgcgagtggggagatgaccgggcgagcaccgcgcgaggcgtccgcgctcgcctcgcccgcgtccagccgtcgccgcgagccagctgggaggctcgccgccgccgtgaccggagatcgactcgccacgcccgcgtccggctttctggccggggccctgtcgtcccgccgcggcaagggaggcgccaggccgccctgccctgccaccgcgaccgagggcgcgtggaggcggccggggaggcgctaggccgccctgccctgccgctgcgaccgggggcgcgtgaggcggccgccaccgggcctgacgacgcgctggtgcaggcaggcggcctcccagcccgagcacggcacatggaggaggctgtgtcgtttgtggagaatgcttcaaattttccagtgcccgcaaggtgtttgtggaaatgcccctgaggctgtgggttctctattgtgaaatgcaaccgtcagggctaccgctggaaagcctggtcctgccctgcctcctgggattatacagagtcctaattgaaagtaaattgttattgttggcattgtaagattgggcaaattgaatctgtaatcttgatttttgtcatcaaggaaaaggtgccatcggtagcacttaggcaaattgattgagattgatttggatgtatgactcatgatgctgtaattctaaaggtagctaacaaattttgagatgtgtcattgtgaaatcttaaagagatattgtgcagctaacaaatttttgagatgttgcccaggtccatggttctggacttatgtattgtctggtttatactggacatgatatatatactccctcaattttttaatagatgacgccg

SEQ ID NO: 30211 - DNA, 64407 bp, Oryza sativa
  unsure (1)..(64407): unsure at all n locations
gtcatctattaaaaaacggaggtagtatatactattttcacggcaaacctaacctacaaagggattcacattttcacggcaagaatggacggtttatagcgcaaactagtggagacggacaaactagagttaaaactagggaaaataagaagatatgaaatgaaaagcacgattcaatgggttaattgtgtgtaagattattttttgttgctaacagaactaggcatgctcttataaagaagttgattttacaatatagcaacacagcctctccacgtttatctaggtcacttaggacttgaaaaatataggactcaactagatctagggcagaggagcagcctaggattggggatctaggagaccgacgagagaaattgatttaggtctgggcataaagggatggaaaagaagcttagaagtggttgggtttgtaggctaaggtctcaactctcaagtattgatgtctggtggtgatattttgaaacttgagtgtgggagaaataattggaatggacagcgaaaaagaatgtgcaagcacacgcctattgaaaagtttgaagtttgaaccaccgtcaaatggttcgagccggctcgttagatcgagctgatgagctttgagagaagctcgggtcgatttgaatacttatcaagccgagccgagcttgagcaactcgtgacttctgagttttcttgacagccctagctaagaaagtctgtaccaggctctactttgaacatgcctaacaaaggtagccttgcatgtatagcgaaacacatagtctaaggaggtagccttgtatatatagccaaacacattactttttataacggaaatgaattcggcctctatatccactatacacggctaaatatggagaaacacgtaagaaactcgaagtttatattctgataaactgaagctaattacaatataacatactcactcatatcagaaggcagctatagccgagcagccagccggcattgcctcccattttgttcgtacttatcatcacaactcacaagttctgctactagcgacaggcatgcaagccccctcctcgctgactctctccagttacttaattactactatctgattaccccatatgtgctattcctttcattaattacttgtatacgcgaagtagtggcgaacgcgatcgatcgggccagaagccaatcagccatgcatcacggctgtgcgactcgcttattcgtgatcgcccgcagcacggggcacacgattggtaccagccgcagcgcggggcacgcggtcgacaccggcagccgcacgaggaacgcggtcgacggtagcagccgcagcacgcggcacgcggtcgacaccggcggccgcagcgcgaggaacgcggtcgacaccggcagccgcacggggaactcggtcgagccagcccgaacccggatcattgggctggaaagggtcgcttggatccaccaacatctctgcaaaaatgaaaaaatgaagacaaaatcagggtattgcacaatcaggtgcatggaagcgaactcagcaaggacgaagaagaaggagaaatcaccggcggtgctggtgatcaccgcgtaggcgacgagcagcgccgccaactgcaggagcgccagggaacgggcagatcgagcgaaggacgccattgcgcgcggtactgatcaccagctgggtcgatcgatcggcagctcgaagtgttgagtcgttagtcgttacacacacagcttatatattctgctggctttcttgctgcatgttcgatggtgttcaggggtggccgtatttataggcatatctgctcgccactgttactcgatcgtctctctccatgcaaactgggcccgagagtctaaatctaagggcatctggatactaaatttccaatgtcttttggctttctaccttgacaattgctttattagtcaagggagtggatcttattaagctcttgacagcatgtgtgcttatctttttgtatatatacgatctaaataattacgtatgaagagttctggaaaaatacacttcttttttttaatcgcgccttagtacaacaaaaatttacgggatttctgtcagaaatctgattttgggccaccgggtccatgctaagatttgtgctgactccttctccttctccttaagttccaccggtggcccaaccaacaaggtttagctgtgcgaggcagaagaccggcggcggcggtgagcggtggacacgagcaagcggcgcagccggcttcggagataggggcaaggtaaacaagggagaggaagaggccgagtgggcgggcctagcaggtgccgttcgcgccattaggcgccgaccagggttggaggtggggtgggcatcaccagtgagctcgcttcttcccattttgccaagcaatgtgtgggagaaaaaggggttgagagtatacagttactattaatgcttgaatctcgatacagttctagccatgtaaaaagtctctcaaatctaagggttttttttgtcaaatgtgcaacgaacatacatgtacaccttattcttacaactgagagaatgactgatatatcttgagattgataaagttaacataaacatcttggtattaactagtacgtaggttatcactaaaagaataatttgtcacacataccagcacccgtgtttcataccaccaaaataataattagccacacgtatgacatatcagcacacatttctctttacaaaaataggaaaaattacaaaaatcaccttagaaatcacttgaaatttgacattttaccttgtaagttagtttgctgcgaatgcctaccccctacttagttctgttgttaaaaccacccccaatgtacatgtgcttaaccaaatcattacgttttcataaactgtgaggtgtcaatatggtttataccaaaatcaaatatttctaggagtatagtcttgatatttttttttgagagtactcaaatagaatttttgatgagtgcttaagcgttgttgcactgagtttcgctatatgacgaaaaaaataaagaataagtctaatacaagcatttggacaaggatgactcggctagcttagcttgggtggctctacattagtgataacatgctgattcggttaagctcatatgtattagggtggtttaatttttatattaaaaccgactaaagattgagcatttcgaataaaatgatttatcaagtgaaatgtcaaattttaactgacttatgaggtggattttataatttttcatataaaatttaaggttaaatttgatccacacgtgaaaaaaatctatccacttataaaatgagggcggacctttcccctatttaatcaaaacaaataagtagaaagcatggcatgctttgtgtatatgcactttcttttggacccaaacacttgtgcgtgtgagctttttcaaaacagataagtagcaaagtacatcatgccgtcgttggatgcaggtttttcgaaacaacggcacgggtaaagggtttggccgagtagcaaaactggaagatcgatgcgtaggtgcgttatgcgtatgacgggattacacgacacggccgcctccagccctcctgcctcgccgcgacgaccttgcggacccaccggaggtatgaattttttcatttttaattttttttaaaatatttacagaaataatctattgtcgcaaaaattttaaaaagtagaccctgccgctctagtggagagcggcaagctgacgtggcagacgacggctcgacggcgtcacttgtgcattttgcgctttggtccttgccgtccttacaggcgtaatgcattttgcccagctggaaagaagcatttggctggtttttttcatcggcaaaggacctaaatgcaaaaaaaaccaaatcaaatgcttctttccagctctgttaatatggcccttcccgggttgtcttttttgcatggaggccccttcccgccctgccagtgggcggcaagggtgttaatgcaaaaaattcaactttttcaatcggccgtcaccgcccgtcgagttgccgtttgccacatcagcttgccgccctccactagggcggcagggtctatttttgtaaatttttccaacgatagattatttaattaaatattttaaaagaaaattttaaaaatgaaaaaaattcccggaggtatcggccggcgggtgtactgtccggggggtttgcggagatatggttacgagcctacgacgcaggagccgggggatcgaggctgatggccctttgttggtacgggcagggtgatgggccaggcgcacgcgcacacaatgaataagtttattttaggtctcttaacttgacagcaagtttgattttcgtccttaaaccgaaatagcagatacaacgattccttagctgccaaaaccggtgcaacatatgtcacagggcagtgtagcgggtaattttgtctgatgtggtaatttgactgagtcaaccatgcttttcagcatgggccccacatgttaggtcctcttcacctatctctctcttcatctctttatttctctccttctcctctctttgtttctcgctgtagtttttgtcgcggtggtggctggaacagggagttggcatgggagcagacgctgcatgcggcgcgcgaggccatagggtgcgaatagcggcaaccaacaacagcatggagaaagtcgtcaacgtcggcagaggatgagggatgaggatcggcaatggcttttgtgacccaaccaactggtcaggggagcgagacaccatcgccacgcgtgttcgttcctcttgtgtattcttcaagtcctcggagcgctagcaggtgttctggctagaaatccagccgacgttcctcctctggctagacctggaggtatagccggtcgcaccagttgaggatctgcctgttggtgtcgatgtggtcgatgcggtagacctcaggaaggaacctctcaccgccgccacgtcggcgtcgaccatgttgctgtacatcaccttctccttcggcgataggtggaagaactccctcgttgcggtgaggatcttgtccaggaacggctccgcatgatgtggccggtcactgcgaagagcccccacaacttgatcgctaatagaagcttggccacctcgtcgacgtccccactctcgggcagtcggctcatgcctttggtggggatggcagcgagctcctgctgtgctgcctgcacggcgccgaccatagggcgcgggagtgtgcggcgatgactggcggcagtgtggaggaaggcgttggcattggcggcggcggagggacagggatttgaagagggcggaggagacaccgagccgtgacgtccgttttccccttatgcactttgagcgatagccgtagcctcgcgtcgcacaatgagacctgaaccgatccctcctcgtgatctcccccttccgctcactcaccaccatcgcgggagaagctacttcattacgcatggcagcgtgccccgccacgagcacgtacgcgcgctgcacctacccaccttctgttatcgcattagggtgacggatcgatattggagggtcacactttatgtgggatatataccacacctttaacaaagcaaggtgtggcaaaacttaagggatgtttggttgagtactttaaattaccagagcatgacataagttttcagctaacttatgtaatacgtggttagcaatatcagaacaacagtttagctagcttgagctactcttttttacctcaatggcatgtggaacttacatgatggagaaagcatcttgtgataagtatggctatgaaccaaacaaccacctgaatcagttaaacatgtaccaaacttaagatgcgataatactaatcaagttgtgggagccaaccaaaatagccccttttgccaccgaccaattcaaacaacccagccactttgtacactgacagtttgacaccaccttgatgcctacttgcctagtactatttttattttttgtgttggtttgtgtcttggtagtgcctcatttgcaaagaaatggtatgctttttctcctatctcagtaattctctttgccacatctaatttgatactatgtgataggccattaattaccataatcactatcagcattggaagagtacactgctcttagcattgacaacaccagtcttttatttcctttttagaccgcatagttacacgctcacacctgttctattccagctaatgaaacacaagcacacgggacgggcattattcgtttttaattagtaataacacaatagtgtgctgtagctagcgttgtaccccgctcaagagagctagcgcccggccgttcgccgcacgtacaatatgcgtatgtaatctctggtgtgcgtacgtttttatcacacgcacgtacttaattagccatatgcatatataattaagtggcatcatgacggccggccggccggcatgaacagtcatcatcaattcatcacggaggcgggatctgtttgttctgcggtggcggcagcggcggcgacggtggcgccggcggcgtctgacggtacggcaaaggtcgcggaaaggggtagggacgtaatcggcctgggccggtgcggcaaggcccgtcgttgcacacaacatggcgggggccgggaaagggaaaatcgaagtcgggatcatccatgctgccgccgcgtcggtagtagccagcagcctgcaggtcagctggacggacgagaggacagggaaaattaaacgtccagtagtacgctgttgttagtatgatactgatgcaaattaaagtcaaaatgagctgagagagggggttaggggaaggaagaagctaggtagctgaccctcttgggcgccgtggcagacgtggacggagcagccgatgatcaccgcggagacgacgacaagcagcgccgcgaggagacgggtacgttcggtgaaggtcgccatgaatgcaagcacaaaacacaaccagcaaaggaaacggccaagacaggtatagtaccaacttcccttactctgtaattagctgctcgcagtcgcagctgatcgagatgttatgacaactcttagaaccaagtcggtatttatagacagctcgatcgaggaggagagaaaaggccagatagattggctcctccatttaactttacatagtatcttttatttgagcatatactacttaaaaaaataggttttccggcagccaaaatatgttttcataggaggctgacacaaccgccagcgacctaaaaccagtaaaaatcgatgatttttgctagcggttacggtccgcttgcgagcccctaagacgaccgattgcaaaattcgattttcgcatgcagcactactaggaggaccaccagcaaaaaggttatttttccaataaaaagttaatcaatattaagagaagagaagctattgcatattcaaatccacatctagagatccaaattcaaatcctcatcagatccatattcaaatccatatccaaatagcactacatagatttttcactccattttcaatttgcaaacaacaataacagatgcaaatgaaatagcatcgccgtcacccgtcgccgtgctgttcatcattgtcgttgcaccgacggtggtcgtcataggtggagtgggaaagggaggacttagctcagcaagatctggaatcgcgttgaacaagccgagccgagcaacgctgccctctcctagtctctttcctccatcgccgatgagaaggaggagtggtcgtcgccgtcacaacgtctatcgctgccatggacgagctcccctcgccaacaccatggacaaggatccactgtcggagcctcatcgaagccacccacgccatgggacctgtcacctccaccggatctatgcctgaggtcactgccaccactgcttccatggcttgtcgtcatcttcgccaccgcctcctccccttccgctgctggatctgtggcatccaggcaccgtcaccaccgaatatgccgccataagatccgtggcttgccatcgctgttgccaccagcctcgtcccttctcgtcacatgatccgccgccacccgcctcccgttgccatcgccatcgctgccgtggcatcatcaccatcgtgtggcacgcaggcacggtggaggtggggaagttgaagggaggagggagctgaggagacggaggatttagtgggtggcatggatagtgggccatagggctgtgcgattttaatgccagcgaaacatcaattttcgttggcggatacttaagaagtctgcttcaaaaaatagagttttttttacagacctcctaagcattcgtcggtgaaaattggttttttgctggtggttcatgacctaaaatccttcaatacatttttacaagtgtttatttcattaacccgtcaataaaaataaaagggtgacaccatgaaaaaaatcgtttttagtagtgataataatgctatggagtgtctagtctatttctatatatttgtatcacccacacaatcgtcacttctcttttgggttttagtgcggttgctcttttgggtatatacatggagaaatctatatgcatggtagtgccggtgctgctcgctttctccagttagtcaaggctgcccacaaccatgccgtgcatagaacggaaaaatttggaggcacgaagatatggggtcaggtcaactagtgcgctactacctagctcgctccaccgatgacccaatggcacaccacgcacgctcgcaacgcacgtcgttcggttcggtccgctccgttctcttgccgatgcacaccggtgtgaaaaaaagagagtcagaaatggtcgcaaaacacctttaaccatttccatatcctagaaaatgggatcgaaattaatgataaaaccaaaaacgaatacggaactatatacaagacggattgaaaagtgataattcatggcatgactatataatgtaatcacagaaatttaagtctataagttataacatgtaaattacaaactatatatctctctcctttagcagctatgttctcaaaatggatgatccaactatgggtcaaatatgtacaatagatattgagctatttatagataatgaggtatttagaaatacggtcatttatgtagctaggactttaatttctcggttcgggtcgatatattctaatttgttgctaaaatcgttgcctatcttgacatatcagctttggctaaggctgcattgcttgatcacttggtttgatctggtacatccatcacatttgtatagatctatcggctaaataagtttttcctattatatcctattgtataccgtctcggttagatccgatctattagattgttgctaataagtttacttctactaagtcgataggtttttatgcaatattcatcggagttctagccgcattattctaagctttagttatcatattatcgattcattagctgatgtacattttaatctacctacgtcggacctccagccaacatatgcttaaaccttcagacctgcatctaccactatatcagtattggtcaattggttcaatgttttgattattcctatcatccttgttagttgcaggattgaactaacgggcacaccctgaaccgatttttagaaattgcactagagttcggcggatctctcagaccttcgtgtgttggacaaaattttgtggcaacatattttggcacgcccaatggaaccattatattcaagccaacgtgttgaagaaaaagccgatgctaacaacatgatcccagtcacaatagagaatttgaaggaggaactgaggcaataggtggagcagtccgtggctgattttcaaaatctttgtctagagtcggtcagcatgatgcaacaaggaccacttaagaagccataatttccaaggccagttctgatcggtaaaccaagccaagatgagctcgctaatccgcagaagttttttcaagatttggttcatgaaggcatgaagctatgcatcttgcatcaatcggtcaatctgaagtgttgacgctgatggatttagtcaagcaaacagtaaatgaatgaattgctcaagatcactagtttgtcttccaaaaaagacgatggcaaactttgatatacagatcgatgtcaatgtcaatgttgatgccaatgatgataggagtgcctcaaatatcttaaggacattcaacttgagaggggggggggggcaccacaatgagattcctcctggaaatcatcaaacaaccgatagagggcactggtaccaagtaccaacatggtgaaattctttatcagtatcaaccactaagagatcggaacatgcaaggaacaactcctcatcggtataatatggacaatacaagagatgatatgtgtgcaagaagatagctgaagtgatgaggtaatagtttgggcttaagcccaaagagcaaacttttatgtatcgacggccattcctgagtggtttaataaggttccactacctcaccgatagagggccctaaatttctcaccgatacacgctccatgtggtgaagcatcagatgaagaagttttgcaagttagatttttttttcattatcattatctggatggactttcacatagttttcatcattacctccaaattctatcaagatgggccgatcaagaaaaactatccaacctgtatttaccacactatatcagtactagccaattggttcattggttcaattattcctatcatccttattagttgtagaatcaaactaactgacacgcactgaacccgacttttagaacctgcattagaattaagtagatctctcagtccttcatgtgttagacaaaaattttttggcaacagctagtcatgtataacttccttgaattttaaatcttcaaaatcgtttggcatgcgcttttctatggatataccataacattgaggtgtttctatcatcaggtatactcccttagttttatgaacgattgtgttgagtttttatacacatttaacatcttttagaaattatataataattatttatttgttgtgactttattaactatcattaaatatacttataagcacgacttacaattttttatagttgcataatttttttaaataaaatgaatgatcaagtgtttatctaacattaactgtgtcgactatcaacaaccggagggagtacgtgtgaacctggaccaacacaatatcgacaattaacacagcggcactttatttgtttgaaaccagtcacacacactcacgcacccacctatccgttttattcctgctaatgaacactagcacatggaagacggaagaacggtatatatgatccatatagctagtaacaagtatacgttctagtacctgcgagagatcaacgtatatacgtacgtacgtacatacgtgccctcgacatatatagatacatacatacgtatacgcgtatactattccgtcccatacaaagccaatttctaactacgaacctcgacacatgtgtgttcagattcatagttacaattgaactctttttgggatggaggggtagcttatagggtgcattgggtcgcgtgaggtcgtcgtcgcggcggccggccatgctcgatcacggcggcggggtgtccccattctgcggtggcggcagcggcggcgtgggatggtaggggagaggtcggaagcagggatagcgtccgcgtccatagccgggggcggggagatcaggcctgatgggtattaggccaccgccgtggccggggatcaggggatcgtagcagggtccccgaggcccgtagccgccctcaccaccgccaccgggaacgtagacgtcgtcgtctttgggacggtgatcagctggcgctggatcaggacgggaaaatgctcctgcatcaacgcgcgcatgcatccaagcgttagaccacacaggcacacatacactggacactgatcaaaataaagtactccctccctccgtttcaggttataaaacgtttagactttagtcaaagtcaaactgttttaagtttgatcaaatttataaaaaaaaatagtaacatttttaagctcaaatttgtaaaaaaaaagtaacatttttaagctaagacaaatttattataaaaatatatttaattattgatttgataaaattaatttagtattataagtattattatatttgtctataaacttagttaaacttaaaatagttttgaccaaagttaaaacgccttatatactgaaacctgaaaatggagggagtagtagcaagtgaagtcaaaatgaaaaagctgatctgaccctcgcgggcgccatggcagacgtcgacggagcaggccatgatcaccgcggagacgacgacgacgagcgtggccaggagactggtacgtccagtgaaggtcgccatgcgtgcaaccacagccgagaaaacgaccgactggtcgatcacgcggatgctgtgatgacaactcttggatggagccaagccgggttttatagaagtctcggtgagctgagattaattgggcccctcgatttgatcacctttattttttagcctaacatagtaatattgctctggtctattctatgctcatcgctcacagaattctcacttgtttttggttttagtgacttttctcgtaaatatactcacgcttgatcgttaattgtgacgtacatggaggaggaatctatctataggcatggtagtgccgttgctgttctgctcactttctccggttagtcaaggttaagttggccacaatcacgccgccgcgcaagaactgaaaaatcaagaggcccggcataaatatatcaattttaatggatcatgtcgtgtcactctcctctcgatcgatcagctcgcacgcaccgatggagacatggagtcaactggtgcgctagcttagctctaccaatcgaatcgcccactagcacacaccaccaggcaccaacgctagttctcatatcgccccgatcgatcgatccgcttccggtgtagtacgcgcgagcacgcgggatcgattcatcgatattcgatacgactgcgccgatcgatgggcgcgtcatgcgtctcgtcggctggtcacgagtcatcagcaaagccgtgcaaaaccgcgctcgcgtatacggctcacgcgcggcgcgcgcgcgggtcctccgcttcgtaatcgcgcggatacgtctcacgggctcgtggcccctgccagcgatgaagcatgcaacggaggatggaagctgtaggccgcagcgctagcccacctgttggcactggtgggctgggtgctgatccccaaaaccgaaacgaataagttcatccgagatcccttaacttgtaaatgaatccgattttcatacttcaaccagaaaaccatatacaaaagtcccataaatgtcaaaaccagtgcagatgaggtccctcggtggttttggctgacgtggcgcatacgtggctaatttgaattggtcttcatctgatatggcattgacgtaacgcttacgtggcaatttgacccggacaaatagtaaacttcgtgggacccacatgtcagttacacacatgaattaattataaaaatgttgggtcccacatgggtcccacgagtcattctcagcccctttcttcctcctctcttcccatctccctctcctcaactctctctcccctctcccatccccaatgcttctgagcgcccgccgccggcgccgacgcagctcccgccgacgcagccggagtacgcccatctgcgccgactgcctcgcgttctccctcgaggctgaccccttctgccgggagcccgacccgtcggccgagtcgtagtgcgggaggtggaagagtccaccatggcgcagacgtaggtgggcacgagaccagcgtcggcgtcggcctgcatcacctcgagcagcttcgccgggtcaaggccgtagtctgtctccgctccagtggggatcgcccggatgttggctggatcgaatataacatgttcgtgtggctcaaaggtcaagcacgtgaatagtgtagtgatgctaaatgttacttctactcataaagcatttaccgaagcaactctaggtgaggccctttatcgtttcaactattctatatatataatctctaaataatcatctaagagatatcatactcgtttctaccgttgtacatggtatgagtaaaaaaggagaaaacttggtgagaattgaagagaaatacagatgcattttttcctatcgcatgtattcacctttagtaagagagaagaatcagcatgtcgcagtgatagatccaggaagaaataataggagggtctccagtgatagatccgggaataaataataggaaggtccgaagaaactaaaacaaatctaaagccctcctccctctatgtatggcagaaaaaatatgtgaaggctttgtgaaggcttcaatgttcctcacgccccccaaaagcggattgtggaaaatctctctcgcagctccagtccaagcccctctaccgtctatggcgttctcaccggagctgagatggaagcatgtggaaaaattgatgattatactttagttacaaatgaggatgcttatagataggatatttgtacattggttcttgtaaaatggatggtctatagtaacttattaataaagttcctttcgagggaggggcggagacaggagtagggcaattagggctgtagccctactcctgagtctaaatattcattagaattgtactttaaaacttcgtaaaatactccatctataattgaataaatttataattgaataaattatagatgttttaactttagtcaagatctagaaaaagtagtaatatttacaacaccagcataatttcattaaatctataattgaataaatttttataatatatttttattgggttaaaaatattactactttttcattaaatctataattgaataaattttcataatatatttgtcttgggttaaaaatattactactttttctataaagttagtcaaaaacttagagtagtttgactttgacaaaaattaaagtgttttatgacctaaaatgaagggggtagaaaattaaaggaaaagctatgtaaattacattagttgaggcctaagaatcctgattccgccactctttggagggatcgattcatcccatgtgtgcctgcgtgcatcgtcagttattctatggacagagagagcgtacatactctttatataagtacaaaacggtctgacaattgcatcaattacaaaaggagaaatacgtgttggagttctcttaataaaggaataagtaatactccacccaacaaattaataacctgcatgtttgtgtgcagaaataaggggaaattgattgtgctgtatgcacggaccttaggcagatcatatcagattacatggggcgatccttcattaggtgggtaacatcgagaggcctttttccagcaactaggtagcccgtgcaaaatacgcgggtatacgtcgtacgctaagtttgagacactaaaactaatatattaaccggagaacgtctaccccgatttcttcgtaaatgatttttgttagcattagttgcttttataatttttaacatattagctttatattatatcatatttaagtaatatctatatgcagttatttataatcttattcatcatttgaaaagaaggtagacttattttctttagaaaatatttcaacgaaagtaaaagtaagtgcaaagcaaaagtagtgtgtttttctttttttattgcatatatattatcatggtttattagaggatgaatttggtgggacatgaagctccactaaattttatatagcctaatacgatttatgtagtttgagagataatccatctataaacatttcatgtagagtgggcaagaggttctacgcaacctaacgtgaatataattgaacaataatatttttgaaatgtgatgtaccatgaatgcacgcttgttttccttatataagatagatctaatgattaaaaataatgatttcactggtttaaaaggcataggagtattccaaaaatgtagcttaaaaattaggttgtttaatatccaacattattttgaattgaacatagctcaactggttaggtttcttgtgatggaaattgcccactcgtgttcaagtcccagacttgacaaattcattcagtggtagacgacgtacccatcggcagcgaggcactcatggtgactttgtcaatgtcaaaatatgtcggtccaatctctcagaggtactcataggggtagagtgtgtgcgtgcgcgttcgtaagggtgagtgtgcgtgcgttgtgagcggctgcatttgtactatgtttctcaagaaaatatccaacattattgataagtttattagggacgggtggatggtgcgtagtatgtacatgtctggggtttttttttctcaattcgatggatagtagtacgtattgtacatgtgagaaatttttttcaatttttttgggtgaaccgtacgtatatacatttctctcgtagcaattaggtgggatcgtggcagcgttaacccttctttcttttcattggtaattatttttttcctttttttgccgtgagtagtatagtacaaaagtacgtgtgtgtgcgtctctctctctctctatatatatatatatatatatatatataattatatgagatgtattttaaatgaatctaatctaattgtttaaaaatagtggatccgctgaattaaatgaaaatcgagggttgggttttttttgttttttcgcaaaatttgtaaggttttatctaatttattagagtgacacgtggcaacttaggagcattggtaggagtctcacctgacggtgtgagagtttttaggaagtttaatggatttttcatatatactatatagatacatagggcaatacacatgcagcttttgcttgcttgttctgaagctgaacattaccgttatattatcatgttatacagaaaaaaaatagctttatctttagttccatataatttatattgccttatcaagtagaattcggtgcagaataggtcatttctatcttaaggttggaatgatatataggtggacaaacagctaggatatgactcaaatatttttttaagtaaatattatttagttatgcatattttgtgatgcatcaaattatggtataacctatattttgtttttctcataattcagaatttttagaactttttaaagttcagaaatctgttttagttatgcatgccggtgaagtgatatatgatgcaacacctcataatgtcactttctttaataattgttcatatatgtttgaataacatgtaaagggtctcaacaaaacttaaatgaatataattttacaagttaaaatatagtcaacatgtgtcttaaattctaattgtgattttaatcataaataatacaatggtacaaatagatcaaaaattgaacgtataatttaaaagataaaaatttagtattatttaaaatttactgttgcaaataatatatatttagaagtattcttatttaaaatttattattgcaaaagctttcataaagagagaatgggaggaaaaaaacatagaggatttcctaagagaaaacggagaggaggatggatgtctttttttaaggatgagaaaaaataaatctaatctaatggcttgaagtgttatgtccactaaatttaataaaaaattaaagggtagatgtttatttttttatatatatgatttagatgttacaaatgttgaaatttttatatcgaatttcccccattaactaatataggaaaaatgaattatacatagaggggagggagagagaggggtgtacgtggggagagggagaacataacgactaagggggagaggtgggaaaggtacatggtatttttatatgagattaaatttgacggttaaaataatgggcctatcaatttaagtgaaagtggatggttagatgtttttttctcatgatttatagttttttttaatttattagagtaccacatggcggcttagtagtttgtagatgccacatgacggtttaggagcgtttgtagaaagtctaataaacttttagtatataattattaatattaatttgggttttatgtcatgtgagtcaaaaaaaaagaaaaaaaaagaaaaggagggacgtggggccagcgtaatatctataatatatgaaaaaatataatatattattggtacgtacatatatttttgcatatatatataggctgtagttaatatctatgggctagaataattaattcggtttttatccttgtgagcgaacaagaaaaaagaaaagagaaaagatggatgtgggcccgtgcatgaagtatacgtacatgcacatacgtgggttacgtgggcctttttaagataaatcagattggttatttttattatagattaatggtaaaaaataatgggtccaccagattaaatgaaaactaacggttagatttattttagaattctaaatttattagagcgtcacttggtggtataggagtgtttgtagggtgcctcatagcggtataagagtgtttgtagaaagtctaatattgaagatagatcgctggtggtgaacccatcgtttatcggttagtcaaaatccacttttattactggttgcaataaaagccgggattagagattatttttagtcgtggttcaaaaagttagcagctacttcttattctttatgcccgtttgactaaagatcgttcgtcaggcccggttggtaacacgatccgggaaaaaacgcttctttttaatctttaatcccggttggtgttaccaaccgggacaaaagatatatttttagtcctggttggtaataccaaccgaaacaaaagatcgtggcggagagtacgaggcatctgccatctgcgagatcgaggaggaggagacgggcagccttatctcttcacctcttcattcactgacctgatctcttcatcccatctcttcctcttcctcctcctcctctcctctaacttctctccttccctcccccatcatcccttcctcttcctcctctctaacttctcctctatttcctctccttccctccccatcatcccatcgggtggccggcggcctcaaggtggcgcgcaggcgggcggaggcccgggtggcggcctcgcggtggtgggcggcgctgcggcgcggcggcggaccgcggggcctcgcggcgggtagcgcgtcggcggccggcgcggcggcggccggcgcggcagcggccgacagcctgtgttttttttcttttttttaagaatttgtgattcggatctgtgtatttgatttgtgtgtgatgtccgtgaatatgtgatgtatttgtgatgaattttgtagaagttgtgatgtaattttgttttaaaattttgtgatctatttgaatatggccgatttggggacttgaggattggggataatttatttggtattttaggatggggatagagtaaaatcaatatattaaaaacacaatgaagaaaagaaaataataatagagcaaccggacctagctagctaggctagctgttaccaaccgggactaaaaatgctctatctttagtgccagttggtaacaccaaccgggactaaagatgtatttttacttccagttttttcacccggaactaaagatagtgatctttagtcctggattgatcgtcccggtttgaaaatcgggactaaggggttacgaaccgggagtaaagctcctttctccacccgtggattcatttaagagggttggtcccagacagaagaacgatgaaagcaatatctatatatcctagctacatgctagaatcacgctctctctgaccaatggcttttatttctcactgttaagcccatccatgctagctagcatggtcatattggttattaagaaatgcaaccgtagtttttattatagtcgtacagaactaattaatgctacgataagttcaacaattgagcctgacttaacttcgacgcagttcacacgtcaaatattcgagaattaaatttcaaaatatatattatttttctcgattttgtatatatatatatacatatttctaaaaattttataaaaatatacttctcccgttgattagtgatgtggcaccgtatcgttggcgcacctccgtatcgttggggcacctaaaaaaggcgggacacctccaaaacgcgggaccggctgtagggggcggtcccgcggcgccaacacatgcacgaccgggcggcacaggatcggtgccgcgccatggccatgcgggaccaatgggaacggaagggagtgacgatggcatgaggttgaaacgtgggactggattatgatcccgcataatggtcgagcgacaccacgccaaatgcaaacgatcaagtacataatcaaataaacttattcctaatgcccatagcattagctaattagtgtgttgtgctatatatgaatgtgtatatgtgtatggccactttgcggcagtggcgcagattggtcacgcggcatcacccgcggtaccgcctgcccgttctgcgcgactgactggttggtgcgggaccgtgacagtcgcgcgtgttggcgccgcggaaccgtcctctttaatcggtcccacatgtttgatgtgagccaatggtgcggtgccgcgtccccagtttacaggagaggtatatttgtgtaaaatatttagaagcatgtatatatatataaaatcgagaaaaataatatatatttcaaattttaattcaaatatttgatccgtataaaacaagccatacaacggcaatgctacatccgcccactctcaatttatttttatttccatcactcaccgaccaacttaggtttttgtcatattctgtgtttcttgtatctcgtactctttctatctataataccttatattattcgcgaagagagtaccaaccatctatctcatctcgggatggtacatttattgctgttgtgtcctaattattattacatatatgctacccccttcatagtaaaatataatcattttaaacacaatgacaaatcaaatattttcaactttaatcagaattagaaaaaaaatcaatcatgtaaacttgatgttactaaatttatcattaaacaaactattataatatgtaattttttatttaaaacatattaattatttttatagatattattgatcaaagtagcatcttcaagactgtgtcagagtctaaaaatacttatattttaggattaatcgcttaaaccactttgatttcgtttctctcttctattgagagtagttggcagtgttttcactctcgatctaattggaagagagtaataatagactttcacaggccatagcccaatcgacagtcacacttgctagctaatactagttgctgcccaggtaattaattaagtggcacaaaagatgcctggatctcagcattttatattgacgcatcaatttcacataatatgatagagtgatgctccggtgcaatatacttgaaatattatactccgagtagaattaatctggaccgtttattttaaagggtagataagtaatcttctaatatcctttaggggtaattttggtaaggggtgttttgttcggtgcgcatcttcggttcgcatcggttcacatcgtaggctattccttccccggcgtcgctgccttgcccgcatccgtccgtatcgctcgccgtcgccgccttgtccgcctcctcagtcgccgtccctctcctccgcccgcgtcgccttctccgccccctccgtcgcagtccgactcccccgcccttcccgccctcgccgccgtttccagtccctccggcgccgtccgtcggcccggacatctcccccctcccccttcggttcgcatctggtcggaggcaggcaccggcaggcggcagcgcgcccggcggctattcctcctggcaggcggcgtcgcggctggtggcgcggtgcgtcgcgtctgtccgacgcaggcggcggcgtggcctgcggcgctgctagtggctgggtgcggcgaaatcatcaggtatccactcttcccatcccccccccccaacctgactttctgttccctttcctctcctcagtggtgactttaatatattattttaacagtaaaagaattatagttgatgtcttgaatataaacggggaaatcttatttttcagttcaatagcagttgaacttgccgaaatgggactaatgtgttacctgaattgctgaatctaaatctgaaaattttcttctggattttaaaagctattgtttttgtaaataccagtccataaaattagttgtttcccatcgatgttttcatatcacatcactggtcagaagtagaaaacagcacattcccttcggtatatttggttatacacattgatatttgattcgtttctgtcagtttgatgcttcagtggtgatgttaacatgtcctacagagtagcaagtgcaaaatgcatctttgagtgaaaaacatatctgccaatgttgaatcattaggattcaataaagatgacctgattcttgtgaacgatgtggcttgtgcaaaattatttatctgataaacgaactatagaatacggtggagatttactcagtttgtcaacgactgttatgtgtgttagttcttaactgtaccgcattggctcgccctctgtgcgtgtgtgtgtgtgtgtgttttacaagttattactgttgtgcatgactaggaaatttagctgttaaaagaaccacactttagtttttttcttggtcatcattagcttttcctgtctcaggttgagaagtggaatgaacagagggagagtgggacatttgcaggaccactctaaatctcctgtttgagagtcttctcagatcagtccactgccctcgtcggtgtcactgctatcatctggtttgaatttatgctgctgctttttttcttcaagcttgtgctgcaaagcaagagatccttttatatgtgttgcactaataatttagcatggttgcttgacatgatgtttcacacatctgtttattcacatgattttattcaagtataagcaatttgatacttcattgttcactgcccaattttctgtcatggtctgtagttagagtatttgtcaatttgacgcttcaatgctgaaatggataaagttaaagggcatggaaagaatgtaatctacatagataaacctcagcaaaggtgggaagttaaatcatatcttgtgcagatagttcatcagtactactagcagtacattgaattaatttattagtgcttgccttagttcttttagcttacaaacagaatttgcagccattgtgggggatctgtagtaattattgttcaatagtttagagtggcaatgtatctatgcagttgatggttgttctttttttttatatacttatgaggtataaaggacataaggttatatttgggtgcttgttctgtttgttttttctacttttccgtaggtgaggtctgacataatgtcttcgagctatgtgagcctagaggatcaggaagagtataaaataatgggtactgtggttttttcaagcgaggaggaaggttacaaattctatgtagactatgctaaggggaagggtttcagtgtgaggaaaaacaacttgaagcggaaggacggtgagattatatggaggcaattcgtatgctcatgtgaagggtacagggagttgaagcactttgagaggacagaccgaaaaagggagccacgggcactgacctgctgtggttgcttagctaagcttgagattgagcggaacgaggagaagggtgtgtggtttgttaaggagtttgataaccaacatacgcacgaacttgcaaatcctgaccatgttgcttttttaaggagttcatcgtgtgatgagtgattctaagaaagcccaagcggtcgagcttcgcatgagtggccttagggcctttcaaatcatggaggttatggagaataactacgatgagttggacgaggttggttttgtgaggaaggacctttataatttctttactcggtacgagatgaagaatatcaagggtcgtgatgctgaagatgtgttgaaatatctaacaaggaagcatgaagaagatccataatttttcctcaaatacaccacggatgagggagggcgtcttaagaatgtgtttgggccagatgctgaatcacgtttagactatgctgcttttggtgttgttgttattttcgatagcacttaccgtgtgaacaagtacaatcttcctttcattcctttcataggagttaatcaccatagaagtacaacaatttttgggtgcggaattctatccaatgagtctgtcaactcttactgttggctccttgagacttttttggaggcaatgcgtcaagtgcatccaaaatcattaatttccgatggcgacctagcaatggcgaaggctatcagtaaggtaatgccgcgtgcttaccatagattgtgtacttggtatatagaggagaatatgagtcatcaccttcgtaagccaaaactcgatgagctaagaaaattaatttataagagtatggatgaggaggagttcgagagacgttgggctgattttaaggagaatggaggcacggggaatggtcaatggatcgccctgatcgatgtaccgactaagggagaagtgggcagctgcctatacagatgggaaatacttgttgggtatgcgcagcaaccaacgtagtgagtcactaaactcaaagcttcacacccttctgaagagaaacatgtcactaatgtgcttagtcaaacatgttaagttgtgcatacaacgcctgcgtaagaaggaggctcagttggacgctaagtctaccaattcggtccctttttgtagaatagacgccgacccattggagaaagacgctgtccgtatatacacagcagtcgtgttcaagaaagttcgtgcacagatacggctaattgctggacttgaagtcatcagtgggactaatcaagatggttcgtcactgtatgtttttggtttgaaggatgataatgaggtgtgggatgaagtgagggttacttttagaggccagtctttggaaggtgtggagtgtcactgtcggaagatggagtgcgaagacatcccttgctcacacattttttgttgtactcatgttccttggtattgacaccatccctcgatgttgtgtcgtggataggtggacaatgggagcaaaggcggcatttaggtcatacaggaataccgatcctaatgtgtggtttgaacacatggttcgttatcgtagcctccgaaatctgggaagtgatgctttctttgaggccgctaggaaccctgagcagacagaaaagacgatggatttcttaaaggggattttggataaaggatcgtcatcccatgagaacatcgtggccggagaatttggtcctatgccaactcactttttatctagtaaccagccattagagaagagagtccttgatcctgatgaaattaggggaaaaggagctccatcgaagagatgaaggccattccgtgagaccttgcactcaaataaccaataaggttattgtggctcacaaactttgtatcttttgtattaatggcattgtttttttgttggattaatttaatattttctcaagatgtgcatattaagtattttcccttgtgcatcaggaatttctcttcaagatctaccagcctttgcaagactgacgaaaatagtccagcttcaacaaaaccaggagttggggaaggtggtcggaattactcttttggcattgagtctggatataatgttgaatacttgtgttgtgactcgtttttatctggcaatctctttgcagcaagatcttttactgaccgaactaaattaatgattgccatacaaactgccatcaaaactgcaacgatccggtcgaaatagccattggatgaactttctgtgcttgtaaaagaagtgtctacactgaagagaaagggaatcatcaggttttggcagcaacgaaaggtatatttcatatcttacaaatatatagaatagcaaccaaagccagcatcactagttcacttcagtactgcttactgtgcactttctatagaatacatgaaattatttttgtaaaacaacaaaaaaaacataagtcatatatgaattgttctacaagcttgggcttcgcataactatggtactggaacgaggttggtttttctttacaagtagaaccaaactggagcatgtccctagttcagttaattcttcagtacgtgaatcagggatagattatcgcagatttcttacgaccatttttttcgccgtgctggcatatgttctgtagccatcttacccagcctgattaggagccccttttgttttcctgaacaatgaaatttttcagaaccttgccaggatgtatttgtctctgaagactgaatataaagtaaaagcttttgtttactgttgcatcgaattgaattagtgatatcagtttgaaggttatttccttttgtgtgtctgtgatgaaaattagtgataccaagtaggtacttgtttaaggtcacagttcacaagaaccaaaatggcttatctgtatctggagaggtggacagcagttgtgtcatgtatgccatttatatttttaagactaacaacaattttggggaagtattaaactgttcaaaacataaataatgtcatactgcaccctttgaactctccatttcctttctccttgagaccatgcttatcattgttcttttgtttttacttaaacaggatttcaaagaaatatccaaagatgaatattttgcaaagaacaacgagttcgcaacctggtcgaaggaagaaaaaggcaaatttttctctgatctttctttggagtctgctcgtgatctgtttgagaagtttgtgaaaacttggaacaaaggaaagcttccatcccaatattatgaggggatcactcgtggtccacggtcagcacacaggtggaacatcaaagcgtcataaaacctgaggccttctgtattttgttgaggaaattgttctatcaggctaagggtagtatttatcttcatcgcctaggtttttgtatataagttcacatatatcataattttgtatcactgtactgtttttagcatttatgctagtaatgttgctgaccttcactacagatacttatagtgagaaaatcatatactgtttttgtcccatagtatgttcttgttgttttcatggtgattttgcacatccatttgtgtcctttgatagatgggtactccagatcgctggagaagaagcatcaatgaaggataggtttgtgtcgccgcacagacagacggcgaatcgatctcacgcgatcaaaaacacagtgggacatcacgattgtgagcatgcagagatccagcctagtactgtacatatgatctgaccagccaatctgatgaaatcatgttcttttaactgaccaatttggaatatagttccatttaataaatatccaaatagtgtatcatttaataaatatttatcaactagcttattctaaatgatcatccgtgcaaactaacttagaatattaaaaataaaacatctcattgacaaaagaacatctcataacttagatttcctcccaatgcgaagctcacatcttagatttcttcggagacggcttatgcaggattacaagttgaaatttcagccaacaatgtgcggagatgatctagactcaatggcactacagcacttcattagcaccaactgtttgttaattttgttaatactacaacaattcaaacccttagaaacgattgtactgctttctgagcctgtcttttttactgtctgaactatggcgctggcctcatgagcaatgaaattggaaacatgcagtgcatatttatgttgaatcctggaaatgttggcctcatgagcaatgaaattggaaacatgcagtgcatatttatgttgaatgaaatgttggcctcatgatcaaagaagtaaaatagcagggctacgccacacacagacacactgtgaccatctagcatagaaactcaataatgcatgatattccatccagacaatctgatttatatttgttgaatcgtcaacccaattgagatcttatgaattatactgaatatatgttagaattgattggaaatttcaatataattaccacgcctcgacgaccgatctatattagccactgcatgttcagaatttcacactatcaaactttcaaaccaaagtgagggatgtggtcatgggtgaaggtggcacagacctgacagtactatgttgccctcgaagacctcactcatgttgctcccctgaaactcctcaacctcactgaatcctgcacataagaatgaagattaaacaaattatagagagggccatatagactgccagaacagtgatggaggacatcacttaaacatgtcagacgagtaacatgccagagcatgaattttcttttcttttctcatgtatttttgtaaaggataaaaaaatgattaatgcatacattacagcttaagtttgttgcattatttcctttgatttctaattgatttctagcaggattaaatgatctctaggtttggtaatgtgcaatcatatatatgtgcaattgcataaattttcacatggactaaactcttattctcttttctgttaatcagggaactctagtttgctctccacatgccatgtccgaggtaatactacatctaagtccacctcaaaagaaagctatcgaggtttcaggacttggcaacttgctaaagattaacaaaatacatatttaccgggacttgtgcaatgagattgcaagaagctacgacaaggagaagaaagcattcaatattaatggtacgttcgtaacgatgacactcgatgatgtcgattgtttgcttggactgccatcgaaaggagatgagatatttgaggcaccaaaaatcaataaacctgaattgttcaacctgtacaaaaaagaaggacaaacaacaattactttagaagcattacgggtagcaataatcaactcctcgagctacgatgaccacttcattcgaagatttattcttttctcaattggatccttcatatgtcttacaactcaaagatatgtgcgctcaggatatctcaatctcgtcgacgacgttgacaaaatgagggaactaaactggtctagtctaaccctgaatcagttactgaaaggcatattaaaatttagagagaaggaaacaaacattgaggggaatgtatgcctcttacaggttcgtttcaaaacaatgcacaaattgagtatgtttacaaaattgacattaacatattttcatagcaatactcattatcttatgttcaaatgcttgcagatttggtattgggaaaaactgcgaatagataaattggctgtgacaatatatcattctggccgcgaaaggcaactaattcagtactgggacaaaataaaagaaaaaaaacgacttttttacctttttggaaaagggcaggtaactatctcatttttaatactatacactaattatatcaattgtctgtaaaatctctaatacacatttttgactaaaacataggttgtcgacgacattaggggaactatagattgcaaagaaatccccaatgaaaatgcgcacgacaatgactcagaaacacgtaccaatgaagattttgtatgcacttctgaagaggtatatattatggggttttaatacgaactctatttgacaaaatatgtttgacatccttttctcacttgtggtattcaggtacactctataatatccacagaacaatcagccgatatcactttacaagaaaggatacaagaaagcatccaaactttacaagataatttcaacgatttcacaaaggatttttggccacgtatgcgagcattgatactagattgcatggaaaatgattcaaaatgccctgaacgaaaagatactacgcatgtgtttgaggtaaagatgataagctagactgttaatcattattactcacgtaacaccgctaaaaaaaggttgacgctattgcaggatgttgaacaagaacaaattgatcctagggagcatgtatcaaatcataacgaagagtactatataaaccaaaatgaaaacatgacttgtgaaacgaaggtaaactgaattttaattctctcgctaacgtttctacaacttatcataatactaacgtgcactttgttacctaacaggacaacagtaaccagagcaatcaaagcaggaagagacttacaggtcctactggaagaacatacaaaccgactaatcggactgacttcatctacgaaactaggggtaaaaagaaggacataatcagaacccaagcacagacaaagaaaacaataggtactatgctatttaatagttacatatgctcatgtaaatggtactaactttcctccttttcaagcgtaaacggataaagaagctaacatgccagacacagacgaattacggggtgaaaagaagaggaaacaaaacaaccaaacaccgtatgaaatatctgaatgtatgaactctctacatcatccataattttttacttatattctatgtttgtgtgttactgatttgacttaccctattctagtgtacatcgagaaggaagatcttacccaacaaatcatagacaatggcccaccaaagaacgccttaagaggtcaaaagaagaaaaaaaaatgaatggctagacaccgttaaaaaattcagaaggtaatgcctaaccatttaacatttctatagatctattactaatttgtcctaccttcgtagagttgactaaaaaagaagaccctttcattacctacattaataacacagaggataacaaagtgatggtgcatattgaacaagtggaggttaaatggataagaatgaaagtactaacacaaccagaattcttgaatgatgatgtaagttcgcctatttaacaagcctactattcttttataactatatttgttatgtaactcaactaacctcaaattcaggtcatggatgcatacatccaatgcctccgctataaagtgaaaggaatcaggggagatggcaaggccttcctagagatggccattaaaataagtctactaaatgtagagggagtgcatgtcgaagcaagcaaacctcgaaataaacgatggattagagatatggcacgcggctatctagcatttgacatggtaatacttacttaagctatctatgtaatggctaattcaatttatgactctatcttactgttgaacatctgtagattttcctcccaattaatattaaagatacacactggtacctagccgttattaacgccaagcgacgtgaggtgtaaataccagattcgctcgcaaagccaatcagtaaagatggtaccaacgttgcacaaaacttcctagctgttagctatcgagaggggattacacgggacagagaaacagcacccacagttaaaacacgattggcctaatttcaatattaccgaatgggagtacaacaaagtccaaaaattgccaaagcaaggagacgggtgggtgactcaaactcttccacatgatattcacattattcaattacggaaacgtgttagcctaacgacaaaattcttgtagcgtctcgtgtggcctgtacacccttaagttcatggagcattggagcggatcttatctcccagaaattcaactacaggcaactacaacaacctctattcatattttgcaccagtgcttcccaatatgaaaaatcatttaaagtgcactccctttacattatgcagaaggaagtgaaaacatttcgacaggacttagccggaattttgatcaactccgaactgaacaacattaaagatcgtccactgctaccaaccacgacataactggattatctttcgaacatttaccacaattaccttactatgctctcttccccttattaaatcatttacatactacttgggtatttgacggatcccaaacattgatgcctttttgagataatattcatatttcatatttgaatacttgttgagaaggagcggtatatgaaaccttacgcttcggggtgactcagggcagtaagctgtcgacgtcaccgacgtgcatctgcttcaacgtcgcacctcaactccgataaccccttcgccggcatgcggatacccttcgcgcatgccaacatcttgcaaactgaccctgctcccaaccattcaatcaaataatcaaagaacaatacaatggattgaagaacaaacaaccttaatctgcaaaatcataacagtaagaaattttgacatgtttacttaccaccatccaaggaggaggttgctagagggagactcggaggagatcgacacgggattgctggtggcgcggaagagaacgacgtgaggtgactcgctggagaaggggacggcgattgcagggggacgccagcggtaccggcacggtggagaagggggcgggggatgatgtggaggggagagccgcgacggcggctaggtcgatgtccacggagaaggggccggggaaattatggggaggggagagccgcgatggcggctaggtcgatggcgacagcggtggagtgaagggggcggcggtccatggggaggagaacgtggcggcggtggcggggggaagcgacgcggtgaagaggcctcatcgagagccggctgaggcgggtggaggggcggcgacgcgacgcgactcgctggaaaagggggcgggggaggaggacggcgacggtgggggctcacaagccggcgcggagacgccgccagaggagaaggcggcgagggcgacgagtaatgggcttcgacggagggaagccgccgatagcgggggaggcggggaggcggacgtcgacggagaggtgctggcggggtagaaggcggcgatgaaggacgagggcggcgaggaagggcgagggcgacggcgctggagggggagcaggcgccaggacatgcgacggaggcagggatggagtggaatggtgacgggcagcggtgaaattgcgacgaagcgagaggaatcggatcgggataggctgagtaagagactgaaaaaatacgataatacccctacgcgattattttctcttgacgaaaacaccctttcatatttctacttccactaatactagtgagagtagaactagatctcagctctacaataaaatacgatcaatggcccagattgctttctaatcagagtataaagcaccggagtggggctgaatatgataatctttactccttagcgtacagatatttaatttcagacaaaggaataccttttttaaagaataaaagtttcttttgaaacaagttgttgaagatcatgggaatacgaacctacttcgtaagttttactatataataaaaacatcggtagttctcaaaaaaaaaaaaaacatcggtgaaggacagcttcaactctgaagcgcgcacccagccacaacaaagccctgccatggccgcctcagccaaccgcgccgccgtcaacggcgccgccggcagcggcgagcctgaggcgagccgcgaccatgtcatcatcttcccgttcatggcgaaaggccacacgctccctctgctccacttcgccgcggcgctgtcggtccaccacaagagcctccgcgtcaccctggtcaccaccccggcgaacctcgccttcgcccgccgccgcctgccggggtcggtgcacctcgtcgtgctcccgttcccgtcgctgcagccgccgctgctgccggccggcgtcgagtcgacggacgcgctcccttccatgtccctctacccggcgttcctgcgtgccacggcgctgctgcgcgagcccttcgcggagttcatggcgtcgctgtcctcctccccgccgctcgtggtcgtctccgacttcttcctcgggttcacgcacggcgtcgcggccgacgccggcgtccgccgcgtcgtgttccacggcatgtcctgcttctccatggccatctgcaagttgctccccgtgagcccgccgtccggcgtcgagcacggcgccggcggtggatccccttttcacgtgtccggcatgccggaaaatgttatgatcacggcggaggacataccatattccgttgcaaagttcaccgacatggacgacccggtgacccggttcttgattgacaacgtcttccagtcagacgtccgcagctggggcatcctcgtcaacagcttcgccgcgcttgacggtgactacgtggctccagtagaggcgttctacgagcagggagcccgcgcctggctggtggggccgcttctccccgccgccggcgagacgccggagcgggacgaggagaacgacgaccccgagggctgcctcgcgtggctcgacgagagggcagcgcggccggggtcggtggtctacgtgtcgttcggcacgcaggcgcacgtcgccgacgagcagctcgacgagctggcgcgcgggctggtgcaatccggccaccccttcctgtgggcggtgcggtcgaacacgtggtcgccgccggtggacgtgggtcccgaccaggggcgcatcgtcagggggtgggtcccgcagcgcggcgtcctggcccacgagtcagtgggcgggttcgtgagccactgcgggtggaactcggcgctggagagcctcgccgccgggaagcccgtgctggcgtggccgatgatcgccgagcagtatctgaacgcgaggcacatcgtggacatcgtcggcaccggggtcagggtggactccggcggcggcgcggccgtcgttgggagagccgaggtggaggagaagatcaggatgctgatggacgccggcggagaggcggcgcagaggatgcgggcgcgggccgcgtgggcccggcgggcggcgatgtcggcggtgagcgacggcggcacgtcgcgcgtagcgctgcagaagctggtcggagagctgcagagaagctacgacgatgtcgtcatcaaagttgggtgactcttcacaccacaaaacgaattaagaatttaagataataagatgacgatactgcatggagactatagatggccatctgggccgcccggcacggcacggcccaagcccggccgtgcctgggccgaggcttgtcaggccggcacggcccgaccgatgcaccgggccgtgccgtgccagcccacgggcggcatacacggctcaggcacggcccaatactagtcgggccggcccgaaggcacgatgggctattgtttgagattataaaagctgtcgatacattgtatttataatcatatggtagctggttataagagtgtgtcattattggttgtggttgtacatgtatccatcgatttaaacatgtgcggctatgccgctaccatcactataaataatctacacttgccaacggcttcatttgtaatggatatattattgttacagagtacgatcttcttattattcttgaacgatcatgattcatcaaatccaacaatctgtattcatcttctatatccgactaaacgatcctgattcatcaaatccaacaatccatattcatcttctatatccgattgaacgattctgatggactctacacactacacctctgacctacacctctccatcctcgcacagtcgatcgcaccccaacccgtgccccgcctcccgctcccacccctcgaccctaatcgccacccgccgccaccgctcactcttgctcgcccacatcgccagcgacagccgcttcaccgatctcctctgcgccaccgccggaacatccgtcgcaccgccaccgatcgattcccattgccgccaccgccgttctcttccgcccgtctggtcagtctctccatcacgtcgtcccccgactcccctcgcctctctcccctctcccttctccttcgcgccgtccgtcgcctgcatccgtgctgccaccgttctctgccttttcaatagtgttgccccgccttgagctgattcgccaaaaggcacgtatatcatcctccatccctcctcccttctctttactcatccaaaaatttaatccagaatcaaccaaaataaaacaacgaaaatcatcattttggtatgtccatcccatgtttctaatcattatacgtattcatttttaagggaatcccataactgtacttctgtattatcatgggaaagaatgttcctgtgttctcagtggaggagagtacatgaaatgttcagaaaagaaagggcatctgtccaccgtttttatctttaaaacaatttgcagacaattgtgcaatcgattccctgttaataatttctaatggaaaaaggtgtttaagcaagggcatctgtccaccctttttatttttaaagaagagcaagttgcagataacctgcttagtagcacttgtgagacaatcttaattatcctcactttagaatccttgaacaccatacgatttctcttggattcagcccactctgcaggccctcctctctagctcgatctacttcagtggcctcctcccatccttgattctcgttgctggcgtcacattggcggaaaaagtttacttggtgaccctcaaaagtaatcaaaatctaatccgtgaccctaaaccacagaaccggatatcttaacccccaaactattgaaaccggtgcaatttgactctctcggcggttttggagggcggtttcactgacgtggcagtatcgacctagtctgtgtgctgacgtggcgcgtaggtggcatttcaattaaaaaagttatatgtgggacccgtttgtcattcacacacacaattgtggggcccactgacatgtgggccccacatgccatcttctccctttcttcttcccccctcccttctctctttatttctccctctcccctacggccatccgtggggagcgagcggcggcggcggcggcgggagctagctggagcgacggcggcattggactggagctgaagcagcgggctggagtccatgtcgcgtcgctcgtcgttcctctcgcaccaccaccacctgcaccacccggcgcccggcatcgtgacgtcgtcggtggccgagcggcagcggcgacagcccatgggcgacggcgggagggcaggcgggcgagggcagtggcggctcgcggcagtgggaggatgaggggaacggcggcaggcgggggaagtaggccacggtggcgacttcgactttgactcctgcaatggcgatggcgatagcggcatggtcggcggcgaagcggccgaagaggaacttggatacctcggcaacgagcccctttctcgcatagcacgtgcctggaaaaggcgtggtcgcagacaacgacgaaaccgcgcggccccacaacaaggcggaaccactcgaggagagggaggagggagagcgcgccgccgaggaggtcgcctcacgccatcacccccctaattttgaatgtcaaaagtactttcttaaatatgggttcttggactgtctataatggggaacaaattagattttgagaagataaatgcctaggtaacttggcttttaaggataaatattcgtctttgtatgcaattgttcgaaggaaaacatcttctattgccactgttatgggatatgttccgcttaatgtttctttcaggagagctttagttagtcagaatcttgtttgttggcatgagttgtgtgcctctatagtacatatccagttgaatgattcgtctgatagttttagatggaatttccatcagaatggcttgttctcggtgaggtctatatacctagctttaattaataatggctatattgagataaataagtgtatttggaagtttaagttgccacttaagataaaaactttcatgtggtacttgcttaaaagggttgtgttaactaaggataatttggcaaggcgtaactggaatggcagcttgaagtgttctttttgtttgaagaatgagtctattcaacatttctttatgaattgtcattttgtgaaattcctatggagaacagttcagttctcttttggttttaattttccagttagcttatctcatatttttaatgggtggtttttgtgagttgataagaaaatgagtaaactaatacttattggagcttctgtcatttgttgggaaatatggctttgtaggaacgatatggtttttaataaatcaccatcattttcctatatgctggtcattttcagggcaactcattggcttcggttttgggcacaactagaagatgaagagtttctaaaaattgcatgtcgaaaattggagactacggttatgcaactttttgctaattatggttggagatttacaaatagacttcaataattgtgatctccttacgttagactggattctttgcttttctctacggtgtgttctattcatttagatttacactttgttcttgaatgttactatataataattggctgtagctcttttgagtaaaggtcgggatattatattccattattaaaaaaaagaacttagaactccgagcttattgatgttctcccaaacaacacgtacgtgtacaaagggttctcatttcaccggtaactttggtaacccacgatcacaaatgtaagtttattacgggtggaaaatatgctggtcatactactccaaagcaggctccttaagcattaatttccgacagttttctttcctattagcggtggaagtaagctaattaagcgcaggcgagaacatgcagctggcgccggctttcaggtttgctgtgactgaacgctgcacccttgtatagctgctgacgcgtatggccggccgggcggtgaatctgcgatggccagcggagcacacagcaccggagcacgtcgacgactctgtccgatactccgatccgatccggaccaagttgagtccaaccgttgcgccaactagtttagcacaaagttgcacaaacgataccgtcgacacagtcagtgtgatgccacacgcaggttgtcttacgtgggccgggtgctgggctgaagctataccctggaataacattgtttcatggcccgtcaatgagagcaataacacgtcgaagagcgcaaaagtttactgtaagcattaatcatcccaaggaatctattaacttattaaaggaatagaaaagaaagcctccacgttcgctctcacgatctagaaattctcatattaatcggagaaaaagaaaaatatagtccatatagaaatacaatttagaaatagttgaaattcggaattaaaaaataaggaatattgaaaaatgagactagagtccatataaaagtacaatttatagataactgaaattcggaatttaaaaataaaaaaaatattagaagtagagtatagagtccacatagaaatacaattaggaaataatagaaattcgaaattaaaaataaagaatattggaagtagagtatagagtccatatagaaatacaattaggaaataatagaaattcggaattaaaaataaggaatatcagaagtagagtatagagtccatatagaaatacaattaggaaataatagaaattcgaaattaaaaataaggaatattagaagtagagtatagagtccatataggaatttaaaactaactaaaaatcggaacaaacataataaaattaaaaagtagagtttatagtccgtataaaaatataatttacaaataactaaaattctaaattaaaaatataggaagaagagtctaaagtcaatataagaatacaatttagaagtaactgaaattcgaaattaaaaattaaagaatattgaaagatgagtttagagtccacatagaaatacaattagaaataataaaaattaaaaattaaaaataaataatattggaagaagagcctaaagtctatatagaaatacggtttacagataacgaaaattcgaaattaaaaaaatagaaatattgaaaggtgagtatagagtccatatataaatataatttacaaataactaaaatttaatatttaaaataattaataactaacacgtatataaaatacaatataaatattacacattaatagtttcgtaaagttagttcaaaatttaaaattatgttgttattttaatatctttgaaaaatacaatgagaaaacatatatgctattatatgatacaaaatataatgatgctagccgcgcaatctgcgcaggccaccatgctagtttcaatttaaaataactaacttatccctaaagaaagggataagtccattttaccccccccccccccccccgcgcgaactataacgtagcagttatctaaattacacccttaacttcagaactgggtataatatacacccctcaactcttaaaaccgttcaaattaacctccccctccttgcctgaagcatggtggtttcgccaatgtagcacagacatggccatctaagagcagttacaatagtagactattagccaactataaacatattttaataagataaatggtgagagagaagagtagcaggctacagatttatagctggctgtagcacggacttcaagatgcaatgtgtgtatgataggtgggaccatatattaatcgtatagtaagtaactattgtatgaattggctattagatcggctatagatgaattagagctagtagtagactgtactattaaatttgctctaagtcagcaaaatatattagaaaataattaatatcccacatgtaaaactgaatcttcatattcctcttgtctccccaagccagcagccattgggttggtcagctcaagcattgatgccgatgaacgtggcagacagcggaaagattgacagtgccccggtttagttccaaaccttgaacccccctcccccaaaaataaaacatcacgtcgaacttttttacacacaaacttccaacttttctgtcaaatcgtcccaaattcaatcaaactttaaattttggcatgaaactaaacacacccagttgtatgtggagtactaactttggttaattaggaaacacaaataatacaaaacttatatatgagaagtcatgcaataaaacaaaactttaaagaattgccctaacacaagtatacgttagtctacgacacttaaacatttcaaaatactctatacatactaattaaaaatacactacgcatataactgcgctcttatttcaagtagaattcattttcaatgaaaataagaaagcatatgaaaagagacaagtacatagaattttatctttaattagattaaacaattctattagccatatttttttaagaaatatcatccattaatatatctaaaaatccataaatacatctataagataaaaataattgttacttaaagtatatacacccaaaaataagatatgctaaatattccaaaaagtaaacacatatattacaaataagtttcattggaacaaactccatattgcgacaatatcttctcatatacactagtccaagtaattttagttgagaaatgttgcgaggataactagaagaattttagaaacatctggagcaatctcaaataaattattgataaaaacaagtttagaatagagtcaaagcaacacatatactgaagcaacaataaataaggttcctagtcaaaccatgatgtgtatactgctgtccggcggtatggtcaaactcaatttttgtaacaatttcttctcacctcattctgctgcggtgacgacatactagtagctttcctgcaggtctccaatcagtttctgcaacgccacgcgtgacgtgccgccgtcgctcaccgccgacctcgccgcgcgctgagcccacgcggcctgcgtccgcatcctccgcccttcctcgccgccggcgtccatcaccctcctgaccttctcctccacctccgcgctcccgacgacggcgacggagccgacggcggcgtccaccttgacgccggcgccgacgacgtccacgacgtgccttgcgttcagcgcctgctcggccatcatcggccacgccagcacgggcttcccggcggcgaggctctccatgaccgagttccacccgcagtggctcacgaaccctcccaccgcctcgtgggccagcacgccgcgctgcgggacccaccccctgacgacgcgcccctggtcgggccccacgtccaccggcggcgaccaggtgttcgaccgcaccgcccacaggaaagggtggccggaccgcaccagccctcgcgccagctcgtcgagctgctcgtcggcgacgtgcgcctgcgtgccgaacgacacgtacaccaccgaccccggccgcgatgccctctcgtcgagccacgcgaggcagccctcggggtcgtcgttctcctcgtcccgctccggcgtgtcgccggaggcgaggaagagcgggcccaccagccaggcgcgggctcccggctggtagaacgattcgaaggaggccacgtagtcgccgtccaccgcggcgaagctgttgacgaggacgccccagctgcggacgtccgtcgattcgacgttctcgatcatgaaccgggcaatcgggttgtcggggtcggcgaagctcgccaccgtaggcgggatctcctccggcgtgatcgtgacatgttccggcatgcgggagacgtgaaagggggcggcgccgccgccgacgtgcgggctcacgacgagcgacttgcatatggccatggagaaacaggacatgccgtggaacacgacgcgggggacgccggcgtccgacgcaacgccgtgcgtgaacccgaggaagaagtcggagacgaccacgagcggcggggaggaggacagcgacgccatgaactccgcgaagggctcacgcagcagcgccgtggcacgcaggaacgccgggtagagggacatggaagggagcgcgtccgtcgactcgacgccggccggcagcagcggcggctgcagcgacgggaacgggagcacgacgaggtgcaccgaccccggcaggcggcggcgggcgaaggcgaggttcgccggggtggtgaccagggtgacgcggaggctcttgtggtggaccgacagcgccgcggcgaagtgaagcagagggagcgtgtggcctttcgccatgaacgggaagatgatgacatggtcgcggctcgcctcaggctcgccgctgccggcggcgccgttgacggcggcgcggttggctgaggcggccatggcacgggtgtgcttgttgcttggagttggggaatggaagttttgtctttgagtaacgtgttcttgaaacatataccgcggtaagctgagatctgtttgtgactattttaattaccgcggctgctagtttgactttatacttagccaatgggatatggcgtcaataactgtggactagatttagtacaactagaaaggtagcccgcccattcacgcgcgggcatgtattgtatattgcgtttgaatatatataaatcaatagactgacacctcccatatttaaaagtactattttttaataagacacatcagatgaggcctccgctgttcattggcattttgctttgataattattccaagatatttgttaggttttaaaatatataatatttaatacatctatataaataattatctatgatcgttttattatatagaatgaagttcgatttagtttgtttggaaaatgtgtctaataaatcaagtataaattagaagtaaggtgttttgtccctttttaatagaatgtttactcgctttttttaacaaattctaaagaactattattgttaataaatatgatttatttgtagcatcaagtagttctccttctagttggtttaagttgatgcaagtttttacatacttatatataaattaataaagacatgtcatatacctcgcttcattgcgatttgtgttatatgtactatattttcaaaagaaaatacctagttaatatgaatccaaaattttaaatttaatagtaacaaatataacttttcaatgaactatatagtgcgaaccttagtgcggtttgtatgtgtaataatatgtgaagaaactcataatgctatgatataggatagatgtaaggacattaatgtctaagcattttaaaattgttacgaaaaaggaacatgcaatgggttggtccaattttagtgaaatgtgagaaccaattttttactaactattatgttttctctaaatagtttaatttagtctctattgtcattttctattacttgctttattttatattttataccagctcaaaatataggctttatggatctttaaatcaatcttttaattataaatacaacaatatctagattagaaatcgaatgtgtagcttgaaatttatgcaagttttaaaattttttattatttccggctatataaacaggaaggggtagagtggagagctcaagacgagaaaggattgggcgaatagtaccgtgttgtgcgtatgtgtggggggatggtgaagtggaggggtattttttttctattttatctaaatgatttaagtgaaaccgatgatatattttttctcacattttatgttattttttctaatttttaagacgtaacacatggttgcttaagattttcttaaaagattatctattggttgaaaataatggatctacctatttaagtggaaactgatgctaagatggtttttcttccaatttgtaaagttttatttttatttaaggtgtaacacgcgacgccttgagtgtgctcagaggatgtccagtgatttacggtaatataatacttattttcattttgtattatggtccatgttttttctatttggttaccatgcaaaggaacgatgtctatgcttaaatgacatattttcattttttataaagtgaaatatgggtaatatggatcttaaacattttatttaattgtaaataaaacaaaaattcaaataagttaaaattatgatttaatttaagaattataatcatttagatttcttattattgatatttctttacttagttaaaaattaggagataaaggaattaaatgagtgagtagagaaagagagcgttgaagggtagagattatgcgtgcatataattgtaataattctttttaccggattgtaatgttttagttgctattacttttttaactaaaaattgaaaaatgatttattgattgattaaaatctatcatttttacttgtcttttccattatattcgcagaagatatgaaaaatacgaacactacaatccaataatgttattttgacttattctaatgttataatgaaggagtagttttttaaaacattactcatggttaggttcattttacttttatccatatatatctaatttaattattccgatgtcatacatattgataaaatctatatcattatctttctataatttcataattgttcgaatggcacacaaaaattagaaaatatagccccaaagtgatatatttcttctcgaagtcgatattacagtggatatgggcctttaaatgtaaaataatctaaagatataagttcatcaaatattagttgtggatttagatgctatagttgctttttttcttgcataattttgctttctaactaacatattttggaaacattactcatagtatattcattttacttttatgattatagacctaatttaattattataaagttatgtatgatgatataatctatattattattagtattttatattttttataattgcttgaatggcatgcaaaagtaataaaatataaaccaaaatgacattattttttcaaagctaaattatagctagtgaaatatggtcttcaactgtagatttagttataaataatttaaagatttacgcggattagaaattagttgtatgattcagaagcttacttgtttaacacaaaattattgcttatctaactaataaggcatgaaaatatgagaaggaatcggtgaaaatgtagataaatgaattgaagaaagaggaggcgtacataagtacgttcgttttttacatacaggcttaggtggtcctaggtttaggagagtaatttcatttcttgaaaattaatctaatggctataaataatctgtccaccaaattaaatgaaatatgtttttgttatttcagattttttaagaatttcactcatttattatagcatcacatgacaatttaggaacgtttgtagaatgtcatatggcgaattaggagcatttttgagaaatttaatggacttttaggcatctaatctaatgttctaaaacatcgatcgggtccaccaatttaaataaaaatcgacggtgatatttatgtaaatttatgaagtaatatgttttatatttaaataatagaaaatcctattttaaatattatcaaacttttgcaaggtactaagtacgtatgtttttttcttattgattttatggtaattctgtgtgtagttttttttctcttcattagttcagttgtacgtacgtacaaatttctcctgtatacataaacacgtaactgcctaaggaattagtttctttttttaaaatatatgtaatctaatggcctaaaatatcgggtccaccggaaagtttaatctaatggtttaaaattatcgggttcaccatttaagtgaaaatcaacggttagatttgatggagtcacgtgacggactaagagcatttgtaggagtcctacttggcagcttaagagcgtttgtagaaagtttaatggacttttagtatataatagataggtagatagataatagatagatttgatctacgagatgacttgtattcctactttggatccatcgagaaaactagtgctcacgtactctctcgcttatcttgtttatacctctgataagcacaatacaaattcattaatggtgtatttggttggatggatgagtctggataggagatgatcgtctgaatttttgtggtgtttggttagagggcagggtagatggggtggtccgaaatatagaatattccctcaatatgctcgatgaagccatccagttttggtctgggtgatatgtcgtattctgattggctgtggttggtttgattttctgtgaagcaagctctaaatgtttttttctcctaaaccatttatctttacaccattatatttgttacaattaaatatttaaaacaagatctcgaatgattatatgttaataaaaatataaatacatatatgtatatatgacaaataggtcccacaaacttttggcttttcccatccatgttatatccctctaaccaaacaaaatttagtcgtcctatccatacaaaccaaacaaaaaattggttcgctatgtccaacaaaatatggatgtccatatcctatccatgcatgaccgtgacaaacacaccctaaaaaaagttcactttactacctcaacctatttaggtagtccattttacttcaaacaatttttggccacttaaccttctaaactataaaaaaatgatttaaagggagatacctccctccaaatattagaaccaaatattttttaaaaaaattatgagcttaatcgtttcaggcattccagtttctttttcacatatcgttatcttcacgttagtcagcttggcaccgagttccaggctgaaaattttaagagagaatctattttataccattgagtttcttcgagttcaataatttgccatcgatattgttgctttctataatataccggtgactttatcaattgttctacaatacgccattatgttgggtcttcttttcaaaaatacccaaaatacccttatggacatacaaggttaacaattgatttatctcattataagtttaaaaaaatatgaaaatttttatgtggctttcttacacaacgtggaaatttatatagaagtttcaagttttttactaaatttttatttttttaacaaaatataacttgtttgttatatgctatataaaatacttttttattgttgttttcaatataaatcatctttcattcactatataagatatttttatgctattacctcttgtataagcaaattctccctcatataccacttaaaaatgtttttttttctaaaaactaaatatacttgaaaaaacttgaaacttgtatacaaacttccaaattgtgtaaagaggccacataaaaattttcatatttttttaaaacttctgatgagataaatcaattgttaatcttgtatgtctctaagggtattttgggtatttttgaatagaagtttcagccaatggcgtactgtagaataattgataaagtcgttggtatattatagaaagagacaatatcaatggtaaatcattgaactcgaacaaactcagtggtatagaatagattctctcaaattttaacctttgtataccatagatgttagaccagtatcttgccccaatccaatagtgtgaaagtgaaagttctactgcccagttagggcctgtttagttcccaaacaaaatttttcacgctgtcacatcgaatatttggacacatgcatggagtattaaatatagataaaaaaccaattacacagttcgccagaaaattacgagacgaatcttttaagcctaattgtaccatggttggataatgtggtgctacaataaacatttgttaatgatggattaattaggtttaataaattcgtctcgcggtttcctgatggaatatgtaatttattttattattaaactatgtttaatactacaaatgtatataaatgtatgtccatatatccgatgtgccatgcaggggtaattttttttttttttttgccaactaaacatgccctagacactcctgattcttcgaattgtaatcttccaagttccaaggccaggaggcagtcatgttttgcactagaatgaataggagtatgtgctaatgtgcatactacccttgctgctatcatcattgttccttttgctgtcatccctgtggtagcatcagccggcatcgacgagatcatgcaggcgcttgcctgccgtgcggcgaagaagaaaggaggcaagatgagttcgaaacttcaatagtattactgcatccacggtgttgcatgcaaaataataaaatagtatttttgttctacctttatacattgggagatgagaaagtgaaaaaaatatctatagccaaccttaaggctagatcgtaagaaataaaaaattagttcgtaccttttgcaccatgcatggtgctctttcattcatgttaaataaaattttttaatgagtgggtcccagcttaaagatctataagaaaaagctatatacattgtagcatgtgctatatgcaaatgaacgtaagaatgcgtgggtcccatcttatttctacagtgatcttaaaggcttaaacattgaacacattctatgcattctatgcatcgggagtgagaaatactgccaaatatgatatgtgtaggtgtctgtttaatttattttagaaaaggaaacatgattttaaaaactaatagcaacacgatcaatgtgacagttgcatttcttaaccgataagagcatgatgtcctctggctttcttgaccttaacaatgagaaatgttactccctcgggtgaataataactaccattttggataagaacacaatctaaaaaaacaacttttattattatttttttattataatatatatagaaatattaaagaaaattttaagacactatatttgtttatttatacttacacatataaacaattataacaaaattgacagcaaatggtgcatactatttatagtcaaagttatcgtttatttctattttacatatgctaaatatcaacttgcatattttttatgatgtatcacatattaatttatcttattaaaatataatttttttatgatttcttgagcaacatgaaaaaaaaggtgcccctcaagggatgactggacttttccaaatgacgaatttattcacttcattaccaaaataaatcttactacttccatttattggtaaaaccaaggattgacaatgctaaatttcgtcaagtcaatgaatgtgaaaatgttgtttagtttaatacttactaaaatttggtgcattttgttaatggaaggttctggaatagtcaaattttgatagattttggtaaggttgcaatggtaaaatcttgtttagtttgttaccctataaaaatatcaaaatttggtcaaatttatttttgcaatgaagtgatcagtccgcaaacatagtacataatcaaattcaacttgtacatatggggggaattaaatccaacaacaaatgcagctgtaggttttcacaaaggaacacttttaggaatgttaatttggtattcttccgatagccaatgtgcagcatattcgtgccccagttttcaaagatttgcgttgtttattgaaaaacaacacgtgtgcatgcaactatatggtcgttttattttatttttttctacgcgaaattgttgtggtcaacaaaggtctacaggtgatgagcttttcttgcatgttttctggtcaaactccaaccgttttacccgccattttgtcctcctctccacaggaggggagggaggcccgcagcgcgcgaacaccaccaaatccgatcatctctcacctagctgccatcgatccgaaacacagggggcggggagatcgatcagagctgagacggcaaaccccggcatggctccgcctccgcggctgccggccggcgcggccgcgctgctgctgctgctcgccgtggcgtcccgtgcggcggcggacggcaacgccgtggacgtcggcgtgaactggggctcgcagctgtcgcacccgctgctgcccaagtcggtcgtgcagatgctcaaggagaacggcatcctgaaggtgaagctgttcgacgccgacccgtggcccgtcggcgcgctcgtcgactccggcatcgaggtcatgctcggcatccccaacgacatgctggagacgatgaacagctacgggaacgcccaggattgggtcaaggagaacgtcaccagctacggcgacaagctcaagatcaagtaggggcatatgccggccgctcgccaaggtgttcgtccatggccgcaatccccgcgatgatcctaatcgtgagtctgatcgatcgagcaggtatgtcgccgtggggaacgagccgtttctcaaggcgtacaacggatcgttcatgaagacgaccttcccggcgctgaagaacatccagaaggcgctgaacgaggccggcgtcggcgacaaggtgaaggcgaccgtcccgctgaacgccgacgtgtacgtctcgccggacaacaagccgtcctccggcgcgttccggccggacatccagggcctgatgacggacatggtgaagttcctgcacgagcacggctcgcccttcgtcgtcaacatctaccccttcctcagcctgtaccagagcgacgacttcccgttcgagttcgccttcgtcgacggcggcaagaccatccaggacaagggcggcatcagctactccaacgtgttcgacgccaactacgacacgctggtcaccgcgctgaagaaggccggcgtcccaagcctaaaggtcgtcgtcggcgaggtcggctggccgaccgacggcgacaagaacgccaacctcaagctcgcgcggcgctactacgacggcctcctgaagaagctctccaagaaggaaggcacgccgctccggcctggcaagatggacgtctacatgttcggcctcttcgacgaggacatgaagagcattctcccgggcaacttcgagcgccattggggcatcttcacctacgacggcaagcccaagttcccgatggacctctccggccacggcaacgacaagccgctcgccggcgtgcccggcgtcgagtacctcccgaagcagtggtgcgtgttcgacgacggggccgaggacaagtccaagctccccgggaacatccagtacgcgtgcgccagcggcgactgcacggcgctcggctacgggtgctcctgcaacggcctcgacgagaagagcaacatctcctacgccttcaacatgtacttccagatgcaggaccaggacgtgcgcgcctgcgacttcgacggcctcgccaagatcaccaccaagaacgcctccgcgcgcggctgcgcgttcccgatccagatcatcagcgccgccgcgccggccgtcgccggcgtcggcttatccgcggcggcgttgctggcattgttgatggtgctggtgtgagcataccgtgtgagacgggtgggtgggtgcgtgcgtggcgtacatgtagtgagagtgggtctatgcgtgaattgaattgtccatttttcgcagcgttcaaatgtgttgtgacatttgcaaattcttcacgccggatgcatccttaattttctcttgtaaaattacgttgtccgtgtatataataccacctctgttctaagatatatgacgttgttcacttttcacataatatttgactatttgttttattcaaagatttagtaatgaataggtagaagtataagttaagattatatttttatgataaaataagtcataacaaaataaataatatttttttaattagatgaatggttaacgttataaaaaaaagtcaatcacgtcatatatttttaaatggagggagtatatatcaaactgaaaaatgtttacctggtaaaaaaagggaaattttcatagtagtctacatagataggataatcaataggtttttcattttcgtttcttttcgttcaacatatcctatctatgcatgaattgaattgtccattttgcagcgttcaaatctgttgtgatttttttttgcaaattctgctcgccggatgtgtccttttcttttgaaatggaatgcagataataccctattagacctttttcgtataatatccataagagaggaggaatgaaggggatcgaggagaaataatttcacaccacaatagctgttgaataaatcccttccaaatatccctcaaaacccttatgggagagattaaacaaacatggccataactgattaaatttacattagcatggcattatcatgatgtaatttgatggaggctaatattattcagttcctttcaaagaatgttgatttttttcccatctcaaacatagagaatcctagctaaaagattgaatttgctgccagtatggaataatcatgatcaagaaatgttacatcactgtaatatacatctcccctgcttctcattcaatgaggaaggtacaaattttgaagcctacaacttctaaccaaaaaacagagattttttttcctttttaaacgaaaacgaaattaacatacatgatggagaaaaaaaatagtagataaattaatttgacacatctgagttagcaggttagctagggaggaaatgatgaatgaatcatctgagcgtcaagatgcggaggttgatgagcaccgggaggatgaggacggcgatgaggatgatgccggcgaggacggcgacacacgcccacttgcggctgctcttctggtgctcccgcgccacctcgagctcgacggtgcccctgcggacgaaggagctggcgtgcgcgacgtggctctcgatgtcgttgagctggtgtccctgggcctcgacgagcgccgccatgtcgaggaacacctggtgcaggtcgagcaggctgcgctcgatgtccttgacggcgtcgtgccgctcctggatctccgagatggtgtccatcacctgcccccgcccttgctcctggatcgccttctgcaggaacgactcgctctcccccgactcgatgagcgaatcgatcgtgctgtcctccgccttctcccccgtcaccgtgtagtacctcctcgccaccgtctccttgtactccgccgccatcctcgtcctcagcccctgcgtgcattccatgttcatcgccgtcctccacaaggacatgacatcctctcgttgtttgcatgtcactcagttagggtaggttgacttatacctggaagtcgtccatgatgtccttgagcttcttgccgaggccggcgacgacggaggtgcgggtgcggtcggtggaggagccggggccgcagccggggaccttgcgggaggtggcgttgtctctgtcgagggcctcgagcttgcccttgacggccttggcgcggcggagcacctgctcgacgtcgccgtccatgcgggagcggagggccttcacggcgcgggcgtcgtgcgccgtcttcgtctcctcgttcgtcgactgcagccgcttgtacagcgcctccagccccttcatgtcctccttcaccccctccacgtcctcgaagaacctgtccaggttcaccacgccctcgccgccggcctccatgtcgctgccgccgacgccgctcgccgggctcgcgtccgcatacttcttgaacgagctcgacgagaacaggtcgttcatctccgacgaacgcttgtggatcagcagcagcagcagcgacgaggcaagcggatgagctgaggagacgtacgatcggttggacggggagcttgaaagaatggcaatgggtgagctaccaagaaaggatatatggagtccgtccatgaaactagtaattcgacatgaagtgtagggcctctccctgcctatttgtggcaacgcgccatgcattcgcttcttggtctcgccactttcttgcccatctcctctccaatcatttgtacggcgtcaggcggttcttgtctttgtctcgggttagtcaggccgattcactcattcacacacagaattcaagctgattcacaaaactgttaatccatgttcaatagccaaatccatctgtgctacggcatgcaagccagggatatcattcactgccactttcataagaaacaaacttactatgtatctaacggtagaacatgaacatcactggttcacagacttcttgccttcatgattagttcagtagcccgttcttccaagcacttccttcttctttgtggagcatcttccatttctgtatcaagccaatcattttgagaatcatttgtacctgggattttatcaaagtgttatcaaacacaaagtcatttcttctaagtcaaatttctataaaaaaaaatctgctcccttttttcatgtcatataggaaaaaaattccattacaaaatacaaatatccacgttccttacttaaagctatgatagttgtaaaaccaaacaacgattacaaataagagtcaccacctctaaacaacgcaccagtggtctagtggtagaatagtaccctgccacggtacagacccgggttcgattcccggctggtgcaaattcattttttttgtcaaatttaaatggagccaaggctatccagaaactagaatcgagcctatctgaacgtgggaagctgcagtcccagcaaatattttttccctaaatgccacaaatggagcgaaggctatcaacaatcgagcctatctgcccgtgcgaagctgcagtcccagcaaacttcagatgtttcggtgcttcagctcggtcaaagtagaaagaccctgaggttagcttctctttgggttgcaaagctaaccagatcactgtatcagcaccttcatcgtttgatctcaggtttcctgataacctagcataataattgtaatacaagtttatgggtttgatgttaagtgaaaagcagatggatcaagataggcagtagttaggacttaggacagcagaaagccctacttctctgaaagcccaggcaggctcttggagactccaggtgtgtcagcccatcctggatgcatcgaatagaaacctacccccttgttgctgcatttttcagaccaccgttcggtgagtgcaacctgaatgaagttcatagattgttatattctctcaatctcataaagactagcattccaaataaagaaaccacttcgaggtttacaaacctgaactcttttgttacgggcatattgctgtgttccatcgaagttgttttcaccgaactgaagtataaacaatagtgaaaaaggactgttattgcagtatctgactactttcacatgctacttcatttttatgacaaaacaaaacatcatgattctatggtttccataactttagacatgcatatttcgtaaaacactttagatatgcatagaaagaccataataccattataagacaaaagatgaaaaggggagaaatgcaattgtacaaactctctgaaattcaccaaagctaattcgttttcagtgacaatcagttgaggaactagataaatagggtgcttgaattttgcaccacaaagtgaactgtatgaaaacaaaaaatcaagtgctccaccaactatattattttgttctgttttgctaacttcctagtgggccctcttagcaagttctactgtataaatatctttctcctaacaacactcttgcaaacttagaaacgaaaaaggttttgagaaagagaggcatgagcatgacaaacgaaaaaatcgtaatgattaagttttattttcacaatttacacattgtgttcaactgtggaataagagcatagaggaaacaaatttacctgcaaatccttgttcaatggctcggtgtacatacctcctgaagaaactgtaatgacacgagcatcaggtgctgctttctccaacagtggcattactagctctgttaaagtgtatgttgctgctacattcacagcgaaattgagctccaaccttttttatttttaaaataaaaggataagttatgaaagcaaacaagatatctggtttagtgagtacgaaagtaactaggggagaatatattgagcacaataaacaacagagtatcacgcacccttctggcgtagtcacacgcttgtgctctagtaaaccagcattgttaacctagaacaacaacccatatgttatagctggttattcaaaaccatgattaatgtaatttacaaaaaaactttactgaattatatggttataacataaaagaagcaacaaccagagacaagaaacacatatacgacataattttgaagaggcaaagctcaccaggacatgaagtggtttatctgttgaagagaattttgttgcaaatgatttgacttcactgatagatgaaaggtcacaaatctgcaacacaatactattgttgtgttagagacttagttcaggtatagttactgtacaacatcaccaaggtttattgcaaattagcatgcagtaaaattcggttctgaagcatcatgtacctccagatgaacattcatgttgccagttttagatcgtatttgactgagagcagtctctcctctttccttgttacggcaaagcatataaacagtggcaccactggaagaatacaaaacatgtgatcacaagaattttacatgttcagaacaaatcatcatagtaggaaaggtatagatccataccgtgatgccaagccctcggctgtagcaaaacctatgccggaattagccccagttactaggcaatttttcccatccagccggatctgcatatcctcctctctgaatttcttggcatgttccctgaataaaagaatcctcgttagcatggaacacaaaaataatgcagccatggtgtcaacaattgcatcctttgacagcttttcattcagtaccaaattgtgtgaaagttgttaacctgctacacgcaaatagattcctcagaaaatccttcgatactatttgctccagtgataactaaataattccggtacttattgatggacaggggttccctatctttgcactacttggcataatggcatcgaactacacataattcgcacaatgcagctataatcacagttattacatcacatctccaaaacgggccagagcagttgtatcctaaaattcgggattttcccttcaaaaaaaaaatcaggattcctacaggggatacagactatcgtttcacagctagaacacaatatcaataaattggcaaagctatagaaaacaagggggaaatcagccaggtgactcggtgagatcacgcttacacgaagccggatttggtgaactgcgtgaagccgtagaccccaaacgccgccgtcctccatgcttgcgcgccctcacacacacacacacacgcccacacaaccaaatccaccaaaattaaccacgcatacaggaggacatcagattaatggtgcgagagactagagctggagacatctcctcaccttctggatgaacatcttaattcctcgcttcgctcgctcgctcgttcgttcgttcgtccgcagccggcaggggggagggggggggggaatttgtcgcgtcgtcgcgcgctgcttgatcttccttgcgcgttctggaaggttcaaaggagaaaagcgcaaagaggagctcggaagtcaggcagtcaagcgacggcctcgctggccgattctgcgccgcgagccgtcgagccaagcggagatggccacgccgcctcccgtctccgacacggtggcgcaaggcgcccccgttgggccgaactggaccgggccgtgacagtctgtcgagctttttccaggattttgcttgggcttgggccaaacttttggggcagctaattggcgcgcgccccagtaacagctggcgcccccacgcggcactttctctcttctttttttttcgcgttttctttttgccatctttttcgtttttcttttttccgctttccctcccctcgcggtttttatttttgtttcgtgttttttccttatttttaatagttagcatacacttttttaaaaatatttgagtagaaagtttttaaatcttaacttgaaagttttttaatttgaagaaagtttaaaatctagagttaaaagttttcaaatctgagttaaaaattttcaaatctcgagttgaaagtttttcaaaattgagatgaaaagttgaaagtgactgcaaaaaattcatatttcgagttgaaagttttcaaaatttgacttcatatatagatttatttttaatctgttatttaaaaaaatatccctaaaaagaaaaatcttatcttaattatcgtcattatctaaaactaatgtattagttacgttagatgcactcgtcttgggaaaaaaaagttacgaaaaaaaggaaatccaccgtactaagtgcgcgttgccagcgtgtacgctccagttagcttttccgcaaacttttaggatagggcaaagtggatgggaatatgtctagtttatctccctcatcctcatttttactgttgatagagtcctctctccctcgaccgtaaaaccgggtataaccctataacacatcctccattcttagaaccggtgcaaatttacttcttcgctcaccacttcaccagaaaagcacataaaactcactgcatactcctagtatgcattgctactgtacaggatattttcaacaccttttcctatggctattaattattcatatatgcttgagcaatgatcctacaaaaaattgcatatgctgctcctatatagggttgggagacatcaggattgaagctttcattctaatatttaaccggacaactccggggcttccttgggcaggaattggagatacaaagccaacatcatatttcacctttgcaagggcaatcccaaccagagttgtgtgaaagagatggtcggcgcaacgcacctagtgaacaagttggaaatcaaccaagctgctctcattctgcaacttgagaccaggtttcttgtttccttggattcaccactccatattagtacccacaaggccacaacaacataaacaactccagtgtcagtacatttgcatcactatacggcctgaccctgccgattacacaagccaatgcaaagcatatgcttcttggaagagttctcatgcaaattgtgaccggtacagtgttagtagcactttcagtccaaacttaattagtttataagcataaatcatttagaagaaggtggggcatatatgattatatttcttaaaaatgttgcatctcatatatagtagacttccaattgatgggtatttacctactatctactagaaatcatgcattcggaccatatggtaagccttaatcaagtttgagttggagctcttgactatatttttcttctcgagtgtcgcgtgttgagttagatgaaatttgaggtaacgtaatatatactccctccgtccctaaaaaactcaacttctgctgtttgaattttgtcccactaaaagccaacttttaccatcgtacctactctcagtacataaatcgagaagttttatcctttcaataccctttatctacctatcaccattactacttttttcaataatgaggcatttgtcattttcattctttactaattttaccttggaatgataggaatggttttttttttttacggagggagtatatcattgtacacattccattgaatgtttgtgattcgccatcgaatgatatttttgtgacaattgataacatgattttccgttgtcggtaactcattcaatagtcatgttagctttctgtatactgctaaacccttactctgtagtctgtacaccccctgtcccataatataagggattgaagagatgtgacacatcataatactatgaatgtggatagactctttatccagattcgtagtattggatgtgtcacatccctccaaaaccctttatattatgggacggagagggtactaattaatagtgaatgaaatacaacatgaagcgacagttgaattgaagggtgcaagtatagtataagtactagagaaataaggtaggaagtcaaaagtgggtgtgtcaattgaagagtcacaactcacaagaggtggctagtatcagccacatggagaacatatatccatgtccatatattctcaacaccaacgtgtgaggattccacttacaagacatctcaacttattttcaacacctttctgtggtgatcatgtatgctcttgcatacacaccttagcaaaccagcttatggtaaggttgagaggcatcagaagagatgatcccatcccaattatgggatgggaatctctcttgtaaaggtctgccacttttcttaagcagagcacgatgagattcacataaagttgagttcatgttggttcaactttgcaaattgtaccggccctaaacactgtagccaatgaactaagcccattttaattattttccttctcttaataaaatcttgactgtcaatctatcaccagcctaccaaaaaaaaagaaaaaaggattataaaaatacatatatattatgtttgtggtgatttggcataatcgcatacggtcataagaagttaacatgtttagaacaaattgctatagtagaaagggcataaattcacatcatggtgccaagcccttggctgttgcaaaacctataccggaatttaccacggtcactatttactttctctgtcccaaaatataacaatttttaacaggaatagctatgctttgaacatttgatcaaatgtaaaaattattggacatctactttcttctccatagcacgtgcgcataacactcccatagtgttaggaacgggaacatgagtccctggtcctccggggtctttggggcatccgaggttgtatgttacgataagagacgtacaagatctacatcttcaagaaatgcgcagtgtctacatccccaaggtgccaaggagagggtacatacctacaagatttatgtctccaatatgctaaggaggcagacagctgcttggtgctactccgtcgaaggtgatcactatgaactccttcatcagtaacatcttcgagaagctcatccaaaataacaagaaaacctataaagtagggagagatcctcggtgccccgggcaagcaagaagccctaggtttgcggctgccccgaggagcagaggctgccctagagcacagtacaagtgactagggggcccaggtggaggcccaagcgcacccccactgcccctagctcattttggggtttttctccgcctctctaggtgggtccggaggtttaattccaaactaacatcatgatttatgttgcaggagggagccatttggagaactcatccaggtatattttagagatgtggcgccacatgtagcctcctacacccccacgtctaccgaaggaataggaggggcgcgatgtgtcacgcccgcatcactccagcggaattctaccttgtcacttctcaagggttgactggtgggccccacggtgaccggggtggagatcacctcgtcgccagcgccacttgtcaaccggagagcgaagctgttacatctgggcgctgattgccatggggacatcgaaaagactaagcatacccaactctttggagcggggtcctctcctgtattcatgcattggcattgtggactcttgtttgcgtataaaaggaggatccatgccaacagatagagggttcgattctttagcaattagagctcacacaagtcacggatctaattgtaactttccacattgatagtccacatacacagaggagtgggtattattcatctgtgtggcccgaacttgtattctcctttgcgtccatctgttccctgagggtgacttatgcttgacttgtcccttagccgaatcttcaaagaggggtcctcatttccccattgtgttcaagctcttgcactagatttatatgcaaattttaagcaacttgacaaatcactgtataaatcccatggtctgtttgtgattcaccatccaatggcattttatgacacataacatgatttttcacttgtcagcaactcactcactagcacactagctttctgcatcctccgaacttaactctgtactagtgaatgaaatgtaacatactgtaaaaggcaacaatcgaactgaagcttaccggcccgtatagtactatcgcaataaggtaggatattagagtgggttgccaattcaagctgtgacaactcacacgagaaatggctagtatggagtgacataaagaattcttttttctttttaanaataagataaacctggcctctaaattcaaccgaatgtgcacagccaaacatgaagattatgtatatcaatactttctccgtgtcaacaagtgtgagagggttccactcacacgtcgtcttaacttatttttttcaacatcttttctatggcgatcatgtatgctcttgcattagcggcttagcaaaccagtttatgctagggttgagaggcaccaggagagaagctcccttcccaatagtgggatgaggatcttccttgtggactttaactcctggtccgattgcatggttcaactctccaaattgcaccagtactggctagcataaaagttactggttactggccaattaactttgaccgcccagtagctattgcacttaagacattgcctactgaaattagtgtgtcaaattacgcagtgtcatgctgcagctacgagctctcatgttatattttttttcctcatgcaacttgttggtcctaataatcaccatgatcacccagtaacgtgttatatttttttccctcatgcaacttttttttgtctaccgtaaaatttataatggtatttttcatagaaaaaggagtcagccatattcgttcgtaaggtataagaatttttacactagtaagagaaacaaaataaaatctagaccattaatttgggtctatgtagaaataaaattttaaatataaaaaattaagactacaaataaataatattgaaagtagagtccatgtaaaaatataatatagaaaatatacgaaattcaaattaaaatagttcatgtagaaatataacatattaatatttgaaattcggatttaaaataactaatgttgagaaaatagtccatctaaaaatacaatacaatttagatatatttgaaattcgcattagtaataaataatatccaggtcgagaagatgccaagtaaagtacagttaaagagatcaattcaaattaggaacaaaagataaaacaaaatccaaattttgacactacgccagatcctcacacctttgacggcatatttgtgacgggcataagtgttggtcagtgatgaaagtcacctttgacgagtcctaccagatgccgtctttagtgagccatccagttttaacccgcaaaggggaagggcccgagagggaaaacccccaagggggggggttccccccccctctgggaggggttcttttttacacccctcacaggggattagcttcctctggggggtgcaaccccgatgggtttccaaaggggaggttttctcaccctaaaacgggtagaagccctaacccggtgagtgaggtggtgtacctattatttatatatatacccgagatatttcttctcccaagagataaggctggcttctccacttctctcgat

SEQ ID NO: 30212 - DNA, 2114 bp, Oryza sativa
cggatccggcgcctctcccccgccggtcgcctcctcctccgcccccccaccgtcgcctgccagatccggcagcagccgcctccactgcggcctctccccaccgcggatccggcgcctctccaccgccggtcccctcctcctccgccaccccaccgccgcctgccagatccggcggctgccgcctccaccgcaccgcaaaccgtcggatcaggcgtctctccaccgccggtcgcctcctcctccgccaccccaccgccgcatgccaaatccggcggctgccgcctccaccgcaccgccaaccgtcggatccggcgcctctccaccgccggtcgcctcttcctccgccaccctaccgccgcctgccagatccgacggcagccgcctccaccgcatcaccaaccgtcagatccggcggcctctacccccgaccggcggcgtcgtccaccatctcctccacccgctagcgccgccgccatctccaactcttgtaggttgtgcaaattttaattgccaaatttcagattgggttatactctcggttgcttgtgtggatttgtagtttattactcaaagttgtgtggatttgtgatgtatattacttgtgtggatgtgcttcatgtgtcaacatatctgtcaataaaatgcaaagttattgtgtcatgagggatcttgagatgttcttcatgtcatgagatatggcttgtgggcggctgaggcctgagagctgagagctaaaggctgagggcttttaatttttttttggttgattttccacacttgtgacgggtggtaagttgaaacctatcagaggtgtttatcacctttgacgggctgaaaagatccactcatcacaggtgagactcacctgtgacgggttattttgttcggtccgtcagaggtgtcaatcatcattgacgggctttcacccgtttgagatgaggtgtagtcatcagtgaccactaatgtaacctagactaaatccgtcaaaggtgagggttagagcccgtcacagatgactaggtccggtgtagtgtgatttcaatacaatatccaaatcaataaatatgtaaaagagcccttcctaaataggagtatggctaggaaaataatccatagaaaagtaaattttataaaagtaagaaatattagccactaaaatattattaaaaatccatgtgaaataaattctaagagtattttaatcaaagctatataaaagaaatcaagaatatttatgctcaattcaaattccaccataaaattcctcgatctaaagtctgaaataatcattagagttctcatcaaatataccatctctaaagtctataaaaacaaaacatgaacagtaaaaaataggcaaattttgctacaggacatcgcatcgcaattgtgtgtatttagctcacggacaccgtgaaactgaacatttggggaagacatcccataatcgtggatatttgcccacggacaccgcgccgtctcctctccacttgactgacctggcagacgggaggttgttttttggcccggtcggacgcaaatacccctcggccttatctccgatggcggcagcggcggcggctcgggtgcagcgtgcgaacccttcttctcgccgaagcgatcgcgcacaggggaagactcggtgtaggatgaatctagcgaggcgcataagaccagtggtgggggagtgggcggtggcggcgccggccagtcatcctccgcggtttcgtacgaggaagaaggggatgacgccgccgacctggggtagaactcgaccgatggctcggcgggaggatggggcgaaggggagtcgggctgcctcgtcgctgcgggtgcagatggtgccgccgagctacccagctctagaagcgaggggaagaacgaaggctgcgtcggtgggcctgccgcacagggagtcccatcgatcggaggttgcggttcttccaccctgggtcgctccttggtggcctgacctggagacggtggcaagatgggggtggcgtggtggggctgcggggatggctcaggtggagcgccggttggtagggagtggtctccttggagaggaggaggaggagaaggggaatgggatggcggaggtgaacccatgtgtg

SEQ ID NO: 30213 - DNA, 35128 bp, Oryza sativa
aggggtatttgcgtctgaccgggccaaaaaacagcctcccgtctgccatgtcagcatgtcaagtggagaggagacggcgcggtgtccgtgggcaaatatccacgattatgggatgtcttcccccaaatgttcactttcacggtgtccgtgagctaaatacacacaattgccatgtcctgtagcaaaatttgcctaaaaaatatcattaatcaaatttaccatctacgagcgagtaagtaattcttttgaatctccgttaccaaatatcgtgcctcagtgtcgttattaatgttggatctgctatagcgttttttcgcatttagctagtgatgctgattctgaggctggttttataacattaactgctccatttcaaactggccgcaaaattacaggcaagaatgtacatttgggtttggggctccatgctgtccatggctagatgtgtaccaatgatggagctctcgggaagtttagtgcccgagtttagttatgcctatttcatttggattaggctaccaatggatcagatattcaactccaagaaggttcagaatgtgagtctgcaatcaagtagtaaatcagctaaaatatactctttttttcaagtttattatgtactttgttaattttgttgaaccagaacttatcaatcgttacttatatatccactcatgtctatccctagcgttgaagattcaattacacctttatttttcgatcccacgttcgtcgtgttttatgcatctacccaccattgtacttagaatccttatacaatctgaaaaaaaccatgcacgtacatcgataatttcctgattctacccatttaaatctagttagcaatcgacactctgccgtcagtccatcacacatgcaaaccagaagagcacatcaaattcaatatatatattatcctagtttttcattaatttccaccatgcgacatacctcacatattttcaacacatttctgtggcgatgcttgagcagtgatcccgatgtaaaacattgcatggttcataggattgggaggcatcaggatggaagcttccactgtgatgtttgaccatgcagacagctcagggacatgtttcttcaggaattggagatacaaagccaacttcatggttcatctttgcaaggacataacgaaccatgcgtgtgtgagagagctcagtcagtgtaaagcacctgaggaacaagtggggaaacaaaccaaattattttgaattagcaacttgtaccttgggttcttttttccatgatcattatgctcaaacatgctacccacaacagaagaaagttcagggtcagtaaattttgcacctgtacctgacccaattgcttgtactacacaagtcaaaatgctcaagagtgataatgtgttattagcatttttagtccaaacgtacttggtttcttagatgttacaattgtatgggatttaaattgatgtgcctggccccgttatctgctaaaataatgcattcagaacagacggtaaagcatttatcaagttgagttagagctcttttagtacatttcatcgagtgtgtcatgttatattagatggaaattttaagcaacttgacaaatcgttgtttatacattccatgaagtatctgtgattcactacccaatggcattttgcgacaatacataatatgattttcctatgtcagttactcattcaccaggcacataagcagcatcagttttctctatcctgccaagcccttaactctgtaccagaatgaaacacaacatgaagcaataactgagatttgaaaatgtaccagtatagtactagagtaataaggtaggaaatcaaaagtgggtgccaattgaaatatcacaactcacatgagaaaggcctagtatcagccactaagaagaacaaccatatccatatatacccaacatgtgagatgattccacactcacaatgtcatggtcggcatcacgtatgagcgcagacggcgcgcggcgaagacggacgagcagcgtgtcggatgagaaacagtaccgcgcgaattgctagcgattagtttcagtttgttttgctgttttgttatccctttcttttagcaagattagttcaatgtaaggctatttagagccacgaatttatggttaatctaagcaagattcaatctacacttctcatcccattttctctgttcccttcctctgttcctcccactcgccgtcatgggcagggtaaagaggctgccgaagcctcgccctccagtgacccattcatatccaatccgttccctcgccggtgctcgtaacaacttggtatcagagaccatggcaccagatcaatcctcctcctccacgcagccatccactgatgccgacgcactggcaaagcttcaggaatccatggcgacggtgttgagcggcatttcgcttttggcctccaaaagtgacctcgccgatctcagccgttctgtcgctgtcgcgacctccagcatcaccgccttggagcagtcttcctccacttcctctggtccacgtctgaccggcggtggcctccttaaatcaccaccaccaccacccccaccactccccaccacccccaccaccacctccgccgccacatgccagacacggcgcacatcacgatgccaactccggcaacgcagttcctcgcttttacaagctcgaatttcccaagttcgatggctccgacgatcctctcaattggcttaatcactgtgaacagttctttcgtgcacagcgttcgccggatggggatcgcgtttggttggccacataccatctcactggtgccgctcaggagtggtatttccactacgagcaacacaaagggccgcctgattgggacacgttcaaggagctatgctatgcccaatatggtccaccaatccgcaacaacccgttgggtgaactcaagcgcctctcacagtcgaccacggtggccacctaccagcagcgcttcctcgccttgtccagccgtgtgacggatctcctcaccgaacggcagcaagtccaactgttcacggtgggcctccgcgatgacatctgcatcgacgtggagctccatcagcctgaagatcttcaggaagccatggggttggcacgtgcgtatgaacgcaaagccaacttcagcccatcgcgcaccgtcagcaagcagttcgtgcgcacggctgcgtcgactccggccgctagcgcctccccggctccgacggcagtggccgccgtgcccaacgtgaactctcgctagtttcgtcgtctgacaccggcggaactcgcggagcgccgcaaacaagggctctgctacaactgcgacgagaaattcgtccgcggccaccggtgcgcacggctcttctacatcgagtacgacgacacggcggatgatctcgacgacgactcggccgacaaagatgaggacactgagccacacatatcgctgaacgcaatcttgggtgttgatggcgccaacacaatgcgcttggcaacccgcctcgcgaacgaacaggtggtggccctcgtcgactccggctccacccacaacttcatccacgctgaccttgcgttccgcctcggcattccgctgtcgctggtccgcgatggtgtccgtgtggtagtggcaaacggagatcgcctcaccagccccggcattgcgcgtggcctgaacctgcgtgttgccgacgaggtattcgacgtcgactgctacgcgctccaccttggatgcgtcaacatcatcctggggacacagtggctacgcactcttggaccgatactgtgggacttcgtcaacatgcggatggcaatttggcgcggctgccgggaggtcatgctatacggcgtcctcgacgaacgcctcgcgtccacatgcgctgcgatccacgctgacgatctccttctgtccctattggcggaattcgacgacctcttcgcgcttccaaccggtttgccgccggcccgggccgtcgaccaccgtattcacctcaagactggtgtgtcccctgtcgcggttcggccgtaccgctatccccagctacagaaggacgagctggagaagcaatgtgctgagatgctggcccagggcatcattcgtcccagcacatccccgttctcgtcgctagtcctactcctccgcaagcatgacggttcttggcgcttctgcatggactaccgcgtgctcaacacggtcaccgccaaggacaaatttcccattccagtcgtcgacgagttacttgacgagctccacggcgcgcacttcttctccaagttggaccttcgttcggggtaccatcaagtccgcatgcacgccgatgacgtccacaagacggcgttccgcactcaccggggccacttcgagttcttggtcatgccattcggcctgatgaacgcacccgcgacgttccaggcactgatgaacactgtcctcgcgccgttcttacgaaggttcgtccttgtgtttttcgacgacattctaatttacagaaggacatgggccgaacaccttcagcacatccaagcagtgctcactgtcgtccgcgccaacaacctcgtcctcaagcgctcgaagtgccacttcggtgaacgccagatcagctacttgggtcacgtcgtctctgccgacggagtggccatggacgcgcagaaggtttgcacggtggccgactggccgcgtccgcgttctgttcgcgccgtacgcgggtttctcggcctcgccgggtactaccgcaaattcatccgcaactacggcacgatcgcggctcctctgacagccctcctcaagcgcgacgcattccagtggacgccggatgcagcccgcgccttcaccgagctcaagcaggccctatcgacggcgcccgtactgcaactgccggacttcgccctgccgttcatcgtcgaatgcgacgcgtcggggtctggcatcggcgccgttctgcaccagggggcgggtccactcactttcttcagccgggcacttgcgccacgccacgccggactcgccgcctacgagcgggaactgatcggcctcgtccaagcgatccgccattgacgcgcgtacctgtgggggagggcgttcctcgtccgcaccgaccactacagcttgaaatttctcctggatcagcgcctctcgacaattccacaacatcgatgggtaagcaagttgattggctttgatttcactgtggaatatcgcccagggtgcacgaatgttgtggccaacgccctgtcgcgtcgcacagaagacgccgaaatcgccgccctggcgctctccggcccaacattctcggcattcgacgaccttcggaatgaggtggctaccgacggcgacctcatcaagatcgccgccgacatcaccagcggcaagctgagcgcgccttgggcactccgtgatggcctcatcctccgggacaaccgcgtctacgtctcggcgtcttccccgacactgccggcattgctcgctcatgcccacactggccacgaaggagtcaaacacacactccaccgattccgggcggacttcttcacaccccatgccaagcaagctgtccaggagttcgtacgcacatgcgccacttaccagcggaacaagaccgaacacctgcacccggtgggcctactccagtcgcttccggtgctgacgcaggtctgggaagacatcgccatggattttatcgaaggtcttcctcgcgtccacggcaagacagtgatcttcaccgtcgtcgaccgcctctccaagtacgcccatttcattccgctcgggcacccctacatagcgacgactgtggcgcgtgccttcatcgacgaggtggtccgtctccacggcatcccaagctcaatcgtcagcgatcgcgacccgggcttcaccagctcattctggacggagctcttccacctggcgaatgtcaagctcaacttgagctcagccttccacccccagagcgacggccagtcggaggcagccaaccacgtcatcggcatgtatctatggtgcttgactggtgatcgtccccggcattggctacgttggctgccctgggcggaatattgcttcaacacggcattccagagttccctgcgttcgacgccgttccaggttgtctatggcaggccgcctccagcgctgcgggaatatgaccgaggctcggcacgcgtctgcgcagtcgaccaagccctcatcgagcgggatgactttttgggggaaatcagggagcgtctactccaagcacaagactactccaagctgtactacgacgacaagcatcgggaactcgcgttccaggttggcgactgggcgtgggtgcgccttcttcaccgtcaggctgcgtccctgcccaggttccgtcgtggcaagctggcaccaaaatattacgggtcgtaccaggttagcgaccgcataggcgatgtggcttatcgtctcaagctaccggccggcgcacggatccacgacgtcttccacgttggcctgctcaaggaattcaagggtacaccgccggaccaaccgcctgctctgcctgcattgtccaatggccgtgttttgccaatgctggcgaaagctattcgtgctcgtttggcacgcggtgtgcgccaggttctcatccagcgggaaggcaagccggctgcagacgcgacatgggaagacgagacagaattcaggcacatgtatcctgcgttccagctcgaggacgagctatttacgaaggaggggagagatgtcatggtcggcatcacgtatgagcgcagacggcgcgcggtgaagacggacgagcagcgtgtcagatgagaaacagtaccacgcgaattgctagcgattagtttcagtttgttttactgttttgttatccctttcttttagcaagattagttcaatgtaaggctatttagagccacgaatttatggttaatctaagcaagattcaatctacacttctcatcccattttctctgttcccttcctctgttcctcccactcgccgtcacgggcagggtaaagaggctgccgaagcctcgtcctctagtgtcccattcatatccaatccgttccctcgccggtgctcgtaacacacaaaccatcacaacacttgtttttcaacacctttctacagcgacaataaatcatcgaaacttattttcaacacctttctacagcgacaatgtattctcatgcatcggttttgcttagcgaacaaatttatgctagggttgagaggaatcaggagagaattataaggatgtcttctgtactgaaggtctgcacctcatccagaacttgttcagttgattggtatatcacacgatatgccagttgattggtatatcacatcttctggtaaatgaatctgattgccctgtagtttttttacttactgtgtagtggaattgctctcatattatttcttccactcatgcgacttggatgtcctactcctaacaatattgtacagttttagtagaaaaaccaaagcttctttcaaaaagaaatgaaaggcttaactttaatgtgatgacttagctttgtcaacaaaatatttcaagctatgtactcattaaaattaactcatcagttctttctatatattccatttaaaaagtaaatcttctattacaatcatttttgcttgaaagacaggtgcccaaaaggcgtactttctatgagttttggcgttcctttggttcgaaacctaaaattttgttctacaccattatgttgtctaacatcaacagccaacataaccaaacttttttaatgccgaaatctgccattgttagctagagcaaatttagtcaccaactctactggcccatatttcgtcttggcagaaggtacaaaaccgggccgaattaggaacctatatgggcccagcacatatatgggcctaattaccctgataccctcgttgcatcgatcgaccaactaatacaccaaattgcctaaattcttgtccttaatcagttaatctgatgatttttagactatacaatccactgaagtggagtatatcttttttgtgaaagatcaatatttgtgatcaatacttctccatttattagtgtgaaagatcaatatttgtgatcaatatttctccattaattagtgcgtgtacccggttgctgctccggccagcgtgattgtttgtgaaatcgatgcataaacttcaggaaaagcaaccaaaatcttgccgggggatatgatgctgctccgtttcaaactggctgcataattacaggcaagaacgtacatttgggtttggggctccatgctgtgtccatggctagatgtgtaaccaatgatggagcactagctatctatattcttggccatttcttaatccacacaaccaaagcttagcttaattagctagcaaactagctacacatgaagccaagtggatactggtaactgatactttgctagcttagcttagagggcccaattaagcagctcactatatctgcttagcataattaacctagcttaactattaccaccaatttactaatgctactgtcctgtatattaatagggttggattcttggtttgctctcgctgatgcctcaagtactcccactaatcatttttttatgctgctgctttagataagcaaaaaatcaatcaaacaattaattaattggccatcgttggtttcctcccaatctgtatagaaaaaacaggcgctgccacgtcggcacagcactgcgccggtatcgggagacgaggagaaagtggagttaattattgtgcctgcttgctaaactcgccggataattactgttagcgccgctcgttggtgttaaccccttgtatttacgcactaagagcatactattaaccagctataaacatattataataagataaaaaataagagagaacggagggttacagatctgtagctagctgcagcacggactctaagacaaaatttatatatgataggtggtaccatatgttaatagtatagtaagcaactattgtataaattaactattagattggctatagataaactagagctagtagtgagctatactattaaacttgctctaattaatcctaatccagcggtaattaattaggagtgatttaggtttggtaggactccaactcctaatttaaactttaggagttaagttatagagtcgtctaaacccagtttcacatttctagtttattttataaaagcactcaaccagtttcactcttatttttagtgaagctaagatcatcatttggttaaactctaaggaaaaataaaaccggggctgaaacttaagctgtgtcaaaaagacccgcgaagctaccaacttgtgcgttttgtaggtgtggacttggattgattcctaccgtagaagagaagcgatgtgttgcattggcttacacctggctgcgtcgtggactaactgcacggtgaacatatatatatatatatatatatatatatatatatatatatatatatatatattgcaatattgcattgtccggcacacaaacacaagggatcgaggcaaatgcagttgcatttgcatcgatcgacgaacgacttaagcttgattaattagccgtgccgagatttgtgcagggtaacaggctagccagctgcggcatccatgctccgtgtcctgttcataggtgccactcatatcgccgtgttaacacgccatgacatggtactggtacaaattgaaacagcctcttatgttcatacttcttcatggatgactatctcaaatccacagttcagcatcatctcttgatgctactccctccattctaaattaatctatatataatattttttaaggttatttctaaatgatttacatatttatattcattcattaagtctattcgttatttttatattagagtaaatggacattgatacatgcatccatgcacacaactatttataacccacatgcaatattttgatttgctattggctaaaaaatagtagggatgttacatgcattgagtttgttgctaggtaaatataatactcccttcgggctgggtttattagtcgtttcggacacgattttaaaaaccaagaagtcatatccctattaaatatggttagatgtagcatgcaagcaagcaacaactgctctctcagttgatcagttggtttagagctttcatgttgttgtcttgggacctgagttcgattcctggtctagatacataccttttttttctgtcttggcgattttgcatcgcaccatgcatgcatgcagcccatgcagcttcagtacagatagcgctcgagggcatgcgaaaattaaatgagatggaaaagaagcgttaaaaggagtaacaaggagataatctgagagcaataacaccatgaatgcacaagggcaatctcgtctcatgcgtggcaaaaatgctccaataacaaattttcttatccacagctaaccgagccaaaacgactaataaaatatgtacctataaaatatgtagatcaatttagaatggagtgagtaattgattaattactgtgacagcagcttgaccgaaccgtaccagaagtagcattagagggtaattaagtacaagtacgggaaggttaattaaccacggaggtcacggtaaaaactgcgtgaaatctcgtgctgggaggatgggggcgaggcgcagctgttcctctttcgctgggcaagagcgcagtaagtaacagtaactagcagctgccgacgagcaggagcacacgcgggcctcacgtgcgcctccggatttcccaaggctttcgccgtacgaccatggccaaatgtttaaagctcgtcgtcaggatgcatggccggccggggatagatttgggcttccatcggctggggtcaccgacagcgtctctgcctcgtccaagtattgcccaaatgaaaatttctctggggttcgtggagttgttgccaatgcaaagctttccgtggactttgaagtctgatgggggttttgattgcctgagttttatcaacgtggttgagaaaattgaaaaggttgctgctcttggaaaaaaaaaagttttgtgctactttctctattttattctagcatttcccacattcatattgttgttaatgaatctagatagatatatatctagattcattaacatcaatatgaatgtgggaaatttattttgttgttaatgaatctagatagatatatatgtctagattcattaacatcaatatgaatgtgggaaatgctagaatgacttacattgtgaaacggagggagtatttatcattatctggtttttttttctaattgttactccctccgtttcataatgtaagactttctagcattttccacatatatatagatgttaatgaatctaaacacatatatatgtctagattcattaacatctaaatgaatgtgagcaatgctagaaagtcttacattgtgaaacgtaagaagtaaaaaaaaacctaatgataggagctctactgaatgaaaatattaagaagagttagtccgatttataagggagattgggtcgaaaaaccttattgcatggttagaatacgaaatacctagcaaaccacccggagagcgaaaaagaaaaatcatgtggcaacataagaactgaggcacggcaaaagtcatcgttactaagctcatcacaggcaagcaactccaaggttcggcttccagtttgaacaactctcaagaccacctagtgcaatcccaccaaagagcaagactttctgggcgaagccttcaagaaggaaacaacatccataatgctgccaacgcatgtccgaaacaccggacatgtttttcatatgaagaaagagagagctactttaacaatgctcccaagagggaagacattgcccacaagcgtcgacgtcaccaaggccagtcagagattggatacggctttcgccttggacactctcaatcgccgatcatctttgtgaataggacgaaacatgttgtgagttatcattgccaagctccatagggcaccaccccagctctcaactcgtcacccggcagcaactctgtcgaaacaagattttggcaataataaaagggggtggctatcaagctgaaaaagtggatgggtttagagacaatgaattttatacaggttcaggccttcttaataagaagtaataacctactcatgtccggggattaatccgctgagtgtattattgatcgtatgatctgggagaaaaagttgtgccccaagaggcacccggacccctccttatataggggaaggggtccgtattacaaagtacagcccatatccctaacggaataggtagttatagataagatacaatcgtaactgactaaaatcctgggtgcttccttgatatacaagtttaggaatttaacccgaaaccctttaaagatattctatctatacatggtacccccatacccagtcggatatacatgccgtgtgggtatagggtatccataatcttcacagtagcccctgagacctttacagtcgacgaaatagtcttttcttgtaattcaaaaggataatccgagtactttaacttcttctgcattggtctcccgagtactgaaatcaaagactgtgaagggctgaaaataaaaaaatcaggtgcatcgactagatgcacctaattaggtgtagcccctgactatgtgattagttgaataaaaactaaacatatagtcaaggcacattaaacatctatccgagtggttcaaggtacattacaaccgaatcactttgggaattatatatttaagctcaagcagcagttgataaaatacccagctgactgctttagccataatacgcccaaaaaaggcataaagagacccgagtgaaaagcactctaaagatctataaaccaacatatatgacaagaatctgagtaaaaaacccttaaagaattcatcaactgttgtataaagaatgacaaatgacaagtcaaaatagcctaagttgtgacttatgtcaatatcaaaataagcatataacatgctgagaggatagccatctgaaattagccaactcaacaaaacccaagcagctttgcaacctaaaaaggtcaacaaaattagtattacacttttctgccgggcacctttttatttcgcattgtagcaattccaaagaattatctaactgcatcaaaaaggattttaacgacattgggctattatgttgtgagcaatttttatcaaggcaaaaatatatgcttaaatccctaaggaacacaaccagccacaccaatagtgaagttgggctgaaagcactgtgcaggcctaggcccattagtacctcccgataccctaacaaaaaacgctaaccaagcgccgcttcgtcttccccgccgagacctccgccactttccctattctctgctacagtacaagactgcactggcgaaaactagggtttgccaatctgcaccaatccaccttctcaaggcttcgtgcttttgcaaagatctcccgcacaaccaccgcatcagttccctttccaatcaccaccaccctcacgctagatttcatcatccattttgcatccatggcggaggagagagaaagctttgagagtcaatgggctccttccgatgtcacggaagaaaacttgaaggaaatggtggcgcgcgtctccaccactccataggcaaacaacactactccatccactccaaaccacggtacctgaaagtaagaagataaaggttatcattgctgagcttgccacctggccaagcaacttcgactctaccatagctcacaaatgcttgctagcgtggtggatacttccaaacaccgccacctccctgcacggaacctagcacaagccctttgtgctgcaaacttcaagagagcattgtcgatgctgaaggtcacttatcctccaccaagcaggcaccaacttgaccaaaccaccaccttccttcgtgccatggggctccccacggccgaagtctggaagcagaccatccggaagagggggatgagatccaaggtgaggggaatcacccagctaccctaggggttctacttgctatccttcaagccaccaccagcatatattcccacgccaaccgtgatctcaccaccaagccacccaacagccttgcggtgagcagcatctatagttttaggccaccccgtgcagccatcccccacaccaactcctgcagtctccctacaccaacaccgcctagcaacagtgccagacgacttgagtgacagcttttcaactcaaactctgacttgtgcaccattagagacagctccaactctacttcttgcactagcacacacaactaccagccatcaaagacagcgctgcttgttactatccccaagctgctccagacgacaccacaacctcaccccaagctactgtcaccaacaaccgccaaccccctagattccaaccactccaggagggtggccagatccactcgtcgctaccaggaaattattgtcttcaatgtttgcctgacaagccgcaagccacaaaccaccaccattgctcacacacctcctgggtctcccacacctaaaactcctcgctgttgccatcgtggatcactagctcacttcggtgtcaacgggttggacgaagcaagggaggggcaacgatatctagggcctaaaagatcggatcttgcctagatccaacctaaaagatcggatcttgcctggatccaacctttcttgccacatcgagctgtcacctccacgtccctggttgcccttaggatgcatccatgccttggcccaatcagcaacctccagcagatccgtcgtgcttcttggatccacgaaaaggagggaatcactatagtccccatccttactgccgcacgatttttggtggtcggctccactgacggcgagagggagggagggaggaaggaggggagggccggcggagggcatggacatgattctgagaagcagcttgtaggaattcaactagtgagaatatgtagaaatttggtctctaattcattttctggattttataacagcagcttcttgtaatcttttaaaaaaccttactgtttgggaagattttgatcctagaagaatttgtagctgctagaagctactccaaacacactcataatcagtaaacttaaatatgatttttgtcgaacaaaagaggaagggttttgccaaatacgaaggagaaattttgagtacaaattaagggctactctactcaatcacaccgacaatagaaagctactccccctgttccaaaatataagaaccaagaactggatgagacatttcttagtgtctattcagattcgtagtactaggaaatatttcatccaattctaggttcttatatattttgggacggatggaccaattctaggtttttaaattttgggacgaatggaatagctaaatataataagtgaagaggttagatacttataaaacgggattgtgcttttttttgctctatattgtgtctataattgttgaagtaacattagtgtttttctctaattgtattatactactgcgcagaacaattatatacatgttttcgtgattaagattaaatgctaccaattatggaataacacagcttcctacttctgttgtgtacactggtccttccgtttcagacactactacatatcgtttattaatcgatttttgcatgcggatgagtggcccgcatgtacccagggtatgtaaaaataggatttttgcatgcgggtagagcaatcgcacgcgaaaatccgattttcgcgggcgggcgcttaagctgcccgcatgcaaaaatgaaaaatcgccaaaaaaatataaaaattccgaaaatcaaagctctagccctcaattcatccctaaaacctagctcccgaagccatcgtcgtcgcagccatcactacagtcgtcatcctcgcaatggccatcgccaccatcatcgtcgtcgtcgccaccgcaaatctgtcgcttccatgggtgtcgccgctgtcccaaggccaccgccaccgctcctaagagcaaatctgtcgcttttgtcaacttcagtggttgatctacccagtccgaggctaccgccgccgcacccaaggacggggatgtcgtatccgccccaagctggcggcggatccgccccgaggtcgttggatccacgcgccccccgagccagcggccgtatccacgcgctagcattgcctgcccccaaggacgccgtctccatgcgccccccgagtcgagacggtcatctccgcgcatctgcgccacccactcccgagccaccgtccccgccatgtgtaggccgggaaatggaggaaggaggacgagaccgggaaaaatgtaggagaaggagaaggaaagtggaggaaggaggaggtggccggggaaagtggaggaggaggagaaggaaagttaccgagagaaagagggaagaggaggaaaaggggatgcggacaagctttaagaggagggaatttagacatctaagcgggcctttaagaggcccgcttgcgaaaatatattttcacgtacggccgcttaagaggttcgtttgtgaaaataactagatgaatctcttaaggggttacatgcgaaaatgcattatctcgcatgcggcccctgaactatttcttggtggagcgattcttcatgcgcaaatagtagtgatatataagcgtccagatggtccgcatggaacctaaaagggttctcgtacagaaaaaacgtttgctatgaatctggataaccgtgtgtccagattcatagctaaaagttgttatattttgggacggatgtagtaatcaatatggacggaaggagtacttcatccgtcccaggatatagcaacctatgattggatgaaacgtatcctaatatgatgaatctggatatagacctatctagatttgtagtaatataatacgtcttattctattatagtttgttatattatggggcgtactcactccaccaaaaaacgaatctagaacggaatgtgacacattttactataatgaatctggacgatcaattgtactggaatttgtaacatctagttttatgttcgtcttttataagatctagttttatattcgtcttttacaagacggagagaatgaggggagtaaaaaaaaaaagcattaacgggtcgggtcttgttccattagaaacaacaattcagcccagtaatcggatggaccggaactcatcccgtgccccgggattttgtcccgtgcgggtacagtcagaaaaagtataaaaacaaccttaaaaaatgtcacttccaaataaaatatttctctcagatgccagacacgccgggctacgagctaggtcctgtccagaaattagtttctttcaacgtccattcgatctaaattattttacccttccctatttttcccccatcatgttcttttctgggagtacatgtcctccatcttatggacattattgtgtttgctgaaactaccgctatcagtagtaccaccatttgatttgattaaggcccacatgtcatattcaatatatacttatcggcccatcgattcgtttattcggggaataagcgaaacgctatatttgcaaatgaaaaatagtttatgattaaaacttttatatacgtgttattagcgatctgaaaacaaaaactgaaaaataaacttcgatgaaaaaccctaaaatcaactctaaatttaaagttgaaaatttaaattttagctaataagtataagcataaacgaaaagatgataccatatgtttgacacgaagtttggtaataaaattgcaaaaaaaggcaaactctgggttttcgtgtccaactttgactgtccgtcttatatgaaatttttttataattcgtattttcattgttgttagatgataaaacatgattaatattttatgcgtgacttgtctttttaaatttttttcataatttttgcaaataagacgaacggtcaaacgttggacacagaaatcagggtttgtctttttttggacggagggagtagtttgtaacaaaataattcattatgtggttcttaccatgttaaatattgttccactagtcaataacactcttgatattcatccaagtttttcacattttgcagttttatgttttggtgactaaatattcgtaaattaagttgaattattagtttagtcaattaatcagataagtattttgcagatcattttttttcataaattagcaccaacttcacacacaaagcatcacacaagaggcaacatgatgcaagtacaaattgctgcatttttttcttttctttaacccaattccccaaacccacccacctccaccctcttggaaagctcacccagtttttttttacccccatagtctcctgtgcacaattatcactcctcttctcctttcacccctcttcacacacaccacggtaaaaaaaaaagaaaagagaaagaacagagtaaaaaaaaggaaagcacagtaaataaaaacaaaggcatccaccacagccccatgtgtgactttagaccaaattaaaccagtggtgctgtgcctgataacccatgagagagggaggggtgtattaggaaaattttaatcaccgtttaagaatcccaaaacttagaaatgggcgctttgcttgcctcccatctctctctcattaacctcttttactttaaacacactcccccatgagatgagcaggcagcagccagcagccagcagcctgcttgcttgcctagctcccaatatcatcaaatttttgcccttcccaaggaatcttacccaagatgctctggattggctacaatgccccagggcttgggtggagaggttgtgaacatgacctagggtttggagggtaaatatggtaactagtgggtatttagggatttgcaaggttgggattagcaataagcggttttaggttattggttgggggggtatgggctgtttgctgtcaatcccaacgggtatccatgggcttttgcttggtccttgggtccattaacccaaaagcccaatgccacttcgttttttctctttcatcctttaaaaagaaactggcgggtttttccacgttcagaattagattttatatacaatcgacatatttttctttttcataaatatgattgtattttctatccaatagattttaaaagtatgattagatttgatatatttctcttagcttatgttccatacctacaactgtgttttatatataatagaattttgaagtggtgttagatttgatacctctgttttaaattgcacgtcgttttaggtttatcctaaatcaaatattttagtctttgaccatcgatttgtataaactcatatagtttaacataatacaatttatattttagatttattataataaataattttataatatataattgttgttaaactatacggagttttaaaaattaattatcaaagatagatgtgtttgacataggaactaataaaacgataagtaatttcaaatggtcagagtacaattcttgccttctgttttaaatatacaattatattatatacaactacatcgattaatctatatcattaaaacatgtagttaccatgtgtaacgatcaaaatatttctctttttcttataatccaagaatttatatcccatacatatatgtgaagttggtccctccttttcgagctatcgttataatatataatagatagattataaagaaattcaattggtgtttaagtatattgttcaatcatgtgcattgcgtgagaatgatcattgtttcttgctgacaataacggcatcttttaagatcatttctccatgttatattaaataataacataattgtcttttaaactcgagagctgtaatccttacttcctacatttaattctatggggggtattttaatgcaatgtggtcttcaaaattactcccactatctaaaataagttattttctagatacaaatctaaacaagtgcgtcaagattggaaataagaaattaacttattttaggacgcgatacgtagaacatactccatccgttacaaaattagttcgttttccagttttccctattccacacatatcaataaagaaaactaacatacccctaatttatcaaatcacaatacaattattcctcactttatatacttctttcatactttcataaacttcgatgtaataattacttaaaaataaatttgttttggaataaattaagtgagcgaaaaataaacttattacaagaagtttaatagtatagccaactaccagctccaaatcatatatagtcaatccaatatctaattcatataatagttatttataaatatatattacaccattaatatttggtatacctctaagatatacaaaacatcttagaatcagtgttgtaactgactacaaatatatagcgtgcttctcttctctctcctttcttatcttctccatatgtttttatagtcggcttgtagtccactattatacttgctcttattaaatggagtagctaatttctcttgcaaatcttcgtcgaatatgcctggacaactaacaaagagtaaaccatccttccaaatatacttatactctctccgtcccaaaaaagcttaccctaagagtggatgtgaccaatgtgtccccttctagtacaatgaatctaaacacattctcttctaaggccgagtttagttccaaactttttcttcaaacttccaacttttccatcacatcaaaactttcctacacacacaaactttcaacttttccatcacatcgttcaaatttcaaccaaactttcaattttgtcgtgaactaaacacaccctaagttgagttttttttggacggagggaatatattgtctagctagtgtgcctaggttcgtactagtggtatgtcgtttatagccattggaggacacatttattactttggaggatatatcaaccgtcctaatttacaatttcgtaggataccactatgcaactccgtactctctctgttccattaagaatctaattttaaagaaaaatttggactactccctccgtcccatcaaaaaccaaccttgtactggatgtgacatatcctattactacggatttagacatattggtgtccagattcattgtaatatgatatgtcacatccagttctagatttgatttttttgggacggagggagtattctttaggattaggttttttttttggacggagagaatactccatactactgccttgggtgcatttacaattttgctagttgatcgaattttgcaaactttgatctttttatatatgatcacaccttacaaaatttggctaaccgaatatctttttagcctacaaacaaatgcagtttgtaatgataattattaaaagcaatctagagaaagcgtgctgcttaattagcagatgcaacccctattttccggggctttctcggctacaatactacccgtaaaaggtgaacgtttttttaagatgaatagagtttagaagacagtattagtaggaccccatgttttctacttttctttcatcaaacaatcgccaataatcactcattcactcgtgatatctaagcaacgtaccccagtttgacctatgctcgctagtgattggccggccatgaatagaatggggaggagtctagtatgaccaaacaagaagcttttctcttctttttattatgcgaaactgaaactttcctcaatgcctaaacagaacaggaaagacattttttttttcgattagggagattatcgtagagacgctgacttgtgggccctactgttggagaatggacaagggagtgcggctaacccccagtcacatggcacggctgacggctctcctaggtttgctcgagtaagattttatcccggatacaatcccccaatgccttttgtcagtggtgcggttttcacatgcttgtcgagttgtcgtgatgatctcactattctttcgtgtaaactacaattacaaggtctatatcatatttacgggataattctctccgatatatgtaattcattattgctagttttaggaaaggtttagtaagaagaaaggaaaaaaaatgagaatgaactagaggtatctttgatacctcttcaagcctaagtgtttatattgaaacaagatgaacatttcaaacatgcgggaaacgatacgtaggtctatcggcttgtctaggttaatagggccatccatgagacctattgagtttctgtaagacaagaagttccgtcataagcacctatcgaccttgccatatgttaacaaggctctcaataggcaccgcggatgcaagcgggccaacccgcggggtaacccgtagattgactcacgggttacctactaattcaacctgtaaatgagtttatgggtcgacccgcttgcatctctaggtgcggtaaatagggccacgacgcgaaaacccatgggttaccacttatttgacatataagaagctagatttgtaagtcagtccgtttgcatccccgcagtgatcatcctgtcgtagattggcacggctcgtcacatcattactagctagatgctctgaaatcatgcttcgttatgatggtttatcgttattgttacgatgcattgttatgaagaaaaaatataagaaaattttgggagaatttttaaacaagaagtctccataatccatctcataaatcttctcgatggtatattctccctacatacaccaacatcagtcgtactcctactaggtctaaactgcttatatacataggctacccattgtgtatcgagctacgtctttttatccgtagtcaataacttgcacctttatggacttttgtctttacaaaacatattcgatgacctaaaacttttgtcttcacaaaacctaaggatactttaagcattacgaaaacctgaaattttgtgtaatcctcattccaagatgtatcttgtgctatattttctcataacatgaataccgcattctcccaaaaataccaaccgtggtcatattgctcgagggaaactccgtgatcaccacattttattctagcgagcatgtgacttctaaatgataaaatccactcttcgttatgaacatgaaaaaaaccctctcaactgcatgcatatcctttttcctgaatttttattacctttaaactctttttattcaaattttaaaaaaaatcgcaactgctaaggaaaaacactggcagtaaaaaaaaaaccacaaccttcatctgaagtttttcatcctcattttgctgacgcctttataaatccatccaaaccacactcacgagggtggcttggcttacttgttctcgcaagaaaagaaaagaaaactcacacagtggcagtaaaagtccaagcagcaagtgaccaagaccccaactattaaacaacaagtgaacactaaacacactcatcccatcagcagcagtagcaaattagcaatagccccccgacctagcttgagacgacctctcatatcataagttcataggctccattaaatatactcctcctccaacccccgagacgcgcagataagaccaaatcgaccgaggttttaaccctaatcaaccggggttttagccaaaaacacattaataccactactaccggagagtgagcgagtgtgtagcagcggcgacagtagcagcagcaacgcctccgctcgctcgatcgatcgatcgatccatctcctcgtctagctccatatgcgagctggggtgcggcttaagcaactccagctcaaagtaatcttctcactagcaagcaagctctctctcatgtcgtgaggtgtagattaggggggagatttgttcttcttttttggtctggttttttttgtggtttcttgatcggtttggggggtaatggcgcaccgggcgaccggttcttggtggtggtggtggtggtggtggtgttgggggtggtggttcgcccggcgccggccctgtccgcggacgggaaggcgctgctgtcgctgctgccggcggcggcgccgtcgccggtgctgccgtcgtgggaccccaccgccgcgacgccgtgctcgtggcagggggtgacgtgctcgccgcagagccgggtggtgtcgctgtcgctgccgaacaccttcctcaacctgtcgtcgctgccgccgcagctcgcgtcgctgtcgtcgctccagctgctcaacctctccacctgcaacatctccggcgccatcccgccggcgtacgcgtcgctcgccgcgctccgcgtgctggacctctcgtcgaacgcgctctacggcgacatcccggcgtcgctcggcgcgctgtcggggctccagtacctgctcctcaactccaaccgcctcaccggcgccatcccgcgctccctcgccagcctcgccgcgctccaggtgctctgcgtccaggacaacctcctcaacggcaccatcccagcgtcgctcggcgcgctcaccgcgctccagcagttccgcgtcggcggcaacccggggctgtcgggccccatcccggcctcccttggcgcgctctccaacctcaccgtcttcggcgccgccgccaccgcgctgtccggcgccatcccggaggagctcggcaacctcgccaacctccagacgctggcattgtacgacaccggcgtgtccggcccgatccccgccgcgctcggcggctgcgccgagctgcgcaacctgtacctccacatgaacaagctcaccggcccgatacctccggagctcgggcggctgcaaaagctcaccagcctgctgctctggggcaacgccctgtccgggaggatcccgccggagctctccaactgctcggcgctcgtcgtgctcgacctctccggcaaccggctcgccggcgaggtgcccggggcgctcggccgcctcgccgcgctcgagcagctgcacctgtcggacaaccagctcgcggggcgcatcccggcggagctgagcaactgcagcagcctcacggcgctccagctcgacaagaacggcctgaccggcgccatcccgccgcagctcggcgagctcagggcgctgcaggtgctgttcctctggggcaacgcgctctccggcgcgataccgccgtcgctcggcaactgcaccgagctgtacgcgctcgacctgtccaggaaccgcctcgccggcggcatccccgacgaggtgttcgcgctgcagaagctcagcaagctgctcctcctcgggaacgcgctctccgggaggctcccgccgagcgtcgccgactgctcgtcgctggtgcgcctccggctcggcgagaaccagctcgccggcgagatacccagggagatcggcaagctgccgaacctggtgttcctggacctctactccaacaagttcaccggcgcgctccccggcgagctcgccaacatcacggtgctcgagctgctcgacgtccacaacaacagcttcacgggtgccatcccgccgcagttcggcgagctcatgaacctggagcagcttgacctgagcatgaacaagctcaccggcgagataccggcgagcttcggcaacttcagctacctcaacaagctcatcctcagcggcaacatgctctccgggacattgcccaagtcgattcgcaacctgcagaagctgaccatgctggagctgagcaacaacagcttctccggtccgataccgccggagattggcgcgctctcgagcctgagcattagccttgacctcagctcgaacaggttcaccggcgagctgccggatgagatgtccagcttgacgcagctgcagtcgctcgacctctccagcaatggcttgtatggcagcatctcagtgttgagtgggctcaccagcttgacatctctcaacatttcgtacaacaatttctccggcgcgatcccggtgacaccgttcttcaagacattgtcatcgagctcctacatcaacaatcccaacctctgcgagtcctacgacgggcacacttgtgcatcagacatggttcgcaggacggcactgaagaccgtcaagaccgtgatccttgtctgtgctgttctgggctcaatcactctgttgcttgttgtggtctggatcctgatcaacagaagcagaacactcgcgggcaagaaggcgatgagcatgtcggttgcgggtggcgatgacttctcgcacccgtggacgttcacgccgttccagaagctgaacttctgcgtcgataacatcttggagtgcctgagagatgagaatgtgatcggcaaaggttgctcaggtgttgtgtacagagctgagatgccgaatggggagatcatcgccgtgaagaagctgtggaagacatcgaaggaggagccaatcgacgcgttcgctgctgagattcagatattggggcacatcaggcaccggaacatcgtcaagctgcttggttactgctcaaacaagtatgttaagctcttgctctacaactacatccccaatggcaatctgcaacagctcctgaaggataacaggagcctggactgggatacccggtacaagatcgccgtcggcgcagcacaagggctggcctatctgcaccatgattgcgtcccggcgatactccaccgcgatgtcaagtgcaataatatactgcttgatacgaagtatgaggcatacttggctgactttgggctggccaagctgatgaactcccccaactatcatcatgctatgtcacgcatcgccggttcttatggatacattgctccaggcaagtgattcctacttcaagtatttatctgcatgctattttttcttcaaaatctagaaatatagtagtagtagaatgtagtgtacaagaccagcaacagttaatgccataggttaatgactctttgggtaatgctgttatctaagaaagaatctttgacctgcagttgcttctagtaatcttaaccttgctctgattccatgaccatgaccatgaccatgactagttgattgcttgtagcttaagcaggtgaaaccgatcagtctggctatctattaactgccattgcacaagtttctgaaatcacaagcatcaatgtccattgaagcttgttgacttatatactgtttgttgaaatgcctggcccaagattatgttgatatgcttaaaacatccaagaaatttatcctgacatacatttcctcattttcagagtatggctacaccacgaagatcaccgagaagagcgacgtgtacagctacggggtggtgctcctggagatcctgagcgggcggagcgcggtggaggcggtggtgggcgactccctccacatcgtggagtgggcgaagaagaagatggggagctacgagccagcggtgaacatcctggacccgaagctgcgcggcatgccggaccagctggtccaggagatgctgcagacgctggggatcgccatcttctgcgtgaacccggcgcccgcggagcggcccaccatgaaggaggtggtggccttcctcaaggaggtgaagtgctctcccgaggagtgggggaagatctcccagcagccgctcatcaagcccgggagccagcaaggttgacatgaacatcaagaacatggaacatgaacattgctgctggtgtagcagttgattcagtggctcagcaaggggttcaaggagtaggattttgataagatgcagcctagcttagcttgggttaggggggtggaaaaaaaatttcttgtacagctccaaatggcgttgcgttgcagctcattttggtgaactttgaatggggaaaaattccgcggttattttgtttgctcctgcaatacatcacaaaatctcaaatctatcttgggtatgatgaatatgatgcgaagaattaacatcagaatctgatcgcttcagctgaacagttgcctacagagtacaatacagattgctgtgagcctgtgactgtgagaagaacagttgcaacagtagctggaaggcggatagaggtggaaagtagagagagtacagacaaggcccatcgcccatgcatgacccggtgctccctcgacgccggcatctacggatcgagccggaagcggagacgcgtcaaacactcgccgttggctgggctgggcccctctcgtcgagcgcggttggtggcttggcatggccatactgctgtcattcgaccagtcactcgccgaattgctaggcgctgtagcggccgaagaggcgcgtgttgcatctgatctgcgggtggcggcggccacggtaagctggagttgcgtgggttggttacttggtaggttgttgactaatgggccgtatgggcctaaggccaactgtgttatgggctgtaccaagggacttgaatgggaaaagtataccggaggtccctgaacttgtcaccgagattaaaaaacgtccttgaaacgcaataccagacaccggcggtccccccaactatacaaaaccggtcacccaacgtccctcggtggttttgaccccggttttgatctacgtggcggctgagtcagcgtgggacccacgtgggccccacatgtcaggtgtccacaagaccaagtcaaattagccacgtagacgccacgtcagccaaaaccgttgtccgaaccgccgagggacctgatctgcactagttttgacagttgagggacccgttgtatctggttttgcggttaaaggatgaaaatcggatttgttgacaagttaagataccttagatgaatttattccatttacagcaccgctgacggcccctgtcgatattgagagcggccacgggctgggaagtaaggcggcaacaaatttgcattcaagcaacagttgactagtggagcaactatttttttccacgcacacacacatacttccccatccaaaagaaaacttaattacccagacgagttcaggaacagatatctatctctaattcatatataataaatataataaggtgattaaagtattaaaaaaatacatcaacagaaaaaatatacagtattacatgtgagctcgtaaaagaatgattaaccaatctttttatcatgtttgtagatggctttataatatattttcatacataatttatagattggttatatagtatcgaatgttaacgtttttggtttttatagcacttaaaggtactggttcactttaatagcacctaaagtttagcccatttcaatttttaacactttcctcaaatctcgattgtttttcatccgccttaaaaactacaatgatgcatttcgtttttaacctctctaatgacttatatcttttaaatagcatattattcttaaaaataatatgttatttaaaaacgagatcaatgttgaatatatataaaatattttattaatttaaaagtaatttataagcaacttagctatgtaatggaagtaactctctatagcatgaaaagtaattacgttataactgagttgaaataagaaattatgttgagtaaattcacaagcaaagtgtagagaagattttcaagtaaatatatttatgaaattaaattcaataaagcctaaaagtaattacataaatcataaaagtaacttagcataaaatagaagtaaattattacaacattagaattaaattcgttgtagggagaaaaatatggtctatctaaaaattaaatttaaagtccataaattatagaattgactaaaaacaataataaaaataatcaacacagagcattatgaatgtataaaaagtaatttagttaaatctaaaagcaatttatatatatgataaaagtaacttacgtatataataaaaacaatttacaaatataaatatttttttcatcgtaatataatcatgtaagatcttgttgtaaagattttaattgcaatgaacacgatggtgtaatcggattgtagatcggataagtaattcgagagaaaactttataaggggaaaaagacatgcatgtgtgcgtagtatacttctccactgctcgcacgatcgaacagctatgacacaacgtgcgcgatcgaatgaatctaagcagtgtcacgcgataagacaataacgagaggtttcgccaattagtttttgcgtaatatgattgatacacagactagagatcgatagaggagagaaaccaccgcttgtaaaaatcaagacccgtttaaaaaatggtataattcatagagcactgctgcacgtactaaatttttcttactttactaacaatcgtcaaattgtttgatttaggtagatagaagttaaaaaaacaaatctagatacactcatagcataaacatcagtgttattagcatacaagaatctagtaagaaaaagttagtccttatagccttttcctagttcaaaataacaccaatctataaagcagaacagcgtgtttcggagagaaaacaacacatggtttgtaaattatacgctcgtctgtaggggtgaaaacagggtaggtatttcccgcccacacgtccggccacattatttcgtgacaaattcgggtacgggacttttcacggatatcgggtccaaatacgggtccttttttatggatacgagatcgggttcggtaacatagtatctgacgaatacggattattcggtaaaaaattctggtatttcccggatattacccatattatgtttttgtgaagcacctttttgtactatgtattggttctactatgatgtattataccatgtttatttcctaaggtcctaatggcctaatataatcgtattacggatatatggaattgttaaatggttattgtctactccttccatcccaaaatataagcaattttatcaatgaatctggataaccatatgtccagatttatagacgaaagttgttatattttaggacggagatagtacgtgatatataagattgttggttcgacttgatatccgaataaatatccgtaaccgatagtgtacgtatccgttttggtacttattcgttccgtatttttgtcggacattatctgagtttgaatccgtattcgacactatccgtttccgacccgattccgattataaaatatggattaggatataggaggagtgagatctgaccgaacccgacccattttcaccccctactcgtctgagtcgtctcatcttgaaatctctaaaacgactccggcaaacaaacgagagcggaacacgaaataactgcaccccgcctccgcaccgcaccgcacccgaacccgtcccccgaaccatgcaatgcatgcgcccggttagccggaaaaaaaaaaaaaagaaaagaaacaaccggagtcctagtgtctcactgatacctgggccccacctgcctccgtacgcggtcgtaccggactaccgactctgacactgagccgtgggcccacctaccactccgccgccgatatatataaaccggcggcgagggctctgcaatccccagaaaaatccccacccggggtgaaaaaaaaaataaaggaaaaaaaaaacggagagaagagcgtcgtaacggaagaagtcggcgacgcgtcggcccaaaccctagacccgccgccaccgccgatccgcggttccttcgcaatggcgatccccacgccttcgccatcggtcgtagatcagccgtcccctcccgcgcctgcttccgccgccgcggcggcgtctcagccgctagccggcgatccggctcccgaggcggcggcggcggcggagggggcggggggtgatcagacggccccggcggccgccgccgccaccggcgcgtcgctgtacgtgggagacctggaggcgagcgtcggggaggaccagctcgtggcgctcttctcccaggtggcgcccgtcgcgtccgcctatgtgtgccgcgacatcgccggcggcagaaagtccttgggatacggctacgtcaacttcatgtcgcgtgaagacggttagttttttcctcctcttccttttacttctcattttgtcgggtgatcggcttcgattcgatcgtgggttcagaattctgatggtctgggtgtagtgatcggccttaacttgaagatttatttttcctgatgataaaagctttcggttaatttacgtgatcacttcgtatgggcacgggtcgatcaactgttcattatggaggtttatcgctttgtttagcttacggaggcctatctctttggttattattactagtttgtgtgtagtcgatctgctatatattgtacctattaattatctgtgtgcgagatgctgtaaattttgtttgtttaaattagttcgtttggagtagcatatacttattactgttgttatgataatattgtaagtttaattaatctgttatatttattttaattttttaatggggtgatcacttttgagtgtagggctgttggcaacgatgtattatatagtggagtacaatggttccatgttaattgtgagcattggattttttttttatgaaactatgtgttgtgataccttaatttgaatagaagggaaattctattttgtttagttttatactatgcatctttgtttgttttcgttgtattttgtatttcgagagtttgacacccgctaatatcaacttattaatttattatcaactctttaatttagtttgattgattgcagctacccgtgccatggaaaatctaaacttcaccgttgtcaatgggaagccaatcagagtcatgttttcgaatagggatccaactctgcgaaaaagtggacttgccaatgtgtttataaaaaatcttgaaccgaatattgacaacaagagtttgtatgaaatgttttcgtcttttggcacaatcctctccagtaaggttgccacagatttcaatggaaagtctaagggttatggatttatacaatttgagagcgagtcgtctgctaaggatgctatcaatggcctaaatggcatgttggctaatggacaaaaaatatttgttggattgttcatccgccggcaggagagagaacacactggagacgctaacaactttactaatgtatatgtgaaaaatttaccaaaacattttagtgataacgatttgctaaatgagttttcatcatttggtgcaattactagtgctattgtcatgagagatgcaaatggattgtcgagatgctttgggtttgtaaactttgagaaatcagaatgtgctagaaatgcagttaaaaatctcaatgggaagtccattggtgatatggtgttatatgttgcaagggctcagaaaaaatcagaaagacaagctgagttaaaagcgaaatttgagcatgacaaaaatcagaaatttgagaagcttcaaacagtcaatctatacttgaagaatttggatgatgacatcaatgatgagcatcttaggaagttgtttgaatgttttggtgaggtagcatcatgcaaggtatgttctctatttgttttactttgtttgatgttatgcttactgttagtgagttgtcatttgttttacgcttccatatataatgccaagttacaattgttgtaggtcatgcttgattcgcatggaaggagcaagggttgtggatttgtatcttttgcaactgttgaagacgctaacaatgctgtatgttaaaaaatgattcttttgtgctatcctcatactcccaattccatagttctaaatatttttcagtattatgcaattaatatttttaaaaatattatagattttaaaaatgaacgggaaaatggttgggaaaaagccattatatgttgccgtagctcaacggaaggaggagagaaaggcatttttagcggtatgtactaactctattacatttgaatttgatttttagggtaggttttgtacatcttgttatcttttcttgtgagttttgtaattcatgaaaaaaaaaactgaaagtacattttgtttcttaacattgacacttgatactaagtgtgctatgctaacattgaacttttccatgttacaaaggtcgtttgttaagcttgatattcatatcttctttgtttgccaggcacattttgctcgtgttagagccctagcaacaatggcacctacattagggccaaacattgctccccatcagttcaattttggccatggtgtgcctgccttgttcccaccaccaccacctgcaggctttgggttccaaccaaattttgttccaaacatgatgatgccatataacatgcaaaggcagcctggccagaggagtggtcctccgcatggaggaatgcctagacatctgcataatcctcaccaggtattcctgttggctaaatcattgtcatattttttttcttttttaacacaatagatccagcatctaattgtatccaattatcatatctacttatttttgctaatgttgtcaattactcgcaacttcagctactcccccgtttaaaattacttatcattctaggtgtctcttagtcaaacatgtttattttttaccattaatttttaaaaaacagtgtactttgacaagtaaattatatattatgaaggtattgaatctaaatccatgaatatcatgatgtcaaactacatgagtttagaaaaaatgattgtcaaaaactaaaatgtttgacttagaataagtctagaaagagaagtactaatttaaaatggagggagcaattaataattaactaggattcacttcacttaacatcgttgcttgttactttgtagatgtttcaccaaaatgccaaccagggcttcagacacatgccaaatcgtaggaatggtgtggccaacccagcaatgttgcatcagcaccatcgcttctctagcccaatgcagccaatgcaacaagctgtcaagcatgtggtgcccgtgggggaattgcaagctccaagcaataaccttcagacttccttggcttctgcgaacccggaacaacaacgagaggtatggatgtttatgctctgctttccgtacatgcttgaacaatttcacagattataaactatatactggtcatcaacatgtggaacagcattgcgaaataattcttatggtcaaacttcaatttttgaaaaacttatctaagtcaaatcagccatgttgtgaaacattgaatagatctggagcacgttttgttttacgttttgatgcatgttctcttacgcaattattgttacaaaagcatatgtagcgaatccgtttttcagtttagtcttttattgatgt

SEQ ID NO: 30214 - DNA, 1129 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacgcggc

SEQ ID NO: 30215 - DNA, 597 bp, Oryza sativa
tcacatgtatatagcaaatcatcggccaactaatttctgttgacattttcttccatggaaagcgttggaagaggccagctccaagcgtgctgcgctggggttgctgatccaagaagtccttttccagatcatcaacttcgccaatgagaaaaaagaccatattcctccaatctccgataggatattcaatcacgagatctcgatccccaggtgcatattttcatttacatatctaattgcactgaacatttcgttgggtaccctctgatgacagatgaattctgtaagtttgttgaagattctgtatcaatatctgaatctccaggtgacaccttttccttggacgtgttgacagctcttctgattctgtattcgggtggaacgccgacgtccttagaagagtgttgaatagttgaactgaagacggtgatcatcaagtacgccatgtccagcgttgggatagaagataaccccctatgtggtcgttctgtcaaagatgtcaagccattgtcatgaacagtatcatattgtacagaataatttaggtaataatagaacagacagaaaccaacgattttactcactggagatgtaaat

SEQ ID NO: 30216 - DNA, 616 bp, Oryza sativa
atgatccccccttacctcactgccaaaaaaatttcaatatctcacccacattaatcaccttcctcacgagtctaacgagcaaaaatcccatttcatcatcattcatatcaatcctctcgatttcttccacgtccccggattctgtttcctcctcctcccccgtctcgatccctcctcctctttccctcgctccagcgcgctcgccgtcgcccgccgcccgccaaccatggaagcagctggactggaggaggaggaggaggaggaggaggcgatgccatggtggtgttgccgcagcaggaggaggcggcgtccgtcgaatccaagggagtccacgtcatcggcagccgaatctatgatccggagaacctacaggtggtggcaactagagcctacaggcggggtaagctctactgcgataagtagggacgatcttggcaggggcttggtttgatggaggggttggcggcggtgtaggaaggtgactgggtaagggggtgtgactgtggaacggtgaacttgagctggcacacggctggctcaggctcaacaacacgagcaccgctccatgcacacgaactcccagtctaccacaaacgccacactccctaacgacatt

SEQ ID NO: 30217 - DNA, 688 bp, Oryza sativa
atgatgtgaccatggctaccacggatgcaaccattgctcacatcatggatgaacaaaaagatatcgagatcaagtactccaagtgctggaatccgattcggccacctactacactgctgacttcaaacggccaccgaatctgcatacgacctccgttttcggcccgtgagtacttgatggaaagctctcggagccctctttctaacggatccagcctcttctctgaattctatctcgtgtggccagaatcacaggaacaagatgttgcatcacctataatgggcctatgggcttgtaacttcatttgggaccccggcccaggtggggcccatgtggggtgtgccccaagctggtggagcatgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggt

SEQ ID NO: 30218 - DNA, 554 bp, Oryza sativa
cgccacgccacgccacgccaccgccgccacgccacgccgccgccgcatctcccttcatgcatttcgatctctccgatctcgatctctctccgtcgccttcgacgccgcgcaacgccgccgccgcatgccaacgccacgccgccgccgccgtggccacgccgccgccgccttcgccgccgcgcgcgcaatgccgtcaccgccatgccacaccgcctgcgacacgccacgccacgccaccgtcgtcacgccacgccgccgccggcacgggcccacaacgccacgccgccggcgacgtcttcacgccgccgcgccaaccgacgccccgatgccgccataccgtcgttaacgaacgagaacgagaacgatcgaacgaacgagagcgagaacgaacacgtcaacgtacgttgccgcgacaacgtgaacgagaacgaaaacgatcgaacgaacgtgaacgagctagggaacgtgaacgagcgaacgaacgaggacgaacgttaacgtgaaatgcaatatatatatatatatatatatatatatacatgtatatatatata

SEQ ID NO: 30219 - DNA, 633 bp, Oryza sativa
aagttttttttttaaaaaaaaacaggaactggaaacaggagcttccattaatcacaggctcaattctctttttattttgaattgcagtagactcctgcgcaagttttaggacaggatgaagtcgaacaggaagtaaaatgagaagacataaacgatcgtatctgcctaaacagagcagttaggactccgatccaactcttcgtttgtgtagtaaatgccgcttctagacagtagcatctgtttccaggaagattggagtcattcaagttgtgctgctctatccagaaccacaccaaacagctatcgccttagggtgtgtttccacgtcaaaattgaaagtttgactaaaattagaagcttgaagaaaaaagttaaaagtttatatgtgtaggaaagttttgatgtgatggaaaagttgaaagtttgaagaaaaagttagaaactaaacaaggagttagtctagagatccttcgcaccataaatcaccatccaccttttatgaactcccatgtttcaagacattaaggctgtgtttagatccagaggtgtaaagttttgacgtgtcacatcggatatacggacacacatttgaagtattaaaacatagactaataacaatacaaattacggaat

SEQ ID NO: 30220 - DNA, 38270 bp, Oryza sativa
agcctgtaaaaagagtagtactcgctcacaacacaacctgtttaagcatttactagatagatttctactttgattacaagttcttaatagagataacaatgtattataaacccccttttagatatttttctatagggaatgaagcctaccacgacggccactgccagttcatggaagcgaaaacgtcctcggctaaaggagcaagggatcacgccaactggtcgatctcatccgccgataaccgagaacggcgaaaacccccgcgcaagaatctgaggtacatttgcgagcggcgatcttggatgcaggcgaggacgtgacctccggcgtaacggctggcgcggcgacactcctcttttaggctgatgtcgatccactgtccaatgccttcaagctgagcacactgttgatagtcgttatcaatcagtttcgaccgtcaatattaccaaaatagaggagaactagtgatggttgcaatgcatatgcttgttagaataataatattccactagtattaggtttactaaccttttgcagagaataacaataaagtgaaggagaatcgagatcaactccaatgataaatcaatcggacgatgtcgagaaccaaacttgtgtatgaatgggccaagaactcagaattgacacgacaaactgggccaaaattcacaagtctgcggagaagaacaacagaggaggctgccagccaaaccttgggcttattgggccggccccaggatcggccgaacctggtggttcggccgaacctggtggttcggccgaacccccctcttcgccgctggatgcagggtttcttctggacagtgtggattagctcccaatgacggttggagggtatttccgaccattccaaccgtcacaaccgtcattgggaggctatataaacccctcaccttctcacttcactcacacacctcaagcaagagctctctcgttcctctcaagtttagtttagtagtatatagctggtggaatagaattagaataggaatcaggagtccgaagccttcggaagagttcgggtatggctctagtagctttcctttcctcttttgtaagctttgtacttttattagaatactcttctaaatacatttctggtattgaaatactttccgagtatatgagtaccaactttacattatgttcttgttataccgaatatattgatagcttgtctgggagatgcatgctttggtgcgggtatagtgtttgcttatgcaattactctatgtcatgacgatgatattagagtagtatccggtagtttagacgtggtgtctagattacaggatatcattatttggggttatatattgcggatgagaggtgggcctctgatggtgacagctcagtacgggtattcctccacgcctatatataatcctaagttaatttcctggggagggtactcctccatatttagccccagttggatggtcatgacgagctgtcgtaaggaactaggcagtcaggggtggcttctcgaagtaccaggagggcatcggatagaaggtattagctagtatatcagttaactagaatgtatgtatactatgtatattaaaagtatagaaatagattctctttctcttttcttttcgcctagcttagattatttattatgagtagtaatgcatgtgtgtcactctacccttggattatcttaacccctacttagaatatgattatcacaagtattatataaattattagttgagttctctctacgtgatcttcccacgggataaaatgaatacgatacccttggaatactctcaggcgaaatgctacaatggtatatccatgcgcttgcggatgaactctgtaaccataatataccagaagtatttctgcgccattgctgggaattatatttctagtaatgtcgttaagaaataccaacacacacgcccccctcagctagaacaagtagcccgtcgtgttctcctcggggtccgcgcgatcgaccctcagctggtggtagatgtcggccatggcattacaacagctcttgaggtacgagttcatccagacctcgcgacctcggagagcctccacggccttgtcttttttcacgaccacgagcgatagcccaagttcggtgacctcaaactttgtcctccaagaagcgatgcgtttgtctcgttcggcgatgacaccttcgagatctgcgaaggacaaggatgtaggagatgttgcctccttaataagataataagctcaaagggacaatttctctatgacatcacacctgagttctcgcgagggagcccgactatgcccggactaaacgggccagaggccgcgcccacgcctccgagcacaaccgcatccgtaacgacatcgggagcaggcatatcgcccaaagagggcaagtcgatcatcgcgacatcgggacatccgcattgctggacatcctcggaatccacacagctatgaagaataaaagacgctacagattaacaagtgacgtgaagagaaggaagtcactccgcctaggagattaacagaagtacttgtacaaaaactacaatacaaggtaaaaaaaagtttactcctcataaagggggaggacgcactccccgagatccatcacactagagacatgtcctcgcgcgtggcatctgctgcccccttcgacaagatctccttgagatcggtgacagggagagccagcttcacgcacgcgaggacgtgacacgccctgtgtgaatcccgttggagatttccttcgagaccttggcagtatgccgcgacgggatgacctccatctcgcccgccagctccgacaacgccaacgtcaaggacgtctcgtcgaggtgcgtcgggatagaagacatcacaccacacgccaaggctagctggtgaaggcctatgaagctcttgcggagggagtcgcggagggagaagaggtggtcctgcaggtcgttcatcttcttctccaagccctggtgctgcatcttgttactggccacgatctccttcatcttttgaaggtcgtcgttggcgacttcgagttcaatctccagccgggccacctttccgtccgacgctgttgcacgggccaccgcgcgatccatctgggccgccacctcccgagaagtgttctcgaggaggcggcggcactcggccatcatatcggaccaagttgttagttcgggcgacgacgcggccacaggcgcgacggcaggcccggcggactcagtgacaacaggagcgacctccacgcaaggaatgacaccggcaggaaacccactggtcaccgcctagtccccgctttgcgcggagatcgccgaggctttcctgccaatgtcaggggacatcattagtaaaacttacagatgtgacgacgaaaggagtcaagagtttcacttacttgccggcgagcagctttagcacccttctcttcggaggaggagcgagactgctcgtatcctgagtaagatggcaaattatgacctcattctaacacttcaagaaagaagctaaaggacgacaatgatacgccttacctcggagccactagatttctgtcgagaaccggcgggagcgctcgacctcgcccaaggcttcctctgggtcccgctgcctcctgcgatggctggaacggaggggatgttggcgacttcgtcggcatccttgtccttcaacgaggcggaggcctggtggttgacaagggggccgataacgtccgtcaacggcagaacctacaggagttgaagtcactttgcgccttcagggaatagaaacatgaggaggtctggttctcatttacattgatagcagccgccttgtagactgccgacttgccgcaacgcggagccggtgtttcatcgaccgtagaggaaggactgatcaagacttccttgacccgctgcgccacgatgttggcggggagatctgaaataaatgaagatatgagaggatgagttaggctttggcctcgaaatcatcgtcgaaagcaggaagaagattacaacataaggacaaataccccgcgaagagattcgagttatatcctctgctcccgtgtagtcgaacacggggtgagcacgggcttgtagcggttggatccgaccgctgacaaagtccttaatgacttcatagccggtcaatccttgctctcgaaggtcgctcacagcgttgacaaaggcttggagagagggtgtcaacggaggtttagaagtccagttctcggaatgctccggctgaacctcgggtatgacaagaaccggttcaagttctttgagctctagatagaaccatctcgacctccattggctccgggatgtgtggcattggaaagagatgtatcttgccttcatgccatcacgaaggcgaaaccatcaacatcttgaaacccgattggcttccatccaccggagttcatagaaaaagcaaaaaagatctaagaaaggcactacctcgatgtaggcctcgcaaaggtgagcaaatatgctcaaaaaggcagtggagttggggtttagatgcaagagagaaaggccgtaaaagttcaagatcaataaaaggaatttagaaggaggaggcaaaaaaccacagcggacgaaatcctctagagctaccatgcgacctaggatgggggaaggatcaatacctcttgcttcccaagccatggtctgcttcagagggacggccccctcggtgtacagcttcttcagcgcgccgcatcggagaaagattggtcgaggtccgccatcggaagaagatcgtcggaacaagatcgccagtgggagacgtggaagattagggattttagggaaatggaaagtccgaggaagccgaggaacagtgagggttttttggcaaacagacttgaaatggatcccagaattccattaaataggcgcaccacctaacggttcgtattttgaggaaaggagagagattgccgccgaaaatttctaaggcccgttggaggtagttgttcagacttcaatttaaattcaaattttgcaccgttggactccctctagcgttgtcgatagctccatgtctctacggtcagtaaccgagatcgacctagcgagcacgacgagacgctattaggagaagtcgtgggcgacaacatgaattcatttaagttgaagtcgggggctactgtcagggttaccgataaggcataccttctatcctacgacttatggaatataccaataaggcataccttcacgtacatggattgtttccctatacgtcgttaggaatttgtcttaaattacggaaaatatccctacgagttaaagaaactaccaaagtcctactcggaggggatagaatctctgttatattgtatcatattacatacctccaggccttacttgcgggtcaagataatccacggtataaaagtggacccctagggggaggtgaaggacatctaatatcatcgccaacacacccaccatagcttacgaagccagagtattcggagccaagtcgccgggagatctcgtcgaatccatcaactacgatctcgtcggtatcgtctgttccatctactctctttgtactctgttatcatcgtcatcaatctcatataaactagactaaggctattacgtgttagggggcctgatccagtataatccttgtcttctatttgcttgatgtcgtactacgtagaccctctttcaaacataccccaatactcaacttatccggtccacgagcatcacttgtcgacaatgagaatttcttaagtgtatcctaaatgataaacattagggtagttatttatctacggggtatattctatatatgtatcaaatgctttatttttgtacttgtttatacccataactatttaatggaataactctatacttttaacatttttttagaactttaacatattttcaaacgtatatcgccctcgtatattgtatattgaagtgattatatgttactaattcttgccaagatttattctacccacacaatatcatattattataatttgcgtgaaatatatttgatatacgacataaaattaattaaaactcaattgcacagatcatataaaatactttttgctaacatgaaattttaaaagttattaaagataatagaatgcacagtagtgtttagcatgggcatattactagtatatgtaaatgactaaatgttatggctatttggctaaatagaagaaaaaatgttgcaacaatatatacagttttcagtactacatatgaaaatggagtccttattacctagaaggtatgtttacattatcacgagatatagtttttttatatatattcatgactgccatcgaatacttaccatagtagataaaagaagtagctccttctagctgacttagtggagaaaaagaattaaattttaaaaaacaaaaccaagagattctaaatatatcggaacgaattagcttaaattaatacacacgtgaccagggacgggctgttcggtggctcctttttttatttttgaggaagacctagtattcggtatttcgttatatttcattatagatatgtactatttttaaagcttcgattagactaatatgagtgctcattcatacgatggaccgggctgtgactgtgcgcactgctctgggtggagagcatatatattgatcgatcttatttatttttcatgagaaaatataacatttatttatggcaagacgttattcacgtcaactatggctgtgttagggagtagcactctaaacaaagccgcatttagcgcataattaattaagtattaactaaaataatttttaaaaatgattaatatgttttttaaaacaactttaatatagatttttataaaaaatacactatttaacggtttgaaaaacatatgcgtgaaaatcgaggaaagtgagttgggaaagtagagataagaatttaagcatatatctatcagtcaatgtggtactccctccgtcccaaaaaaacaaaccaaaccatgtgttttcgtgtccaacgtttgaccgtccgtcttatttgaaaaaattatgaaaaaaattaaaaaaacaagtcacacataaaatatcaatcatattttatcatctaacaataataaaaatactaattataaaaaaaattcatataagagagagagtcaaacattggatacggagactcagcgtttatttttttttttttatggagggagtatatagtagtacaacaatgcaacagccaatttccagttcgatcaggcgtgtgcgtgccgttgcgtccagctaaactccacgacttagatgtcggctcgtgtgtcaaatgcaaaattctcaagaatctgccgcagccgatcgatttcatcggattcttcgtggtttgcgtacgtcgtgcgttgtactatcgcgtgagtgctaacgagcgcacatccaaaaaatagaaactgatgcagttctcccgtacgcgtcttttcaagaaaaaaaagaatcgcgcaacgcaactgcgatcctacccttgtgcgtgagtttttcttgctagcactctctccgtaaaaaaaatcaaactcgtagtacgatgtgacatatcatatactccctccatcgaaaaaaaaggcaaatactgggttttcgtatccaacgtttgactatccgtcttatatgaaatttttttataattagtattttcattgttgttagatgataaaacatgattaatactttatgcgtgacttgtctttttaatttttttcataatttttttcaaataatacggacggtcaaacgttggatacggaatcccaggtgtggagattatgggtaccacatacccacacggcatggttatccgactggttataggggataacttatatctatgaaatatgtaacagatcatgacttgggtattacgttttcccgtatattatggaatggcctaaagtcctggtttgataagattgtaaagtagatttaggaaaccgataccgtattgattaaggtttctatcttgtaatcctgcccccatcctatataaggtgggtaggaggccctctagggagcatgagatacaactagatcgtcagatctatactacacccggcggattcaaatccccaaacaggagtagggtattacctctcattgagagggcctaaacctgtctaaatcctttgtctccgcatccatccacttttaggtctcgtgcgctaccccttttattattgcctaattcatgtttcgacagttggcgcggcaggtaggggtgcgtcgaattacccatcgaaaagtgcaatggaatcaactgcagaagaaacggcgagatcaatctcaccgacgtcgatggctcaactcttcaaccgggtttgtcgtttcaatctatctagtgttttttaacaatgtctatgacagattgatttcctggtgtactattattattgtagtactactgtcgacgagatcgtcgatagcatatggagccacctgggagtatacacggcatgctgcaacccctgtcctcagaacaggcgtagtgtgcggttgccggttggttgcgaatgttttggcccggccgactgctttgattgccaaagtaacagtctagcacgcttctcctcgcggcgacgtaatcaggggcaccggaacagctgcgttgatcgcatgcatctactgatcaccgccatatatgcaagtatacatgctggccaataggccaaccaatcaggagtcctgcgtttataggctgctaccaacatgcacaggcttgaatccaattattcaataagcagctatcgacacatatgagtcaattaatatataggagtgtatgtagttgtatgcatgcatcttcttttgtttactaatctgatttgactcgtatttacatgtacttccatggatcgatggccatggccctgagatatcgttctgatccaacaagccggtaaagcaatccttctactattactgggtgggttgtcttcatcaccggccacacattggagcagctgcctacaatttaccagatggtgatcatatgacaaatatcgtcatgcccgcaactggcgccgtcaactcatcgagttttatctcttccaacttattattctatattattagattgatttctaatttcagattaatctcttgctatttttgttgttgtttgcatataattacacggcactactgaggcgattggcgttggtcatggactcgaggtgtctcgctatgcgattagttggccatgagtctactccaccggcttgccttcaccactgccgttgctaatggcaacaacgtcttcaccgccggcctgcctccgtcgccgccgactggtgtcctcgcctatacgattggttggtcacaccaccgttcatggacgtctacgtcttcatcgaccggctggcctttgccgccgccgactggtgtttccgcctgcacggccggcctattatgccgccgttgttgggcgtcaacgtcttcaccgccggcctgcctccgtcgccgccgactggtgtcctcgcctatacggttggttggtcacaccaccgttcatgggcgtccacgttttcaccgaccggctggccttcaccaccgctgactggtgtttccgcctgcacagccggcctattatgccgccgttgttgggcgtctacgacttcaccgccggcctacctccgtcgccgccgactggtgtccttgcctatacagttggttggtcacaccaccgttcatgggcatccacgtcttcaccgaccggcgtgccttcgccgtcgccgactggtgtctctgcctacacggctggcctattatgctgcatttggtgggcatcttcgctttcaccatcgaccaccttcgtcgctgccgactggtgtctttactgttattgatggacgactttgttcccacattggccacctctgccatcaccaaggggaatattacaaagctaagtcatcattaattttctttatatgatattttccttttcctctgcctcactacatcaactggttcgccgttgactagtgagtcgggggactatagatgtcatatcatattttttaacaatttttcataatatttatcttgattgcttgcgaaataatccgagtaacaataaagttcctatcgagttatggagttctattttcctatgctttccatttggtttgtcgatggatagttgcctttgggccgattcctagcacccgggggctcgttggatggaccgagtaacgcaaggtcctaagtattattcggaataaatcaaaagcatagagataagataaatttattttctgctcttacaattgcaaaagtacccgagtagtaaattttgattcgtgaaactttgttccattaatgacgaactcatgtcactcatatgcatgtttgggaagtgcctaaaccaactcccgatgcttgggggctatgactagtcgggcagagtgtttaaacgtacggagtcatctgctcggggaaatcaaaattgacaagaggagaaatacatatttataaatattttaaaatacttgaatttttctcaagtactgtgcttgcatcagatactactcattctatatgtttgttctgcaggatccagatccagatatgcataatagggatttatagctttaagcttatctcctacgcttcaggaatggattagtcagaatatcaccattggcttgctgtcgtcgtcgccgactggtgtcctcgcctatacggttgggtggtcacatcaccgttgttggacgtcatcgtcttcaccgccgacttgccttcgccgatgtcgactggtgtctccgcctgcacggctggcctattatgccaccgttgttgggcgtctacgtcttcaccgaccagcttgccttcgtcgccgccgactggtgtctccgcctgcaccgctggcctattatgccgccgttgttgggcgtctacgtcttcaccgcctgcttgccttcgccgccgccgactggtgtctctgcctgcacggctggcctattatgccgccgttgttgggcatctatatcttcaccgaccggcttgccttcgccgccgccgactagtgtctctgcctgcacggctggcctattatgccgccgttgctgggcgtctatgtcttcaccatcggcttgccttcattgccaccgactagtgtcctcgcctgcatggctggcctattatgccgtcgttactgggcgtctacatcttcaccgaccggccacctcgtatgacaccgactggagctatcgtattcacggctggccatatcgccgccgctaataggcgtcatcatcttcaacgtaagctgtctacgtctgctgctgactggtctcttcacttacatggctgcatgattctgatactgttgattggccttatcgtcttcaccgccggtcgtctcgtctgctgggattcgagcccaggtctccacgaccacaacgtggaattctcaccactaaactactgccgactggtttgttcgcctccatggctgcgcgtcttcgtcatcattaactggcgtcatcatcgccggtttgccttcgccgccgtccatagtgttttcactttaatagctggcctattttgccaccgttcatggacatcttcgttttcatcatcatactacttcttccgtcgccgactggttatgtcgccgctgactggtgtgtttatcttcacaactacacgccttcgctaccgttcgcaagatttgctacttcaccaatcacgacatctacaagagcttcgacatctcgacatgcgtcaccaaatatgatgccttattattttactatagcaagtggtgttctaatcatcaatatttctactcggacatcttcaacacgtatcttcactcaagcaatggctactcgacgacaagctagagttctcgactctatgttcagttgttttccaactaaccaaagagtcgggggctacacaaatacaaggctcaaaatttgacatgttttttgtcaaaatgaagcaatcaatgaatcaacaagtaaattttgggagttattatcttggtcttcgcttcagagccgacattttacttcagcgactctagttatttcgtcgattcaacgagttggacaacatcatctatttttcttcaagtgaagcatcttctacagctacaacaccaagttctactgtcatcttcataaatcaagaggcgttgcatcaatctacattacgcgcactctagcgtcaacgaaattactcgagcttcgatatcttctcaacagtttgatggattattgtcactgacctcattaccaacgcctctactttatcggccctgacgtctacgccattgctaatgggtgactacgtcttcgccttcggttgcttacgtcattgccgacttgttatttcgccttcacggttgacctactacgcaaacgctgatgagcgtcttcgtcattatcattagctgctacactgctattgactggatcaccgacttgtcatcttcatcaccatcctgtcaagcttcttcgacatagcctactctactactatcgatgggcaacttcgtcatcatagtcgatcatgtctgttgctgctaatcgtcattaccgtcggttgcatttgccgtcgccgactattttcttcatcttcatgattgatggatttcgccattgccattgatgagcgtctacgttttcaccaccggcttgcctccgccgccgcccatggtgtcttcgctttcacggctggcttattatgcctttactgatgggcgtctttgtcttcttcaccggctgtctcgtctgtctccgactaattatttcgtcaccatggctacaaaactccgtcgctattgctgggtgccttcatcttaattgttagttgatctgtctgccgccgactggtttcttcgcctccatggctatgcgacttcattacctttgattggtatcattgtctttaccaccaccaacatcttcgtcagctttgatgggtgatatcatcttcatgttagtcatttcgtctccatgtcgactgcatcagctattgccaatggacaattttgactatgacagaaggacaagctatatattctcaggggcttatcaactcaaacactaggatcataccttcaagttggattttgttctgagattattttctatgctcgaagactgaaccaatcattattctccgtaagggctatcaaccgaatacttgcgccagtcgggattcaatttttatatctattttggagtatcccataagggataatcactcagatcagaagctattcatatgagctacacttggtctatattacccggaagatttattactcgggagcatgttatatgcgtcatcctttaaagggtgtcgaaggcatttttttttggcctaggcctaatatgtttgcagcccatattttcatgtgtggcctgtcacgttcttttagggacttaggcactttttgcttaggccaaagtgtgcgtgatcaagtgcccaatatcttaaaatccttttataccgcagttactcaactttttaggagttggtacaatgcatcttaaaaggtgtcaaacagtaaagctttatatagctgttccgctgacttttttatataagtcaaggtgttgtttgggtttttaagcaatcgattggatacaatatcattgctttttgccacgtaagtgtgcgtttttattgaccaatattatggcttaggctgattatatatcttggtcattttccaggcggttggtaaatcctttatgagtttatttactcggattttacaccacatatgccgtatatttccgggtgtggtgaaaccatgtgtcttttagggacttaagcacatctgttaaagcagtgtgcgcatggcgtatgcccaatactttggaaatttctttattcacaacattcaagcttttttatagctgttttgctatgtgtattttcaatgatgtagtcaactttaggttgctctcatcaatttttacaaagcaatcggtatatcacttggatcatgttattcggggattcacaccgcatatgctatatatcaagtcatttggttgattacaattatcaaaaccactcggttggttggattatttattccttgactatacgcttagtttgttcagctaaccacatagtcggaggctacacctattaggtgcatctagtcgatgcacctaactttattttccaaccctccacagtctagtcgaagattatcttttcgactatgaaggtctcaagggctactatggagattatgggtaccccatacccacacggcgtggttatccgactggttataggggataacttatatctatgaaatatgtaacagatcatgacttgggtattacgtttccctgtatattatggaacggcctaaagtcctggtttgataagattgtaaagtagatttaggaaaccgataccgtattggttaaggtttctatcttgtaatcctgccccccatcctatataaggtggacaggaggccctctagggggcatgagacacaactagatcgtcatatctatactacacccggcggattcaaatcctcaaacaggagtagggtattacctctcattgagaggacctgaacctgtctaaatcctttgtctccgcatccatccacttttagatctcgtgcgctacccccttttattattgcataattcatgtttcgacaccagagtttgtcttttttttttggaatggagggagtgttcagattcattgtactagtcacattatagtactagggcctcgtttagttccccaatttttttcccaaaaacattacatcgaatctttgacacatgcatggaacattaattatagattattttaaaaaaactaattgcacagttagaggggaaatcgcgagacgaatcttttgagcctaattagtctatgattagccataagtgctacagtaacctacatgtgctacagtaacccacatgtgctaatgatggattaattaggctcaaaagattcgtctcgcagttttcaggcgagttatgaaattagtactttcattcctgtccgaaaactccttccgacatccggtcaaacattcgatgtgatatctaaaaattttctttgcgcgaactaaacaggccctagttgtctattttttttgggacggaggaagtacttgcttgtgagcctttttgttgctatagcccaaattaccccgtgtccgtggcccatgaaaaccagtcgcttccgtcctcctctgtgtgtcgggcatcatgtaggaagtctaggaacgtatttacacggtgcacaaaacactcatcaattctaattagtgcacacattgtttaacaaaaaagatatagcatatcttgtcatcaatacaacgaatctagacaacgggtagtctagattcgttattctaagaggggtcgtatccccttagagattgagttttctttagaacggaggaaataggtggcagtagaaggccaaaaagaagagggaggtggttcagcccatccattgaagcccatgtttgtcagccaccaaatctatgaagccaagagtaaaagattattatctgtcttatagtccatgcattcctccataaaaccaatatatgattcatatattgatcataattcctcgttactagtaattcgctagtacagttgaatgcaaaatatattgctgtccactgctataaggaagtaagctaagtattgaaaggaatacgaattaaaagtaaagagagaaaaacgataggaaattcaaacatagatccggcgagttttctctgaggtataagagattcggcaatctccactaatactcgttggagcactctacacaaagagtacactgtctctgatagtcacgaagtccattggcgctctcatcatggtggttcttctccgctctgaaaggtgaaccccgaaacctccacaaccacaccggctctcccacaatcttcttgacagatcaccgggttgccttcgagactggctaggcatgccaagatgccaatagttaacaggaagagagccactcctcctgttaagaacaggattcttgttggtgcacactaagccactcttttttgacgtgaaacagtaggaaaatataatttacagggagggtggcaagcaccagaaaaaagcatactctcaactcaaactagcactaaattagtgaagaaaattatcacaattagctcaatgatgctcttagactctcccatcaattgctcagctcaatagggttccaaaggacaccggggagtcaagccaagggatgtataaagccccaatcaagctccctagcggtttgcagccatcgtaaagaagcaaaagccaaaactgcaaatcgtcaaacagtatggcaccgacccgaactattctgcccttcatacttttctgattgtaactgggcaagtagttgttgggccataaagcataggacaatccaacatctcctagattgcccaggacccctttgtccacacggtgtcggacaatccgcaatgttcaaaaaccaatgaccagtaacaatcgaatgaacatgccagattaaccgacgtcgtgtcgaactgtccgctagttgccaaattaactaggcatcagacaattcgagagctgccggacagtctagccagttcatttccactatctagtcaacatggtcagacaatgaactggctgaggatgtttcttttgttgcgtacatatgattgtaaggatgttcagtgcagggttgtccctagtaatttggggcctcgtgcctaatataaaataaggccttacctttagaaaatactattatataatagattagaattatatattatttataatacattaggtgggtatgccctctcacagctcatgagtcatgaggagaaagagcggatgatgggtcccaatcatatgattctcacaactagcataccccctcatctactctaaacgaacctttggctgcctattgcattcttaaagtaagaaacaacaataacaaacaccttccctgaatcgagtggacctagtagccagagtcttagatggtacaaagaagcccatgatgaggaggaggtagtccaatccctgtattgaaacctatgttattagtttttttttaaaaaaaaggaagaaacatatgctattaactattagatgtactcacctattttacctttgtattaatatatttgccgtatagttgacgcatttcaatgtaaaccagcgattcaaatattgatttttttgaaagatccaaatatacaaacgttactaccaatctgtcgttgaagataagtcaaaaacaaattcccatccacctatttaagaaggtggacaagtggatggttggtaggcccaccaacgtgccccctcacacctcctgagtcacaaggataaagagcgaacgatggagcctactcatacacttctcacaccttgcacacacaacacaacccatctgttttagccggacctttggccgctgcactattaaaatgtagaagtagtgcaacccctattaaaacccatgttattaaatactatgtctattcaaccacattaatgttgtatttatatttttctctatagtcgttgtattctaaagtaaacgagtgattcataaattgaatataatttttcaatagatccaaatataaagtctaacaataatttgtcactacatatgaatccaaaacaaaattttcatccacccatttaaggtggaaaagcggatggctggttgccccaccaacatggccttcacacctcatgagtcaatgaggaagagtggatggtggatcccagtcatatgactccgacaactaacatacccactcatgtagtttagataaacctttggctgcctagcaatatcaaaataaagaaacaatgttaacaaatacattccctgaatagagtggacctagtagccaaatacttattaggtggtataaggaagtccatggtaagaaagaggtagaccaattcctctagtcaaacctatgttattcactattaggtatattcatgtatcttatctttgtgttaatttttttataattgatgaaagtaaaccaacgattcactaacagattttttttgaaagatccaaatatataaaggatactagtaatttgttgctaaagattagtccaaaattaatcacctatttaagaagttgaaaaagtggacggttggtaggcccaccgacacacccctcgaacctcatgaattatggttgtgtttagttcacaccaaaattggaagtttgattgaaattgggacgatgtgacagaaaaattggaagtttatgtgtgtaggaaagttttgatgtgatggaaaagttggaagtttgaagaaaaattttgcaactaaatacggcctatgattaggaagagtgaacggtggggcccactcatatgcttctcataccctgcacacccgcccatatgttttagccggactttttggctgttctgctattaaaagaaagagtaaatcttccacgacgtgtcataagcaggatggcatgtactaatcatatgcctattataactagcatacacacttatctagtctagaaaaacctttggctgcctattacattctaaattaagaaataagtaacaatagtaaacaacttcccttgaagacctagcgtattaataaggaggtagtccaacccctctcgttgaaacctatgttatttaacaattagatatactcacctactttacctttgtattaatatctttactgtataattgatgcaatcatcacatattgtatatatatatttttcaaaaggtcccaatatataaagacaacaatccgtcactaaagataagtcccaaaagaaatttctatctacctaactaaaaggggtaattgcacattgactctcttttgaaagctaactatcaatttgaccctcttttatcaactttaattatttaacccttttcttaaaaattgaagatatggtatgaccctattctattaagggcatctaacgatgttaactgaagcacaaaatgtcccttctgcccttactcatttgaccctattacatgtgggacccacgcgtcagttctctcttgtcctctcctccacagctccacacgcagggagaaggccgcgagcagcgagagggcgagccagcgccgaccagcagctgtggagcaccgcctccactcctcgtcaccgccgagccgtcgttgcccctcccttgccggatccagccatcacagctccatcgctgggttcgccaccttcctttcttagtgcatgccggtggcgcctcctcttccctccgcgcgctgaccgccgctgctacctccctccttccgtgcgcctgccgctgccgccgcggcctcctccctccttcagcacgcctatcaccgccaccgccaggcccggctcccctccctcccttcgccgcgcgccggcctctgcctccctcctcgctgcacgcgccgccgcctcacccgacggtgcgcgcagctccactgcatgctgccgccaccaccgcaggggaactgtcgccgccgtcgcagaggctcggcgcagccgctcccttcctccgcaagccgacgccggtgcagatccctccatccgtttcccaccaccgccgctccttcccttcacaagcgtgtgccagcgaggatcccctccacgcgcttcccatcaccgcggcccctgcctccacgagcgggcgccgccgcggatcccctccgcgtgcttcccgccggcgccgcccccttcctcccttcagacaccgagtgccaccaccgcaactcgctggcaggagagagagagatacacatgtggatagggttagggatggatatggtttcctcaagggtattttggcattacgaattttatttatatttctttgtttttttaaatcaaatcttaacggtgtagtggaaacagggtcaagcggaaggttcgtttttgaaaaacatggtcaaataagcaaactaaaaaagtagggttaaattggtagttagacttcaaaatgggataaaataagcaattgtccctattttaaaagataaacaagtagacagttgataggtccactgatgcacgccccctcacacgtcatgagtcatgatgaggaaatgcaaacgctgggacccactcatatgcctctcgcaccccgcacacccacccatccactttagctggacctttggccgctctaccctctatcaaagtaggaaataacagcagcaacaacagctcacagccgtaaaagctcacacacctcctcctcctcctcttccacgcgcgtcagtgggccgcgctgcaccgcgcattgcttcacctctgcacacctgaaaccgaaaaactcaatttggagtgaagcagggagagagagagagagagagagagaggagagaggtgtcgtggagggaagtttttgaacaaaaaatttccccaacccgttgggcacgatgccgtcatgatccccccttacctcactgccaaaaaaatttcaatatctcacccacattaatcaccttcctcacgagtctaacgagcaaaaatcccatttcatcatcattcatatcaatcctctcgatttcttccacgtccccggattctgtttcctcctcctcccccgtctcgatccctcctcctctttccctcgctccagcgcgctcgccgtcgcccggccgccgccaaccatggaagcagctggactggaggaggaggaggaggaggaggaggcgatgccatggtggtgttgccgcagcaggaggaggcggcgtccgtcgaatccaagggagtccacgtcatcggcagccgaatctatgatccggagaacctacaggtggtggcaactagagcctacaggcggggtaagctctactgcgataagtagggacgatcttggcaggggcttggtttgatggaggggttggcggcggtgtagaaaggtgactgggtaagggggtgtgactgtggaacggtgaacttgagctggcacacggctggctcaggctcaacaacacgagcaccgctccatgcacacgaactcccagtctaccacaaacgccacactccctaacgacattaccgattgggagggtgagggagagatgagaaagaggctaacatgtggccctatcctcgtcttggatccagatcaagtccatgagggatccatgtggcatatgcccacgttgtctcatggagcggatcaggggctagtttttgaccagtgatgatgcacagtatacaactcatacttgaagggttgatgcataaaaaaataattttcatgatgtcattcagagttcaattttgatcccttctactccaatgaaaaaaaaagatcggttgaaatgggacaggagagacatgttttttttgtggcgtacatatgattgtaaggatgttcggtgcagggccgtccctagcaatttggggcctgtgccaaatataaattaagaccttatctttagaaaatactattatataatagattagaattatatattatttataatacattggggtgggtatctaataccacttcttttttcttgatctgcattgcaatcaatggccttctatccacatcaagaaagctagctttaatctaatgctactttctttagctatatccacaataagcatgaattgtttttaaccaatgataactatatctatgtcaaagaagttcaccaacctacatctgtaaatgttatggcaatccggctaaatagaagaagaatttatgggatctgaaagtgcattttgagaattcagggacttcgatgacatatacgaacaagtttagggactagtcgtgtactttactaaaaaatactagtaatttggtactacagctgcgtccaatacaaatttccatccaccctacttaagaaggtggacaattggacggtttggaggccctcacacacctcgtgtatcatgaggaggaagagcaaacggtgggatctactaataagcctctcacatcctacatgcccatctgctctaaactgatctttggctgcctaccaccttgtcaaagtaagaaatatgcatcaacaacaaaagggatgtttagatccaggggtgtaaagttttggcgtgtcacatcaggtattatatagtgtgttgcatggagtgtttgggcactaacaaaaaaataataattacagaatccgtcagtaaaccgcgagaagaatttattaaacctaattaatctgtcattagcaaatgtttactgtagaaccacattgtcaaatcatagagcaattaggcttaaaagattcatctcgcaaattagccgcaatctatgtaattagttattttttagcctatatttaatacttcatgcatgtgtttaaacgtttgatgtgacagggtgaaaaattttgaggtgggatctaaacagggccaaaaacacattcccaaaatcgaggaaacctagtggctagggcctaaggtagcatatttacattaattattgattaggtggtacaatgaagacaatagcaaaagggagaggcagtacaactccctattaaactcatgttaatatctattcgactaacttagtaatatctttgttctatagtcgatgcatcctaaagtaaaccagtgattcatatattgaatatatttttttagttgattcaaatataaagtctctactagtaatttgaaactacatatgaatccaaaataatttttcatctaatcatttaagaaagggcgaaaagtggatggctgattggttatgccccctcatagctcatgagtcatgaggaggaagagcggatggtgggtcccaatcatatgattctcacaactagcataccccctcatctactctaaacgaacctttggctgcctattgcattcttaaagtaagaaacaacaataacaaacaccttgccttgaattgagtggacctagtagccagagccttaggtggtacaaagaagcccatgatgaggaggtagtccaatccctatattgaacctatggcccgtttggttggagggagtttttaggagggattgggagtttagagggatgaggctattaagtgttttgtttggttggaagacatgtgaattttgatgggatggagatgggtaattgaggaaggaactccctccttttcaatacctgggtaggggcaggtaattgggagggaattcctcctttactttgtctaagcaaatatcagccatccgtttttattaatgacataatctccaactaaactccctatcaatttccatcacctctaccaaacaagatattgggattaaaaatcaaattcccatcttaatctcatcatcaattccctcgtgtaaactcccaatccccttccctcgagttaccaaacaagttgctatgttattagttttttttaaagaaaggaagaaacatatgctattaactattagatgtactcacctattttacctttgtattaatatatttgccgtatagttgacgcatttcaatgtaaaccagcgattcaaatattgatttttttttgaaagatccaaatatataaacgttactaccaatctgtcgttgaagataagtcaaaaacaaattcccatccacctatttaagaaggcggacaagtggacggttggtaggctcatcgatgtgcccccctcacacctcatgagacatgatgataaagagcgaacgatggggcccactcgtatgcctctcgcaccctgcactcccacccatctgttttagctggacctttggccgctatactattaaaatggagaagtagtgcaacccctattataacccatgttattaaatactatatctattcaaccacattaatgttgtatttatatttttctctatagtcgttgtattccaaagtaaacgcgtgattcttatattgaatataattaaacgcgtgattcttatattgaatataatttttcaatagatcaaaatataaagtctaacaataatttttcactacatatgaatccaaaacaaaatttccatccacccatttaaggtgggaaagcggatggctggttgtcccaccaatatagcccttcacacctcatgagtcaatgaggaagagtggacggttgatcccagtcatatgcctctgacaactaattacccactcatgtagtctagacaaacctttggctgcctagcaatctcaaataaagaaacaatgttaacaaacactttccccgaatagagtagcccgagacttatgtggtataaggaagtccatggtaagaagtagttcaattcctttattcaaacctatggtatattcatatatcttattctttgtgttaattttttttatagttaattctaaagtaaaccaactattcactaacagaattttttaaagatccaaatatataaaggttactagcaatttgtttctaaagattagtccaaaattcatttctatccacctacttaagaaggtgaaaaagtggacgattggtaggaccaccgatgcacccctcaaacctcatgaatcagagcgaacggtggggtccactcatatgcttctcacaccctgcacacccgccccgtatgttttagccggaatttttgtcattctgctattaaaagaaatagtaaatattccatgacgtgtcatgagcaggatatcatgtcttgatcatatgcctattataactagcatacccacttatctagtctagaaaaacctttggctgcctaatatattctaaattaagaaataacaatactccctccgtcccaaaaaaagtgcagttttgtactattcatctccaacgtttgaccgttcgtcttatttgaaaaaaacttatgattactatttttattgttattagatgataaaacatgaatagtactttatgtgtgactaattttttaaaaaaaatttataaatttttcaaataagacggatggtcaaacgttggacacggattttcacggctgcacttattttgtgacggaggtagtagtaaacaccttcccctgaatcgagtggacctagagtattaataagggggtagtccaacccctctcgttgaaacctatgttatttaacaattagatatactcatctactttatctttgattaatatctttgctgtataattgatgcaatatcttcacatattatatatatatattttttcaaatggtcccgatatataaaaacaataattcttcactaaagataagtcaaaaataaatttctatctacctactttaaataagtagatagttggtaggcccactgacgcacaccccctcacacctcatgagtcatgacgaggaagagcaaacggtgggacccactcatatacctctggcaccccgcacacccacccatccgctttagctggacctttggccgctctaccgtcaaaccaagcaagctgtcaaaggaaatagtaggaaataacagcagcaacaacagctcacacagacacacacctcctccccctttgacaattgacaccccctcctcttccttccacgcgcgttagcgggccgcgcggcgccgcgcattgcttcacctccgctccgcgcggctgaaaccgaaaaaaacccaatttggatcgaagcggggagagaggacttgaggagacgcgtcgtggagggaagtttttgaaaaaaattttccccaacccgctgggcgcgatgccgtcatgatcccccccctcgcctcgctgcccaaaaatttttcaatctctctcgcccacattaatcaccttcctcacgaggccaacgagcagaaatcccatttcatcatcattcataccaatcctctcggtttcttccgcgtccccggattcagtttcctcctcctctccccccctctcgatccctcctcctcttcccctcgttccagcgcgctcgccgtcgcccgccgccgtccgccgaccatggaagcagctggagtggaggtgaacggaggaggaggaggcgacgtcgtggtggtggtgccgcagcagcatgaggtggcggcgaagcaagcggcggcggcggcggcggcgaaggggaagtccgtcgaatccaagggggtccgcgtcgtcggcggccggatctatgatccggagaacggcaagacctgccaccaggtaaccccttcttcttcttcccacctacctgcctgcctaccatctgttcgacaccgtgtctagccggtgtcctatgaggagtcgtgcgtccctgttcttcctccccggtggttgggtcgggttggatctgaggaattcttgctcgcccccccttgtttttgcggggaattcttgctcacccttgggtttagcgggtgctctgtttcttgctccctcgcagtgccgtcagaagacgatggacttcgccgcgtcatgccacaagatcaagaagaacaacaagcagtgcacgatccagtactgccgcaagtgtctctttaacaggtgaggggggaatttcttctcgtcttctttcttagcttcaggaggcagagcaaggctggctgaccatgtgatttctgagtgattcgtggcgcaggtacggccaggaagccgagaaggtggccaatgacggcacctggacttgccccaagtgcaaggatatctgcaattgcagcttctgcatgtgagctgaccaaacctgatgctctaccggtcatgctgattatctgtggctcgcgttttgttgtcagaagtgatggatggactttgatttgtttggcaggaagaagaaggggctgccgcccaccggaatacttgcccatgctgctaaggcttcaggttgtgcttcggtccatcatttactgaaaaaggggaaagaagcggtggctgccgcgcagaggagcacccagaaagtgagatctacacctgtgaaggtgtgtggtgttcaggattggcacgatcctttgtcacattacaattcgctgttgcatggtacgattgttcactatgtttgatatgttttgctgatcctttttttatgaacaagcagaagagcccaaagagggccatacagccagatgctgctgctgatgaacctttggctgaaggggatgagaatgtatgcattgatttcaatgctgctccagtgaagaagcagaagagaagcaggaaggtgggtaatggtgtggctctgacgaaggatgaaagccctgatgctcccaaggaacaagttgttctgcccaagggcactccagtcactagtgttgccggtgcagagtgggagcctgaagatgttggtcttgcacttcagttcttcgaattctgccgcacatttgctgaggtagttacgaaagaaagatcaaggatatttaatagtatgattgcacatgccttgtcagagtaatatcttactagcatttgcaagagaataatagatcgagttttttttttctatttacatgtctgatgcatgttatgttttggtatgaagtatgacaatgtaaaaaatgcttttactggtaagcaccgaagtgttgatattagagcttcctacaagtttggaatcatatctatgtgtttatgtaggtaaggcatgcaatgccatgatgggatacaaatcataaagggaataggtattcggattagaatttggagagggagatggtggggtgaccgggtgacagcaaatgggcaaaaggaaatatatgactacctgttgagttcattgtacgcattaaatggatgcgatttctctgcgtgcaacatgctaacacctagatacaggctatctgttaattgccctttaatgtgtacaatattcgagttcctatttgtaattatgaggtttcttttttattgcatggcacttcttgtccatatgatatacatgttaacattgataaactggtcgaaaccttccaattatatttcttggtttgtaatttaagccatgtagtagctttcatataacccaaattaaatgttattatgttctgtcgaatttttttatttgtgataggctgcgtgttcaactgaactaccaaagctatgttttaaagttttttttttaaggaaactaccaaagttatgtttcatcctatacaatatctcttgcaaaaggtatgtataaagctccattgttttacacatagtttgagcaaagttcaaacttctgagcaaaacaactatctattccatctgttccaaaatataagcatttctgactatttacctgaacggaaatgcttatattttggaacgagggagtaagtgatagcgaagcttattcttttctgtgcgagtttataatttatttcttctgttatagaccaaacatccaagtccttaaggcataattttggtaaccagcaaaacattgtaacagttgttttattaggcgatgtgatagttatcttaatcttttatgtttatttctaacaagtgtcatggaacaattagtgtaaaatttttgcaactaccgtgagtcctgttccattacaattgttgcatcatacttcctccgtttcataatgtaagactttctagcattgtctacattcatatagatgttaatgaatctagacatatatgtgtgtttagattcattaacatctatatgaatgtggacaaacctagaaagtcttacattatgaaacggagggagtaacttcttagtgttttttagagttttccttttgaattcgggcttaggatcgctttgcgttataatctgaagtatttagtcattgccgcaagtgatcgctgcgatgcaatgcgagcagagttgagcgaacagtctgtcatgtaagagtacctgtatctgagcacaaactaaccatgggcgcgtcatgcttatatctaggatgtactcaataatttacaaccccaagtgtatcgttttacggtctgatctcgtgcatatatcgtgcatatgctctctttttgcttctatgtaaactccttgtttcaataataataatacaaggataacgcagtaattaatttattgagattgctgtgggcgttggttttgaactattcttttttctgctattttgttttacatatataaagcatgcatttattttctggtgtacttaacaatttgagaaaatagtcacagtttgctgctagcattacaggctttttaattgaatcagatattttaaaacaatatcttgtttccttagttaatatactaatctgctctacatgctcacatggtacattgagattatattttgtattgcaaatggaataacatactgatttttccccacagattttccaagtacgcaagggtcaaccagaaagaatccttcgggacatagctggaggtcgtggacttcgagtggtgtcctcagtcatcgctgacttccacataactttgttatccatcatccaagaaggccgaggaatcaagtaagtagatcccaaaccgagccttttttttttctaaatgcagttgataaaattataattatgttgttttcttctcaggcctatcacatattcaagagataatgatgcatggattgttgatactggaaaatgcataagcgagtcaatctttgtcccagagggacttccccttgactccctaagtcagggggtatcgggatataaaaatctgagcccttcttgtaagctcagtgttctgaactttttgtgtgatgaaagtctttctactgagtaagtattgcctacacatttgttaatacttcccttcgctattgtgatgttgttatttctgattttttaaattactcttaacattgttcaggaagttgaggagctgcatattatctgaaacaaaaaacccctccagagaaaaagctcattctgcaaaagagaaggttttgatcttggcttgcctttcccaccttgtcacatggttctagaacaattgacaaaatatctcctgtttgttaggaggagccaaaagaagaaactataaagaacacagatgaagcagtgcttttgaaaactgaaggagcagctgttgctattgaggaagataagaatggcatttctcaacaaaaggatgtgaaagaagtaaagaatgcagacacaaatggtatgaattatattgctaaacatgcttcgtcatagccttttaaacagattactttagaacattttgcatgatctcctgcactgtttatttcctgtaatgcgaaggaaaataagctgatcattgttattaattttgttctcaactatgaactatggcaacatcagaaaagaagcatggaggtttccttaggactaatcctttcatggtagacaaaaaggtaatctattggaagctggatgactattgtaataacacaacaatgatgctccaaggtttgttggaaagcgttattcaacatccttccactaatttcagttctgcattataaaattggagacgattaacatctgtctgtatcagaggttgatgctgatgatttaatggggaacaaagacaagtggtttatgcttaatgaagatgaaaagaaaatagttgaaaactatttatccacaaggtaaggatttctccatatcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcactggggatattatttcctgaaaatgtagtgtattgtgattccacaaagctcaaatatctcaactgaatcattccaatatgcttagttatgatcaagaaactttagtagcataaaatggtcggtgaagcactttgtccagacatctgactaactgaagtgatgtactgcattaaataaagtttattttatatatcatacttgcattttcaatgttccatggccatattactggatatggatgaatatatctgtgtttttgtgtacctcactactataacttgcactgtccacacattttcctagctgaagtgatgcaccacattaattaattatagcttgcattgtccacatattttcctagctgaagtgatgcaccgcattagttaagagtttattttgcatatcaagctagtggttccttattttctacttgactgaaacttttgtataatacagggtttagtatgataattgataatgaagtgagatattgagatgtaacatctttgttccccactagttttatgttgtaatttcaggaaatattttaaaaaaataatcaaaatttgacatcagaagtttagacgagtatgcagagaattactgccaagattggatgaccatcactggcttaactattaaggaattagtttatttattactatcataataatgcaatcagttatctttttaataacagaatccaaactatcagttctgatgttttcactgttgatctaaaggtgctatacaaatgtttcaagaatcaagattatataggttacaaaaaaattgccatgtatgttgacatgctgaagtttcatcttgtccttgtgatgaatgcaatgatacttgttgctcattgattaaaactaacgtattagcatattctacttccaacttctgaaatagcatatcagtaacttgttatcgctttcctcaattggcaatgttttaatacctaatattgctttcaataactttctctctttactcttatatcagatcacacaagctaactaagttcactttgtttttgtcaactccatgaatagtagaaattgtctttgtcgacacagtttgtcactgatctgacatgtgattttaactggtaatacaggcctaaacgcagggggagaaaagctgcacaatagtctactgatcatactctctaggttcctcacctggctgaaggtacccttttaattcagcacaccccttttcatttctttagtttattattaccattttgagtttagttttgtatgggtcctgcatctagactacgctaggagttcccatatcattttgtttatgtgacactgcctacatcaatcttcttacttttacatgttatcaatcggatagttgtatttttgttgatttaattttgagtagataatttggaatgcgatacatgctatgatctatgatttggtattttgctactttttacggaatttgtagcctgctagatgttcttacaaagatatgagaatccatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttggcaggtgggtggactatgctagttgagataaggcaacctctgttgaggccagaagggccattttttgctacagaaaatttgcgcaattacagaagaaccaagaattgttggatcattcacagaaattgaatcagaagcttgaacaagttttgtccagatggcaaagccggcaacttttgtaacacctttgcagtttcctagatgatactgacggaaaatgtttcagtatgatcgcgttatactgaaatgttgcactatagcaagagtttgctatagtcagtcaacccccgttaccgtggtgtggttaaagttaaactgttgtgtgtaacatgtgactgtcgataatgactatccatccattcagttcagtgctttagatgcctttgatttttccccccttcagggctttactgggttatctgtgttagctcacttgcagcacgggtgactttcacaaacaagtgacaatggcaattccttgccttgtcacaattggagaaattgacatgattttccagatggtccggatattattatgctccaattattcttgattggtttagtgatttgccctttccagattgcggactaggggttaggattacatgagtactcataggaaaaagtaaggggcaaaacctacgtgaagtctagcgtcagcttggtatagtttggttctgataatttgttgttggtcactatggtctctacagatagtattctactgtagaaaagtaccattggtttatgtatttgattagtagaaaattccactgccatatttgaggtagtagtagtatggatagatatagcctattggacgaggaaagatagaaagtctagacttaataaattttggtccaaaactttcttctgtattaggtaaggcatcttccatcattttggttttgtgtttttttttatgaagcacacaaactatgtttgttttaactctctaggattccatgaacatgtggtccaaagattctatcatacttttgtcaagtcaaaaaaagttgctagttttgtagcggcctgcaccacacctccacagtgtggccaaagaagaaaaatctatggacaaactcctattatcttcacccataggatgtactaaatcaccccctaagaatgcctttagagtctagggggtcactagtaaacacctacatactggtggatcgaaatgggcatcacttctagtttggaaccagtggtgagaaagaaatagtgatgttttacggtaataaaattgaaggaaaaaaaatagcacctaggccagctccagttcatactctgagttaccttctagttccttgcacgacaccttgtgcgcacggtggccccttgaggtgcttgcgggtcccgtcttcattggaccctatttgtcgttgtcaaccccatatcttacaagaactgactagatctagtagcctcaagtttggagcaaccaaatctgacactacaatgcctctcgctttgccactcatccttgtcacccaagaccatggttgttttgttgcttgttcctaggccaatcgccatcatcaccatcacctgcgctcagagcacccagatctggcaattagatctagcagccgtaatattgcaacaatcaaatcaatcaacccggagctctggctagatagatttgattgttcaagggcaagtgtgggtggagagaaagagagggggcggagggtaggggagggagatcaagggcgagtgtggatggagagaaagagagggggcggcgggcagggaagagaggggatgtgaatcagtaagggttgagggagactaggtatttaacgatagtgtaggaaagtggctcaatttggccttactcggctgttactatcacttcttgtttctatcttgaacatgtggtgataaattttgttattagtggatcaaaatgaattaatacttatagaaggttaggctatgtgtttgctcacaagtgggtcatagatcaatctattgttatgccaaccataacattctaaggtatggtgacaaaagtgctagcagactgagcttttaagaaccaaagtagacggacacacatccttttgttatactacgagcacctttaatttgtaggaaaatataggaattttggaggattataatcctattggaaaatttccaattcctctctcatccaattatatctctttcatccaatttctacgtttttccagcggtctaatcaaacagtcattcttatattttttctacgttttacaatcctctgtttgtttgcacttgtattcctattagaattctgtgttttttctattctttcgttttttccattcctatgattcaaaaatgcccgacatatgcataaggtgtcattgatagatggatcccacttgctctaggaccatatgtcagtaacacatactgcatatgcagtacaagcaaaggatctcatttaaggccttgtttagttcgcgaaaaaaaaatttttgtgtcacatcggacgtttgaccggatgtcggaaggagttttcggacacgaatgaaaaaactaatttcataactcgcctggaaaccacgagatgaatttattaagcctaattaatccatcattagtacatgtgggttactgtagcacttatggctaatcatggactaattaggctcaaaagattcgtctcacgatttccatgcaaactgtgcaagtaaatttttttgtttatctatatttaatacttcatgcatgcgtccaaagattcgatataacgtttttgagaaaaaaaatttggaaactaaacaaggcctaaattagatctggtagtagcagaccctagtgcaaaagtgcacccaataacatgtatcagtagtactcacggttatgtgctaaaaggtagaatttcactgattgtgtattttgccacatgttacaaatttccgttttttcttgttatttttcttgcaaatgcaggtgcatactgtcaatattgtaatttattaaagaatttttcataacttctaatgtggggtttctgggcatgggaccaccgatagtaatgtttacctagtacgtactcccttcgtcccaaaatataaaggattttgaatggatgaatatttcctagtattacgaatctggataggctaggaaatatccaatccgtccaaaatcccttatattttgggacggagggagtatattatgggccatataattgacaataaggatacattacttttgagctaggcaggtgaagagggagatgagaccaagaagagagagaatattattttaaacaacatgtgttgtaggcctacggatttgtgcatggaattaacgaatatgcaatactacacaaatggcttttgttaaaaccacctcatcacaaggtctggatcatcctgcctattgagtgttgaactggtaattatagtttttttaataaaaaagttagataatttttcatataaagtcagataaaaataaactttatatccataagtattgttgtagaacttaagaatatttacaatctatagttgacaacctttatatttaagatcattcatatgtctgtatacgtgttagaaggtctagagactattttgttgaggccaaaatttgactttactacacggctttgtatggtgattggagacaaactttatatcatggtttttaaggtggtaaggtgaccccggactaccttacaggtaaggcttaaggcgagatgacgtcttaggcacatcaaagctgcattttaagagcagtacgacacacatatataccttgttcttggcaactcttaagcccatgtagcatccaatacctacatggcagcatccacccccttagaagcatcaccattttttgtgttatgaagataataatagatgcataattgtaaacaatagttaataaattgcttccatttacttgagtagcataccttgttgatgacctgaaagcagcaaggcacattattgatgagcaagatgataatataaagccataaattcaaagacaacaaagtaagcatttgagcacgagtaaattgcatattggaccactatattttacaactctatcagcttggactattggtagatctacatttccctattggactgggtaaatttacaaaggtttcagtttggggctgttcttgtacctgtagctccctctctcctctctttgtgtactctctctctctctcgctctctctctctctctctcttcctttgtgggcaagaaaagaaccactgggtgggctcaagactgtagcatggagctgccggccgagctcaacttaagtgcaatgccggagctgttggggctaaggccgagagctgagctggctgctgactgggctcaaggctgagcatgacactgagccaccaatgactctcgaggccgagcatggtgtaagccctaacagggctcgaggtcatggtcaagtgcgtagtctgcttcgagcggatgccaacagtggacgtgctactagtggagaggggtggaggggctaccataggttgttgcttcgctaaagcatggctactacagggaaatcatcatcatcatgggtggtgttatccaatttgccacaacaacttgcgtgatggctctcaccgtggtcagcggcgctcggcctcttgcctccacttgccaacgcatggcatgaagtacgtctctgacatgtcacagtccacacaacaaacaaaccaaattatacaatcggtatgcactgacggactaaccatccatttattcgcctcggccacattgatctccacattgttgggtaaaggaccggcttgctggtcatcttcgtgatggagagggtcagaccatttactagcggtcaccaggttcatcaccttcttgatggggtggtgtagttcggtgatggctctgagatatggagaagagggaggagcgctagaggttgaagaactagcccaagctgaagcaactggtaaagataaagtggtctaaagtgaaaaagtttgtttgtccttagtccaatttgcaacaatggtaaaaaagagcggctcaaggtgcaatttactctaaacataataaactatcaagcaggctaacctagcaggcaagtaaacataataacaaagcaaaatagtgggagctatcatatacctaatggcgtataaagataatagtggtccataactccacactccacactccacactctaaacaaatatactataagtccaactccttgtctcttagtattcatcatcaaactcatcgaaattgccattggcatccaaattctcttagccatcttcaatacctgcgtgagcttcatcacaattgctcacatttgcatcattaggtggatcttcctccttatcttcttcttggtcagattgcatatcttcctcatcttcttcaaacattgttgtattccttgggtgcctttgaaaggttattggaacaacaaggttgtgaactctccttagaacatgcgattgttgtcggtagataagtgcaaactttcaccgtcaactcctgcataaaagaatacaaaatataatatcaaacttagtggtaggggtttattactaaccatttccactagtctttgtaaatattggtatgcaggtgatttttgaaagaaaatgcactcgccatgagactaaatgtacctccgaccaaccatacgcaagcacaaggatcggagagcccacatgtcagtcaaaactaactgaatttgagctaatccaccgtcaactgccaaaggggtccactgtcatacaccggagaatgtcggtggccaatggcggtgtgcctggttcggctgatccaaggttggcgcccccagccacctccttgcacgtggcgaccccctattggttggtgatggcgg

SEQ ID NO: 30221 - DNA, 1201 bp, Oryza sativa
catttcaagcgtcatatgaaggctataaaaggaggagttcaactcacttccgaaacacacatctcaagtggagtacaactcactttcatattttaggcatctctttagtgtgtggaattaggtaaagagtgaggtaaagctccggaaggagtgccccaaatatcggagttcttcttccactggagtttcggagaagtgatggagttatcggccttcttctctcgtttgtatcttaacggatgcttcttaagtaagtatttgagatctccttatggtatttaatttagttgcttgaatgacatatattcccatcgttgcgggttcgtcgcttagttgaattattaagtgctctagtactaggattctagataaagaaggaagttcctgcgtggggctagagtagtaatcaataacttaggtgtggtgtttaggttagcggttacctttttttgttgtgtgctccatagaaagtgaggtaggcggaaggtggtgatagccttgtccatcctttgtatccctccatgttcaggtacatcatagagccgtaggctggattcagcttggcagaccagcggagggctagtgccagaagcaatcgatagggttttacctttaactcaagtctagtaaattaatccataggaatcctctttagccttagcctaccattagttgttgtccttggatagaattatgttcctagatatatgcacatgttttctgtgattcgatacccttggaatactctgaggtgaagtgctacagcggtattcgtgcgcttgcggatttatctgtgaccgtatcaaataccaacagcgagctcaaagagatcgtgatgcaccaacaacttcatcaacatcatcctatgtaatgtcacatccacgaaaaccttcaactggttcatgtaaggaattatcccactcattgttccaatcaaactcctcaatgacttaaggatctggccttttcctgctttctcacgcctaagctgaaacctagtttccatcttccagttataggcaacaaaaacaacatcattcaatctcttgtgtactaactggttcattttctttgtatggatctgcagggatgcaaataacaagggaagaaaaaaaaggataaataacttgctgatatagtaaagaaatttaaagcaaaactacagataaactgactcgcaaatccaaatgttctccaattg

SEQ ID NO: 30222 - DNA, 1782 bp, Oryza sativa
cttaagaatctgggcttttccttgctttctcacgcgtaagctgaaacctagtttccatcttcaagttatagcaacaaaaacaacatcattcaatctcttgtgtactaactggttcattttctttgtatggatctgcaggcatgcaaataccaagggaagaaaaaaaaggataaataacttgctgatatagtaaagaaatttaaagcaaaactacagataaactgactcgcaaatccaaatgttctccaattgagctcacaactggataaaaaagctcaattggatcttctctttggcatgcgtcattagtcttgaaacctctagcatagcgggcttctcatcgccatcaacaactcttagcacaataagtaatggggttgaagctctgatacaatcttcaatagaggaccaaaatttcttagagagaacaatgccagtcacttatattattgcctttgtttttgctaatttgatcccagtccattgttcactcacaaataggcttctcaattcatctctttggctataattgctcttcaaagtaagataagttgtggcaaatcgagtgacagctggtcttaaaagattctttccacttgtcttctccctcattgcactaagaagcctcccatgtctataaatgaaagtggtgacacgcttagcacgggcaatggggtttttaaattccttcagtttccctatgtccttcaacataagatccaaacaatgtgcagcacaaggagtcctatacaatgtgagaattctctccattagaagcttatctgttgcatgtattagcaccattatcagtgacaacttgaacaaccttctcctttccaatgatctcaattctcttctctagcaaattagctaacatagttgcattatgtgtttgtaacattctgaaaattcctaataataaaaatcactaaaatttcgaactttttaaaaacttttgcatcatgctgggtgttatggttgtcattgcttgccaaatataaattgtaacaatggagaatcaaattaatggcgtacacctgaacaataaatatatacattagtgcgcaagaaagcaagccaaataaaatattaatttctattataaatcatagatcaaatattaaatattcgaaccatgttgatagctcgatgtcatgtttaactaatgggattgtaagattaaatctaatgtatttggatccaatctcacatgaagtattataaatccacatgaaatgatgattactactataatgatcctattaacaaatgagaatttcatgggaatatatatacattaatatttgaacacttgataaagtcactcatataaaataatggtcatataattaaattaagctttataaaattatgtgagtttttaattaaacaattagattaatattgtgccgagtctcaatttactatttatagaataaatagattgaacccatccgtgcaaaatatattgctatacaactaaactcgaccaatctgctaatgtattaatcatgacaagtcgttatattaaattcaatattaccccaaagtcttcaaaaatatataagttcaccttagggtcaataacccaaattaatctaaaaagaattcatttgtgcgataaataaataaatatgggtggtaataatttggataaattttcatgaggattaagtacttaaatttagttaacatttaactaaaaaaaattagagtttgtaggattaaaattgtataggagataggctaaaatagggtttaattagggatagcactattcat

SEQ ID NO: 30223 - DNA, 15128 bp, Oryza sativa
ccgtcgcgtctcgtcactgctgtcacgccgcgcgccatcgccgtcgcgcctcgagccccacgcgccgcccgtcgcgtcgccgttagggtcatccaacccctcccccgcgctctataaaaccccggccccctgcccttcttcacccacacccattcccctccgttttccctttcttctccacacgccgtcgcctttgtgccgccgcgccggcggcttcgttccgccgcgccgttgccttgaagccgccgcactgcgccgagtgccgcgctgagcgtcgccgccttgcgccgccgccgccgccgtcggtaagccgccccccctcgcgtccggtcgccgtcgccgcccaggtaggccgtgagccgagagagagagggaggaagaaagaagccagggggagaaaggaaaaagaaaggaaaaagaaaggaaaagaaaagaaagaaaagagagagagaaggaaaaagaaaggaaaagaaaagaaagaaaagagagagaaggaaaaagagagaaaaaggaaagaaaaggaaccctgggtcccacctgtcggtcactagggttatggattagatttcggattaaaaataaatcatttatgaacagtagctttttacaatttctcgggttaattcaaatttgaatctttacactagcataacttattcattttagctccgatttgagtgaatcttgaacctaaattcatctaaattcataagctttccaatggtatatagttcactatttaataaaatatatttataattattaaataattaataccacgatgatgcataatagtcaacttaaaaatgtgctaataaataaaattgatattgtactataaagtagatgtcaaataattgtccttaacatgctttctcactgtaaaacctatgtaaactaattagcagcattgtttcaaattaattaaagcataggaaatactagtgtcaattattaatatatgtcaatatataattatactcatgacgtccgaattgtataaataatgtttagcctcatactttgtgactaaaagttgaacacacgtagatgagtctttaacttgtttatgagagataataacagagctagtgtgactaaaatcacccgcacgaaattaattaacggcatttcctgtacagtagtatatgtttaggttggaaatcgacccttaagttgtatagacggtaactcactcataaatccacttaaaatcacatgtactgtgtagctcgtagtaaatagcaactattcaaataaatgattcaatattaagatattgtgcacacacctatactgtacatcccattatagctatacggtatagtattaatttgcttgttgcatatattaaattagagggactatatgataaacaggaatattagataaatactagttataaatcttgatctcatataattatagttcaattgtaaattaggattattcattgtaaaattatgtgatgggataatttgtaaccataatatgattaacctaaacaactctaacatacaaagcacggataattattaaccttttctaatttattgtgacaagtaaaatatgttgataatcaaagtaaagcttccatcaataaaataataatacaaatgattcactgtaattatttgattgatcctaaatccatctgacaacataatctctaggatatgaccattttatttagatagatgcatgtgtaaccataatccttccatagccattagctagactaaaccaccatgacaacagaaagactaagaaactttagctcttaccttgattagaatccattagcaagcgcgaataatatgagcaaccctaggttcgacctcaacaaatatattttgtttgtgcatatttgattgttgcttgaatattggtttttctcgcgtattatagaaattgtgtatcggtcagtcgtgaggcaacgtctgcaacttccaggaggtgaaggttgatcaagattgtatcaagaataaggactattctgagcaggcaagtcatcactattccttgaacatgttgatcccaattgcgaaattgttttgtttacaaataaaattgcatgcaatgatgaacatcctacttgtgattatgccatgccttgattattgtttacccttaagatccttgtaaccatgattacgtataagtccctagtcaattatgacaattgcttagaaatgctattctagaatcatgcatactcatatttatcaaatgctatatgcttgggcaattacctttgggaagataattgagatacggcatgtggagacatgagcaccacattgccatgatattgatgacatgatttgtgaaaggagaaatgaaactaaacaactgtttttgactggggcggacggaggatttgggtggtatctggaaaaggctagtaccgtccccggtcaattaaggaccgagtcatgaagttaagcatgaaacgaaccccgtacaaccgcacttctcgtatgggtatagacctagcggagtagatagctgagcggaggcagtatccatgcatagtggtttcttgatgtgtgaggcaggggctctacggtggggcagccattggtaggaccacgaggcgggtgtctacagtggtgtcgccatcggtaggactgccatgtgagaatctaaacataattataacttaatgcatgtgtgagtcttcccttcccgggtgcgctagaactcctctcactgctagaaaccgtgtatgcctagagtgcatgaggatgtaaagttcatggagcggatactgccaatgcgaggttatcgaaaagctttgtcgtgacgcgtctcatgtgttgggatgaggctcatgtgttgggcagtcgcagagtgcgggtaaagtgtacatccactgcagtgtgagtaaaccaaatctattcgaatagccgtgctcgcggttattgagcaccgggacgtgtattacacttggctagactctaaattcttaacttgtgtgggatgggatattgcatgatgatttttatgctgttggagccacttcctgagaggagggaaggtggacgtcctcagaaaaccatgaggattcaatggcgggaagctatcattgggatcacaatggatggtggacagaaccgtcgttgtttaatgtgaacactggaactaaaatttgatcagtctatgctaggtcttaggcttgtaaaaatatttgcaaaacgcagctttacgcaaaagaacctgaagccattccttgaataccctttatcatatgcattgctgttgtggtggtttgctgagtacggttggtactcacccttgctatttatatatcttttaggagagcgctgaagagaagcccttgttagtacgcttgcgtatccaacaagatgatcggagtgcggtcttgttctaggtctcgttccccagtcgactgcctgtggcatgttaaccgggcccttatattattttgtcttccgctgttgctctctgatagttgttagcctacctggccctaatgtaagtattaactctcttagcctgaattcattcgtgatatgttgtgatccaactatgaatgtgtgtaccaactactgatccagggattggtacggataaacacagaagatttccgatttccaaaatcgggggtctacagtgtttcacttgatgcatcaaaagactccaagaagtaagcccacagcatgcaagttaattaggtggcgcccctcctatctatccatcgatctgacataaaggtggagccatactacttccatgctagctctgtagctcatgatcaacctttattttacctttattttacttgtgtcttggacatagtcctaaatcaaggtctcccttaacatgtgcttactcataggcttgtaacccgaaccatattatgcggtggcctcacaagcaatctcaaactgccttgaggttgcaacattgaatggtatgccatactcatagaaccacaataccccttgcatatccacataatgcttatcttcctttctctttgtactctccatggtgctttggaaccaatcaaagcgcgtccatctacaatcttttcaactgtttttctaaccgtagcaataattgtcttggtctcctttggcttggctttttttttttactattggagctctgaaatcgtaggttgctcttcttctttttgctgttatcccactagaaggtacaactggcatagaaaaggatgttgttacattttgatctagcagaacctccacatttccccctttcttcatctcccaagaatattgtccgttttttttttgttcttgtgcaaccgattttgcatttgtttcatgagttctttatcaattttgatacaaactaaaacatctccatagccacctgctagatgctgcttcagccttgtagcccctccatttgtcacctccccacaaagattacatgtcactaagtttgtgtttctaattactatcaaatagccgcacttccaagctggatcctttgcatggtggcctccgttttggatcagttataggatcatacccagcctcaggggcagcagcaatagttgttatcgtggttgctgcataaaagattgcactttgataaaatatacaaattgatgagcaacagttgagggatgggctccagtgtcactctgaaggatttctggagcctgtctccataggaaagatccctcccttttgcgctagatggggccccacccctccatttcgaagaagcggaggcctctagccagtttccactggcgcgcataaccccgtgctccagttggggggcatgatcaagactactccgaggcttcagctcatgagccattaaagacgagacaaggcaggaggcagttaatgcccacctactagccgctttgctccaacaagtcgtgcagcgggaggcaatcgagatccttgcgacttgggcccatcatgacacatcagatcctaggatccacaggatccatgtcggcccatgcaacatcttgggccacccacgacggtgtctggtgtagttacgggtgtgctcctaggtggagcccacttgttagtaggaagttcccgggcctacttgtaggaggcctacatgatcaatgatgtaatttcccatgtacatatgctaagcatataaatgtgcgatgtcgccttagtgaaggcaggattctcatcaatctcataagtctcactcttctagtagttcacacaacttgtacactcccatagctattggatttggttccaacaacaactagcaaccaacaactagctagcagatcaaggcagcaagtattaacaatttatacatatgcatacttgaatatactaatctgccacttgcaaaaggaaactttgcaatagcataaaccctagagatcagccactagatgggtataataatcagataaccagaaaaaaaataataaccaaaagaaggtacaagtgtatacaacaacaggggatttaacggagggaggggcgggggggggggggagcagagatgaagcaagcgatcagcagtggaagaaaaattttggaacagagacacacatctgctaatttggaactctatcaaggagatccaagaatgttgcccaggaaaacaattgctgaacacatcactttatccagcactagcactgaagcaaattttgtcaactattcatggatgggatgaaaatattccgaaaaggtcaaaatcgttagcatcttttcagaaatgatgttcggtcagttagtaattcaccatatttatcaatttaactgttccgtgtcaacatcaatacaacgctgaaagaaatgagaacaaaaattcaacatttatatatttctaaaaagggaaacaatcagaaatagtatgacttatatggaaatgacgctcggtcggttgggaattttcatgaccattttcatcctagcaaggtatatctgttcagtggaatctgtttgaaagaacaatggaaaaaaaactcccaacactagataaatcggtttcttttatttgcaataatcaacagatccttaattaaataacaagtaattgaaggcagaaatttagtaaaataagaaggatgctagagtggatagcgtccaagccaggacactactagaaacattatctggataaggacactatcaaaaacatcatccacaatctgggtcagcccaatccacacatttgtctattgctggccaccttaggcccccaaaatctcctcccatattgggcacttaattcttccttcctacgttacatttggactgacctctcacagcatgagttaacatacacagcaagcaatttgaatggatttgtctattagtacttaaacatgtacatggcagcaatttatctgtcaatatattgaggatccatggtcctgaacaaaatgtattgtttcattcaaatcagaaattacattcaacatttatacatccacatccaactaagccccaactgcaatgaaatttgttgttctaacaatgtacacaatcatgtaagcttaattgggctatgttcagactgacagcaccatcaagatattacttacaataactaatcgatgataaaccccgggttgactttggttgataaagtggctgataatctcccggggtgggaagcctccctcatgaatatagctagtaggctgattatggtcaaggtggtcctcacggcggttcatatttatctcatgatggtaatggatcttccaaaatgggtgatcaaagctattgataaagagtaaaaggcgaaggtgtttcctttggaaaggacaggaaaatgctagactgctagtgatggtagctgcctagtctttgggatcatgtttaccgactactccaatatggtggtcttggacttcataactaagagaaactaggatgggctctaagaatgtgatggctatggctccaaaagaccgatcccacaaggccatgggctgggctgcccattcaagtgccgcaaagtgttcacgcacttttcaacgttgtggtggttactacagatggtaatgggaggagaccaagttttggactgactgctggctgaaagggaaaaaaattgtagaatgggctcctaacctctttcttatgatccctaaaaagataaaagaaagcagagaacaatagtgcaagctcttataaatagaagatgggtagatgatatactaggaagcctcactatgctggtcatttatgaatatttacaattatgtgacttggtggatgggttaattttgcaatgtgttggagcagtatgtttagaaaatctctgggtcgggatcttacacaagtaaatatgcttatgatactttgtgggatccatcagatttgcaccttggagcagaatatggaaaagttgggcccctaccatgcaaattcttcacttggttggcagtaaataaccgaggttgaacttccgaccgccttgccaagttcgggttgcaacaccgggaggcatgcacactttgtgatcaggaagaagaaaccatttaacatctcttcgtcaaatgtgttttctcccgacaactttggtttttgatccttgagaagattggaatggcagctgcagcacctcagtcctcttcaactcgtttctctaactagtggtttaaggccattcaaaaagtccctaagaaggaaaagaagggcttgaattccttgtttatcctagtggcttgggaaatttggaagggtcataacgaccgtgtttttaatggggtacacctaatattttggtggttgttcaagcaggaaagtaccctttggagtattgctggggccaaagctccacgagctttttgtaggtcgctacctcttgatggctaattcctcttaggcctagttctttttctcaacttcaaactttgacttcctcgttttccgttagcacgtttttcaaactgttaaatgttgtgtttttggcaaaaagtttctacgtaaaagttatttaaaaaaatcgaataaatccattttttaattttataataattaatacttaattaattatgtgctaatgagttttctcatttcatgtgcaccggaaatgtccctctaatcggagagaacgaacggggccttagaggttgttttagtggtgtgtcatgttgtgacgcccttttcttttttggtgtcgcttgagggatactttggttctctctcttgtaaatatttcttttcttcttcatgaaatgaagcacaattctcatgcgttttcaataactaattgatgatatattattatgtggcattggagttgataattcaagttacaatacgattataacttgcatagaacttccctttaagaaactctacgggactccatccaagttatctttcccacccattgagttgaagctcttcacaattttcattgctactccaaaattggtgagtacacatcatttattatttccataattatatacaccatttattattttcataataatcgtcaagattaatttggagtagccaaagcctcgccaactggagtctacacatctttgtttgtgatattttatattattgtaaaacatgatccatgttatttatcccttcattatttgtttgcagaataaattacatctaatcgacatgttattcttttaaaatgttattaaggcatagttttctcaagcctatgctcgtatataaaaattgggtgaagatcataagcaagaccaaatacatcacaaaaggcaaagagaaattacttttacgtattgcagttttttactaatcccttctagacctgcgagttttgctcaattctctatatacctctgagttctggtttttttcccttagatgcctgatctatctaataagtatgaaaaggcctgttttgaccccttttttagtcaagaaaattaacttctagctattttggttgggcacttttatttttattgttgataataaatcattttacaaattactattgcttcggtgcttcccttcaaatctgtttgtaattcattgggtcaatgccaaagcggttaatgggacaagaaaatgattttaaatttaaaatccagtgagaaaataccaaaattacaaaatttatgtatttttggcaatttcatcctcttgattctttttttcaaaattagaaaatagttactaggtgtggttttgatctaggtagggtgtcttctttctttgggtttctagtgaggggcaataatgatagatcatggttggatccaggacattcaaggtgctatttctggtggagtcctagcggattttctcaatctatgagatatgctttctaagattgttttatagctcggcatgaaggatattcatagatggagattctcaactttaggcatagtggaaaaaaacggaccgggctggtggttcaacaggaaaaaactagaaccaaaggtctccaattttcggttgagcctaaagaccggacatgcattcaacccgaatagaaacgactgaaccgaccgggtttagatctccatggttcggttgagcttaaagaccggacatgcattcgacccggataaaaaacaactgaacggactaggtttagactataccgggcactaaaccactttggtacaaccgggtaaaaggagataaatgggccaaattaaggcccagtccattgccttcaggcccacgcggctgtttttttttacaaaaatcataggaaggcttgtggtatagggactcgaaactgggtttgtgcattgagagcgcttggctctagccatcctacccttgttcccttgtattttagagcaaatacacaccgtatatatttgctattgaaccacggttcaaccggcagtccaccggtcagaccgtcggacaggtgcaccaaggggtcatccaggtcactcaccagtccagttttttgcactatgaatttaagacaatattcagctaaggatgcttatgattcctccttccaaggtgccactaaattttcaggccatgggaacgtatttggaaaacatgggcatctggaaagtgtcacttttttcatgtgacttgtcgtgcataatcactgctagacaccagattgtcttgcctgacaaggtctgccacatccagacctttgcgctcattgcgaccaagatgatgaaactattgatcactttctcacaaattgtgtcttcatgaaacagttttggtactccctcctgtagaggtttgtcctaaattctttggtcccccttgaatgacgatcaaaataagtggtggagcataatcattgagggtgcaatatggcctgaattctatagtcattcttggttcttggacgctttggatgcatcgaaaccattgtgttttttatgggactgctcctaaattggccgatgctcttttgcttgccaaggaggaagcacaactgtggtttttgccggcctcaggggctatcattattgactactcaagagccgggtggttagtctcacatcatggtttggtttgtggttgtggtcttgtgttgtggtttggtttgcaacatgtatggttcctagaactcattatgtgcgtgtttggttctgtactcagggttatagcccatctttttttcttgttaatatgatgataaacagatctcctacgtattggagaaaaaaatgaggggtgatatggtcattctagaacaaccaatgatataggaacaaaaaggtatgcatggaatgaagagccaaacatattggcatacatgatatcgagctaaacttagaagttgtatataagtaatagaataataaaataataggcagcatacaacgaattatctcaaagataaattaacaggacaacaataccaaataaaataggcattctcatttcagataaatatgattttcaagattgcactttctgatacttggattatgtcactttctactgtgatatatgttcaatcattttattatgttcattgcacatactggatgaaacaacaaatcaatgacttaatcctcatctgcaccaacatccatcacatcaaatacttgtccctgcagtagcatattcatattagtcaattcctttgccatggtttggttcttcacccggtcttgaatgttcactccaataatcatctctactgcttcaagggttctcttttcctagtaaatagtagaaagtgttccaattagttttctttacataatttttaatataataatatataattttcttttcagaaataataataatacatataagtcttacctctaaatccaagagttgctcagccagaaggttggaactattgaaagatactatgctagaattgacatctttggagaattgagatggcaccaaaaatgccattgtttcatttgttggtttgcatatcttctctaatttagggaacttgatgggacggaaatttctttcttgatgaacagttgagatcgctcgctttggaaagactagcaaatttgttatatgcccacctagtgacgaaatgacaaggcaaaaaaaatgttaaaataagaacctttcggaaagaacaaaagtgaccctttcagaaagaacaaaagtgaccctttcagaaagaacaaaagtgaactaaaatggacttcatgtagacttacctattttgttttctattttattaataacttgccatgctcttgtgtcccaaacaaggatagtgcaatcctttgatgcagaaaccaaccttactcctttagaacaaaatgctaatgcagtaattggagcgctgttgacaagttggaatcagccaattagttttatgttgtgctaattattttatggattcacaacacttaaaatcaaatattttatcaatgttaggtatagattagatatcaagactttatagaactttgttaaaaaatacttcggaacaatcataatctaacatagaaagaaactaatactcaagattggatacaatagaaactaacgtatagatacatattacataagtttagaaaagtctaaatacaccccgcccaaaagaaactttgattgaaagtccatttggcaccctaatctattaaaccaaatacccaaccctccgaactatataatatcatacataaaccaaatactagtgcattttgcaaactggtttttatgtaatttgcatatacgttcgatgactgcatgacattggacatatatgctaatatctccacctaaatctttcattcttacccacttttttcttgaacttacaaatgaatgtcgatataatactagtatggcataactatatcttatatattgatgaccaatgactgatgatgtgtaacaggctcatttaagcttccaaatgcacaaagccactatccaaaatcactttaggaaataatatgaatggtattccaaagtctgggggttatgtttagggtgctacacggaattttacccaaagtttagaggttatgttcaccgtttccttgaagttttaattgtgataaagaaatgtgttctcattttggaaatccctataattgttttatattcttgataataatatttgttctaaatttaaaatagtacattgcatcttattgtcaattattgatatgtcttgagtaacatttgcaaaatttaccaatcaatgctcttaattcaactataacttacttgtgtcctgaaagaatttgacaattatcctcaaaacatgttaaactggatttttttgtcccaattccattcaacacagtgacatatatacaagtatcaccagccccacaaagtagaaattgttccaaaggatcaactgcgattgtagtaactgaactggagagtgaaatggtgtgaagtagtaacccagacaatagatccgtaacctagaaaaataacatattctcaaagttgtcatcagcgccaatggaaatcatgctcaaatctacattcaaaaagtgtgctaaatcttacgagtaagtgttctgttgcattttggtcttggtactattattgaatatattttaagcaatgaataacacaagcacaagaaattgaccacatcgagttttgtgtggatatgagatctagttataatattgaagcaaccatcagaatagtaaattgtatagccaccaaacatatatgtaagttatattgtttaaaaagaactaagcatatagaaccattttactgaataatatattttgaatgtatggagtatcagtagtcataattcattgctaaattatgaaagtgtacatgacatttagtacaggaactagatttcaagtttcatataggatgctgataaagttgcaatattgatcactgcaaaaggaaacaacatatttcatctgaggtgcattaaaccttgcaattgccatcgagtgagctcgttattagaatgggacattgaccccttaacattgttaaaatgccagttattgacgccttgtgctcatttttctttacattataaaagttgggatatatctctgtaccttcaatgggtcgaggttcctctgcttgaaataaactgcaaagttcatatgcagagcgaaaaataggttattgaaagcatgtgttaacttaaatgcttagttgattattcccattggagggtttggtgcctcatctgatatcaaatagccttacataccaacaataatatactggtaacactgttctttttctgaagtggagcatttctcaaatatttattgtactgcctttatgagatgtttggtatgataatatatagttagaagagtgagactttgtctctggagtggagtgagaagaacagaggacaattgttgacatgatgaattgtaaaaatagcttattttcaactacctacatacatatcattgaattctggaaaattgttgcatagatgatttcaatggtggagatagtgagacaacggctcagttctaggaaatgtggtcatttgtctcatggtggttgggaaacattgataaaaatatatttacccaacatccctttacggcttatatatgatgggttttatcttatgcttgaatgagtccacaaacaagttggttctatcagaggtagcttataggtgaaatcatcctattggactaatgtgattgcattgacatttaatgcgattcattaaaaatgatctatatgttttaatacttgcctgtaagactcctttccaaatcaaactgtaaaaaatagtttgtgtagtgatagtgactaatggagtgggaagagcaagaagacattgacaccttgctggatcaactgaatatgagacaacttgctaaaggggttgtagcctagtggttacagtgctcaagtagcacctctaggtccttcattcgactttccaagggagcaaatttcatgcttgaataaaagaaaaagatgccgtgagggcctccctcgctatttccaataaaaaaataaacaactctaattgcaatccaaggattgtctcaaatagtctacaagcctgatgagactgttgcgcttatatagtttgcaagctatttgggacatttttctctttgtcataagtagttctttagctacctattcttgctagttggttctggtagtgctgaataatgtagtggtgctttgttcctatgcttgaatggcaagcctgcgtgtaatactagtaaacccaacaggaaaagttgggccttaaaaaaaaggaaaaaagtacaaattaccccctgaactatcacggtcgaccgaattaccccccccccccgaactcgaaaaccagatatcgctcaccctaaactttcaataccggacaaaacacccccctactcaatatcagagtggtttcagtccaacgtggcagtccagtcagcaactttttatttaaaaaaggcaaattttgctacagaatactacttatgtgtggttttagccctaggacactgctcaaactcacatttggggaaaaacactccataaacatggtaatttgctagtggacaccgcgccgattaaaataataatatccagttgaagaggagagagaaatcacatgaaatgtcaatgtcaaaaatacccttcggcccacatgtcaggactcatatctctcttcttttaaattctccctatatttctccttccagcgtcactctgagaggcaagccggcgtgcggaggaccggcccgggtgcgacggccttgcaggtgg

SEQ ID NO: 30224 - DNA, 20024 bp, Oryza sativa
accgcgagccaccgccgctgccgcaccactacacctcaccgcgccgcccgcacagccgccgttccccactggcgctcgccgcctcgcctcgccgtgccacccgcaaggtcgtcgcgcctatgccggtcctctgcacgccggctcgctatcacagtgacgctggaaggaggaagatagggagagattaaaagaagagagatatgagtgctgacatgtgggccgaagggtatttttgatatttcatgtgacttttctctcctcttctaccagatattattattttaattggggcggtgtccactggcaaattactatgtttatagagtgttttcccccaaaagtgagtttgggcagtgtcctagggttaaaaccacacataagcagtgtcctgtagcaaaatttgcctttaaaaaatggtggggctcacatatcatagtctctctcctctctatcccctctcacctctctatctctctctgatgtcgctcactcgccgctgagaacgagcagcgcatgcgccgacggtggctggcccgacgcagttggttggctgcaaaggccggcgaccgcggaaacgaaggtagcgtgatcgaggactagcggcgcgccagcggttgcgagtctcctcgaggcagaggccgaggatgtggcgtgccggcggtggccggcccatcaggctcaccaggcctcgtcctcctgtggttaggggagtagtggctcgcgccggacttacgcgagaaggcagccatggcgggggagaggggtgacgcggcggggcggctgcaaaggctgacgaccatagaggcgaggccagcgcggtcggtggcgaggctaaggcaactcggggtcacgggtgaggcagctcagggtcgcgggtgagcagtagggagaagagtagacgagtggttcatcgtcgccatcgccgtcgacgtcattggccggcgctgaggcaaaagcgccagcgctgttgctgctcccttccctggagacggcggtgaggcctctctctctctctctcaactcaggcaggcggcgagcgatgagtctgtcgatgtttaagatcgcgactagggtatttggatggtatggggatcgttggtaccaggtatatgcgagattgaggtaaaagagatggagacatggatttttatacaggttcgggcccctcatctgataggtaatagccctacatcctgttgaccgaagccagtgttgctcttattcatctgaatcacacaagtacaatatttgggataacctatctagttgtcgtcaacttggcggctagataaccaactcgtagtcgacaacagggcagtcttcctcctcgaatatgaacccgttgagatcagagatgatgctagatccctcttaccggcctccgtaggcaccggatggggtatgtctggctaatctctgatgtcgagatctggcggcgtgtgttagcgtgtgtatatgttggtcttgtggttttgtggcgtttggcttctgtctcctctcctcctaggggggcttgtatttatacccatagatgcccccttgtccaagtagaactagggagataaacatagatacgatccgagtagtccttgtagtttacatatagaactctttttgtccttccttatccggaactccttctatatacgaggtatgattccatataaaacatggtatgtggtgggccctgccgagcttagtcgattactattgggtatgtgatatccataaccctgacaaagtcctcatcggggaaggcgcgacacgtgcggtggggagggcgaggcgggcggtgggcgccgacgaggacattggagacggcaggctatggcgacgagtttgcagcccatccccgtcgtcccagcgcccggttgctcctcctccaccgcgtgctccaccgctctgtcatcgccgcctccgctccaatcacctctccttcccgacgccctcgttggcggctctacccctctagccccgtcgcgacgcgccctacccaatctcaccgccgcaccagagggaagaaagagaaaggagagattttagcagtactctgaccgccactgcgtcctccgcaccgccctcgcctccgcctacttgccgctgccggcacgcgccgccttcgcttccgcctacttgccgctgccggtcgcgtcgccatgttgtgtcgcccatctccccccatgccacgcgctacagaagaggagggagaagagcgccgcgtcacgccctctccctagccaccacccacttcagaaggggatggagaagagagatgtgggcggggattccaacgagtgggccctagcaatttttttttaaaaaaaactgatgtctggactgccacgtgtgctatttgaatcctaaaccgcttgcaacagtgctcggggggagggggtgttttgtccggtattaaaagttcaaggtgagcgatatctggttttcgagttcagggggtaattcagtcgaccacgatatttcagggagtaatttgtatttttttcctaaaaaaaatgcttcaccgacttctagcttgtagagagtacctgaccattgaccaagtataaaccatcccttctatagatccagagatgagaaacgaactatcttgagagaaggctaaacaacttatagcatttttatgtccgcaccatcttttcaataatgctccacttgctatctgaaatgaacaatattttcaagtgaaaaagagttcatattaaacagaaatttgtcactaagtgtgtgatgcaaaatttaaattattactctttttagatatttgtactatttgcaagaatatttcccatagaagatgcaatctttatttatgaatttggattaaaaaatacactcatacactaaccatccaagtagaatatcaaacaatgcagtaggttaaaaaatgttagtatgtcaagtgaagtagaatgagaggcattaagattttgttcaagcgaaatcatacatacaaaagggatattcaactgaactgcttctcaaatataaatacaaatcattatatatccttgctggaacagcactaccaatttatcgctaaatgaactcgtaatgttatttttagggaagttaacatagtgactagaagtataattaacttccatggtcataaactttcttccgtttgtcagttacatggacctccttatttagatcatccaaactaacattaacaaatggagcaaaccaatttatgatcagagtggcatcctttcgataaagatggagcataacgaatactaggttataaatgaaagaattggcggggcataagttttgatgtgatcttttattagttcaaacttcattttgtattgctggacaaaccagttgaagttcggtagattcatacatgtttaaataggaaatccccatgtctttcataaatcaaaataaaagaacttggtattgttggatataattatgcattagtgatgacaggataattcgtagaatgatttaaaaaacaaacataaacacaagccataccttcctttaatataaagatacccaattcaaacatcgaacaatgcatcaagagtctcttgttgatcataatctagctagaatagaacgacgtatgaatagtttaattcttttgtagaaagaggaagctttttttatttacctcccaaatataagtatgtccagaactagcaccaccaaccaaatacaccccatcttttgagcaagcaatgggcccaatggcttcagctacataacttttttgcacttccttgatctgtaaaaggaaaataatttaaatggaactagaataggactatagggtattcacaattgagatataaacactcacatgtttgagcattaatcctttgggcccatatgttaaaagtaatgccattttgttttctcactaaatgttaaatttgaacacttataatattttacaatcaatcagttttagtcatttaccatatagaaacatacaccgtatgtacttgttgtgtaagggtaatgagaagttgtagttagttgattctatgtcctcggttgattgagggaaaaaactattacatctagaaatgagcaatacatgccgagttttagatgaaataggaaaaatggacttaatgtattatcactttagcttgtaacttggatcacatttttcatctgaattatgactcaccctaatcacaatcacacttttacatcttgaatcccttctaccataatctggcatatgatttctgactaaaattgaaaaacctgaatttgtcaatactgatcgaattagatctactcctacaaacatgatagcgaaaaatctaacaaaatttagagtattttgataaaataatccatcttattttttaatgaaacatataatttaatttggaaccaatcataacacaaggaccagttctagccctagacttctgcaattaattcattctctagactaatttgctgccatgatccacacaatccaacctatgatctacacaaaatccattacctgaaagggcaaagacgaagaaaagacatcacatggcacaaaagaaatcttaccttacttggagcccagaaatatatagcacttccaaagattggttgatccttgtctgtccgagatgcagcgaggagaaatccatcaacaaaagcgaggccacatggaggagcaacgcagtcgtgtatgtacataatcttctcgcatgtgttgatatcgtacaccaaccctacatcattagcacacaccactagcattgcctctttctcccccattctctatcttaggtaggcaatggttctggtagagaggttaggaaagtgaagatattgtttataatgattttggtcttggagtactaggaagtgaaaagaggttaataaagacaatccaaaaaaagctccaaaaagtctgaaactgaaattcctttttaggagagttaaagatgtgcatctcatgaggcaaggaccacagagtttgctgagtacaaatggtccttatatactccatccgtttcacaatgtaagtcattctagcatgtcatatattaatattgatgttaatgaatctagacatatatatctatctaaattcattaacatcatataaatgtgggaaatgctagaatgacttacattgtgaaacggaggaagcagcttcttctataagggtacataaaaacttccttggttatctatggatgtttttagatgcagaaggccttgtttgttaaaatgggtcaggattttggccaaagaaagttctaggagattacacaagcatttaatagagaaaaaaacattttgatattgaaagttaattctttaggataaattgttctctaattgatacatccagttttataactaaagcatttattagttttgaggatttagatcatccactacaccctaacgagtcaacattttagagatatggagagagggttcatgtggtaaattcgaaaggccacttagagatcatatcttgtcatatatcatagcatcattcggtggcaaaggtcaacaaagatggcattgaaatgaacaacagggtaagtgcaaaaaaaagtatgcaatctcaccattgagcccctctctcgcgcaactttcccaccctcatccccctccttccgtcccctatgccactaagttgagaccctaaaaccatagagtagccactcattgtcatcctgctaggctggtatacatgccatcattcgcgcactccctagcaggcactaagtgccgccatgctgtctccaacccctcctaagctcctccacgctgcatatgtgaccgcacctcccccatgcctcctaggctagcagtcgttgttctgccgtcccaacaccacaagacatactgtagaagctcggtgcatctgcccgtagctgcacagccaacttctcgagctcctcccttcacactaaagtcttcccaatgctccttgatccatgctgaaggctttcccgagctcctcaaccactcccgtgttcctccccaataacgcaaggcatctgtggaagtcctcccccccccctcccctcccgtgctctagttgtgcaacttcaaggtcccccaacatcgttttcacctctgcctgaggacaattctgaggtcccccaaccgtggtttttcattcaaaattggttatgtacgtggaaattgaatttccttgtcaactaggaatcgtgaatttatatatcctacactacatagttggagccaaaagcttaacaatcattgagccacatcatctataaaatattgtcctttggatccatcttatgcttttatcttaatcattcatatgccataacatcacatagaaaataccagcctttggatccatcctatgctttgatgtcaaccattcatatgccatatgaatttaaaatccactacgtttattgccataaggcttaatgtacattgaaccatgacacctagaaaagtaataatcattagattactctcacacttataaaattgcaatttcacatcaattactatatagagctcaaaatattgtccatttaggtattacgagtacacgatttaaaaaaatacaagttttctttaaaatatttctaaattcccggttgcaacgtgtggggtatatccactaattatgcaaatattgtgatgtagattgccttctctgatgatgatgccaaaccttgggctaccatggaccatgctagttttctttcaatgattatttttcacatttttggggctgcaaaaggaataagccactttgactccctcaaatataagtacagacccgtttggtagagctccaactcctaaatttaattccgagggttgggtctggagtagagttgtggaacagtctaaactcaactccacctttctactttattttgtgagagcgctcaccaagctccactcccattttagatggagctgaaactatttggctatgctccaattccacgagaggtggagctggagctagagttgtgccaaatagaccctacaatccgattcgtatccctcaaccgcaataccagatatcttaaccctaaactagtaaaaccagtgcaaaattactccctcggtggttttgagggtggttttcgctgacgtggcatgttgacctagtccaccttgctaagtcatcatgtgggacccacgagtcagcgtccttctttcactatatcttttctctcttcccacttcctctccgacctatccatttgacgcagttgtgggcgccgcactcccttcctctgccccgggtcttcagccttagcttctgcggtggccatctcgcggtgccggagacgatgtgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcatgctccaccagcttggggcacaccccacatgggccccacctgggccggggtcccaaatgaagttacaagcccataggcccatcataggtgatgcaacatcttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatagaacattggttggatatggcaaatcagacttagcaaataatttctccttgaaattatcgagctcacaaaaatcatcaaactgaacatagcccatagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggtggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatggaaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttttgtgcggcttttttttttgcacctttctgccttttttttcactttttttcttgatttttttttaacaaaaactgactcaaggaccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaatttgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaatcttgactacttccaaaatcagatatggtaattcaccttcctcctctcgtgcacgacataggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctggcccggggtcccaaatgaagttacaagcccataggcccattataggtgatgcaacatcttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatctttttgttcatccatgatgtgagcaatggttgcatccgtggtagccatggtcacatcacgatgtcacctcgccgacgccaccgtgggtggtgctcccttccttcgctctgtatctttgtcctcgacctccacggaggctagtcgacgccggatgacgtccagtagcgtgaggcgcctccccaacaccaccgcggtaggagccagcttgcggcgaccaccgccctcgccctcatcctcgtcctcatcgcagaggttggacaacgtgaccatctgcgcggctaacatgatgcctcgttgcggcgacgtcatcacccacacctttatctcctcctgtgcgaattgttccttgaggttgccggtggacccccgtcaccattgaccagggaggagtaggcggcggctacttggcagccgacgaagcacacggctcatgtgacaaggacaaagtgacgtcggcatggggtgttggtggctcgtggtgaggtcgtggtggtggaactggtggaactacggcttgacggtggtgtgccctaacccaacggccatggacgaaggcagtggcctcgtcgcccttgactggtcagacggtgaggaagacccacccacccccctgcatccatatctctttctcctccctcccctttctccccctacatctccctcggcacagttcctctcgtcatgtgggcagcccggcacatgacagggatcgcgtccaccgacacataactctcttctcctcccccaatgtcgttgctgccaagcaagccgaagcactgtgtggctactcgctcttccggcattctaccgtgagaggacatcacgctggtgttgctgctcgcctcgttgctcttcctcgcgatagatgtgttcagccgtcagcccagcgacgttgatgcttttccctggccattgccaccacgacatgggctaaccttgtgaatggaggtgggctcggggctcgcagcggcccgcgcgaaggacagggacagcgacatgctacggcacctcgtcgttgcttgcgcctcctctcgagggaagaggaggagctcaaccacggcggcatggccctgctacgatggggagatgtggtggtggaggaggagcccgccatatttgactacgcaggatatcgttggtgcccgcaccatcgcctacccaccggagaggtgtgtgaaggaggagagagagagagaggaggacatgtaggtcccacacgctggctcagctgattagactatgtcaatgatccatgtcatcgaaatccaccctcagaaccaccgagagagtcattttgctccggtttcgacagttggggggtcaatatatctggtattgcagctaatttgagggactcaatgtagacttaccgcgctgcaaaacgcaggaccgagcctgcccggcccgattgggctgccgggtcgggcggcccacgagcaggtctagccgcccggtctcctctcctccacgatgagacgaggagccgaggagaggaagggtttaaagcgcttcttcactcgatctcgccgcgagagacccaccgatctgccctccgccccccaacatggcgacgccaccgccgctccgccgcgtcgccgccctcctcctcctcctcgtcgccgccgcctccacccccaccgcacgggccgatctcgtcgtcaccagggcggatcggaaggtgagctcccgcctcgcttctttgtctctctgcgcgccctccagatctcccgacgagcacgccgcgccttctgcccccggatctgaggcctctttgcccttccttttcttttttgcaggttgacctgacttcgcacatcgttcgtgtcctcacttcgctcaaggtacacgcggttgttgttgctgtgttctctcgaattttgtttgtctagttggggggagattcagccgttccccggttcgttcgtccgatctgttaagggagcttctcatttcatcgtgatatagttctggatgggtagatgtttgtctcttcatcgctgataatatgataagagcgctgtaatgtgtggatggatcatggatggagttagcgtttcatcattaatggtgtcctgtataggttcatcgcctcgacgtgtgctcacgagtgctccaaattcttaacgtctcaatttgggatgttcaattccatgtctcgcatgatttggcctgcagattctttgggttgcaagctctcttctggttgatttgaagttggggtttaactggcaataggggttctgtgtttgtcagtgccaccaccaattctaaaatctccgagtaactctttttgaattacactttgtctgatgccagtcctcactagtagatagagtaatatatggggttttgtctatgcacatgtgatatgctgaggttttgcttttgttgtaatctctgttttttttaggttgagaatagtggaccggaggctgtttctcaatttctactggcgtttcccaatgtccaagcaaagaacttagcagctataagagcatttggtactgaggaaaaggtgaaaggtccaagtatggtccttccgattgaagttgttcagccttctggagtgcccccagaacttacattcttttcggcatctttatccaaacctttggagaaggggaagactcttcacttagatgtcctgaccgtatttacgcactctgtccagccattccccgaagaaatcacacaagctgaatcgcagcttgttgtctatcaggacagtgctcagtatctgtcaccttaccctgttaaggtacagacacttagtatcagattgcctggtggaagagttgagtcctacacaaagtacccaaacacaaaacttgcagagtcagaactaaaatatggaccatatgaagatcttccaccgttttcctactcccctatggttgtgcactatgagaacaataacccttttgcagttgcaaaggaagttataagggagatagagatatctcactgggggaatgtacagattacagaacattacaacattgctcatggtggtgccaaactcaagggtgaattttccaggttcttctcccttctaacttgtgctttaaatagctcacctttagctggatagaaaaaatttgtccagagataactgatgtgttcaaatttgcaggattgattaccaatctagaccgtacataagaggggtctcatcttttaggcatcttattgctagactgcctccaagggcacattctatatactacagagatgagattggtaacatttcaacatcacatttatggagtgattccaagaaggtacacttgctttttattatctcagtttcaaggctataatattcccagcaaaattgcaaaagtgagtgcatatgctgaatatttatcctattgcagactcaacttgaagttgagccaaggtttcctttgtttggtggttggcaaacgacctttaccattggttatggtttacctcttcaagactttgttttcaattctgatggaaagagattcctcaatatcacatttggttctccagtggaggagattctcatagaaaagcttattgtgaaggtatgttctcctgtacccatctggcacgcacggtaaaatctttcattttttacccttgtgttccatgttttgttcttaattgcactgatatagaattttagacaccaaacataattccttgtgttgcctatttctttgatattgaaattagatcttcatttattgctgggaacctgcaactaacatacccttttgttgtcttggctatcttctggtgtattgtccttcacttagttatttttattttatgtttctaaaaaaatgtagatgacatgtcatggttagataatcaataagaaatacatttgcacatatttccatgaacgtgatgttacatattaatttccctccctgcataaaaacctttctttttgaacaggttgttctgcctgaaggttcaaaggatattgatatttcagttccatttccaacaaagcaagagcaagaggtgacttcttgttggatgatacacacacacacacacacacatatattctgaacaactagctgatcctgttcttttgttgtaatgacaatgatttgtggtgcaggtgaagtattcacaccttgatatttctggaaggccagtggttgtcttggagaagcttgatgttattccagagcataatctatatttccaggtttgtcttcagacttaatttgttgtgcaactaattttacccctccatgaaaagttgagcgttgctaaattattaacctgactgaagagtatgtaaaatctgctatgcaaaaggcttactgcaccatgaatactttctgtgagttgtctatctcatggtgttttatgtgaaccatagcaaacttatggtgttaatgccctacaatatgcaggtttactacaggttcaacaacatctctctactcagagaaccgatgatgttgataactggcttctttctcctcttcatggcctgtattgtttacatgcgcactgacatgtcaatctctaagaattctccttcttatctggcaaaggtgcagtgggatgaggtatggtcgttttagtcaaatctcccctttgaggattggattttgatgatttacgagaaatgtttaaatctatcttgccataacctttcttctagtgaactacagtttgttactatactgctgctatgtttaggatgagcactaattacagtgaaataaacttatgaatcataattcgaattggtttgctagctcatacggagtactatgtagcggtgttatttttatgggagaaaaaaaatgcaatgataaaaacttgaactagtaaatatcagatgacaaacatattagggcctgagcaaatagctaggaaaggtctcaaaatgtgcagggttgaatggtggccttaaattttggggagggcttgtttactagtaattttagttggataagtgacaagtttactatcagaatcatgtgagaacttttagttggataagtgacaagtttactatcagaatcatgtgagaacgctgtcctttctgttaaagattggcttttgagagctttggtccaaaaatggacaagttacaagtgaagggtcttaaccacggtggaatagaatctgcaaaacaagctctaaatgaatctggaggtaaagagcagtccatgctgtgttaaaagcgagcttcataattgacagggaaaaaaatgttacttgaaaagtcctaaatcttcaatccaaacttcaaagttaagaagataataattgcgtatcattggtttaagcagttaagctggatcaacattaattgtagtgtttctggaattgaagaatgctttaaacttgtggagacctcttactttctgcagactaacctctacaatctatttcatactttttgtacaggtacagagcatcatccagcaaatccaggctatcttcaaccaatgtctagcagctcatgataaactggagacctcattacacgagttatctaggtcaggagatgttaaatcatgcaaagtggctcgtaagacagctgatgcacagtttaaggaattagcaaaagagttgaagccattgttgacatccctgcagtcatcctctcagtcttaccagatatggccaaaggtttgctcaacgtcttgtgcatagaccacctagaagagagagatacttactagtgcatctttattcaccatttaatttgaatttgagttctttgcccacattctctaattaagtatatgcgccatagtggttacagttggcctttttttctttaatgcaggtagaggaattggttgccaaggagagagagttgcaggataagctcatgacaaggcattccactgtggttgacagctttgaaaagaagttgcgagggcaagatgtggagaacaggattgctgcccagcagcagaaagttgctgccctgaggcaagaggtcgaatctcttttagagtacatcagtgagatctgagcgaatccggcgctgcatggtatgtcaatttagcaattagactggagaatggatcacctggtttctcattgtgcgaatttgatatgctcgaattcgaatcaaatactcgtagatttcctgttgataacctgtctcagtcattcaggctgggagtttcaaaggaccttgtaacatgataagcacttgtgaccgcctgaaactgattgaaattttgcacttaatagcaaatcacgcgacctttcaccttgtttcatatgtaattttcatgaagatgccataatacctttcacgaacattgcaacgtttctagacagcaactctttcatggtagtactaagctaattgctccattcacctaatagggtcatcatgggaagttgaagatcaggcaaaagaagtttgacagctaatcatattttattttttttcttaataaaatataacgtctcatgtgtttttcgagaaaagaaaaaagccaaagtcatttttcgcagttgacagtctgaaataacaaagattgaccaccgggtgtatcatcttcatgttctggactcctaaaagctcatctaatatgttaaaaccctaataacttgaattaatggattgtacgtagtatcaactctgccacggactggctcgtcaaaacgtccagtgagacatgtgagatctcaaaagcaatattatttctctttacctatggcggtagacggtgctcctaacgaatgaattcactgtgccaagagaaataaacagatgaaaataggcttgtaaacatcagacatgggatcaagccagctaaaatattatcatttttgtttgcttgtattacaagatcaactaggattactctgctgggttaattagatccgtgccattaaaaatattccggttttaaaatatgccacgagcatttacatatttgaatccatgccatataatttacacatattcaagatatgccactacctacctcttagatgcatttacgaaaaaatgtggaccaaattgcccttgtttccttcttcctttttctccccttctttcttccacagctcagagaccagtgatgcttagtgtcggcagcagcaagcacaaccagcgataaacatacgagtgttgcagtcattgtctcctccctctccagcgttattttgcacgcgacatctgcatctccctccacctcacactgccgttagggggacgcctgcgactgcagcgctatctccacctcggggctccgcaccctcgccgcggccgccgcctgctgctgctgctgctactgggggacgcctgcgacggcgacgggcacacggagtgcagtgttgcggttgcgacggcggcggctgaggcgactagggcagcgactgctggaatcggatgggctcgagcagcgagggcgatggcggcagcgatagagcaagttgtggctcacaacggcgaggacggcggcggagagagcggagagaacggagcggcggtggagcaagaaagcagcgggaagagagaggtagaagacgagggaagagagagaggtaaaagatgagtgcattttcgtctaatacatgcaaaatacgtatctttgtgggtattaacaccactgagattataaataagtagcagtggcatcgttacaaatacgcaattgaaattacaaataagtagcagtggcatcgttacaaatacgcaattgagattacaaatagcagtagcattgttacaaatacgtaaatagtaatagtatatttcgaaaccagcaaatttttaatggcatgtatctaattaaccctatctattttcatgtatgacataatatcattatattaatatttaaaaatacttttaattgttaatgcttcttgttttgtacctatattaggaagaaattaatgatcaaaatatttattcaatgtcaaagactatattgtacgcctcaactcttgtgactaatgagaaaggagcaagtattcacggctaattatttttttagtagtagataatgtatctgtcgataacgagacacacacgataacttggtcgatacgaaaatttaccaacccagttattttatatgataatagagatgaggtatgcgtgtatgatttcatagaaataagtggatgcgtattgtgatcatgtttgttctttataaaaagaagtattttaaaggaggtgaacaaaatcgtctttgcctttcatcaccctttacaagtttgaccttttcatgtcatgaattttttttaaaaaaatggataaattagcaatgacaaaaacaacattcacccccacctcttcccctgtttctgaccaatcccctctgctctctcctctcctctctccctctcccgcgatctgcagagccgcttgtgcccccgcgccgcctt

SEQ ID NO: 30225 - DNA, 18267 bp, Oryza sativa
gtcgccggaggcctccgtcgtgcgcgcggccggcgagcccgctcgagtcgaaccggaaggtacctattcctctctctcgcagctcgtagcccccctctcccccatccctcctccttccgcgccacttcatcagcgggggcggtgtggactggagatcccccatcccggcgtggattggattcgattggtttgatctcgtttctctccctagcctgtagctttttcttttgttagaaacggaaaacggaggattaaaccccatatgcccccgcgtgttaggtttaggtctgcctgcacctggattcatcgttctagggtgggggatttatgatcgagtaccaaaggatttatgatccgcttgtggtttttcgccttgcgataaagctgaacacagttgacaataattctctctgtagagatagtcgatgggcgatcgtaatcctgactagaaaatttgattacactgccatcccgcactacttgtggttctatataataaatgaattcgttgctcgtcattgcgccgttgctcattctccattcctgagcacgcacaaactattgcgcaccatccttgtagctggtgggtataatatatgcgtattgatgcaagtgtgtctagtggccatcgctaccaaggaaaatcagtgatcactaggtcatggctgacacgattcagcagtggagctgtgttgttgattaagaccccatgaaaagtcagttaacctaagatagttattactaatggttcccttgtaacaagaattggggatggtacccagtgtgcccccacatccattgatgcaggccaaattgtttgtgggctgcaaaacctttctcttatcataacagacaaatgaaaaccagaaaatggtctatatatatatatatatatatatatatatatatatatatatatatatatatatatatatatatatggtgttggtttttcttctcagtattatgaaatctacacacatccagaagagtaatttgtgttggatgatgccaatatttatttctatagtgtatgtaacgttgtggcaacatcagcatgtcacaatttgtgtgtgtctgtcttaacacatgctaattttgatgtgtgtgtgtgttgtgcgtgtggagggcaggggtatcctaccccttctgactactatggaaccatcactctgagctggtaggagcagtaaccattttcaccagttaatccatcgctgctgctaaatgtatcactatgtttattttttctttaagccaatagcttgtctcgacagcatactatgttcaaaatattgtggtgctctctccaagctgggttagttatgcatttatagattgtcctgctcaaatatctttattgatcttcagtcactgcaagaccattcacctccatgcacatgatgcactctctaaaaaagttacattctaccagttcattatctcatttgtcatgtgcagaaaattgtttgattaactttgttagtattatgagtcattcgggatcatcaacttgagatgatattaagtcgtgtcgatatgttggaactgggaatttgcacgtgctttcctatcttacacttatgccactgacagttgggctctgttttaatttaaaacacaggaatttcacagatatcagttcaattcctacacaaaccagaaaaaatctcacattacatttgggccttaatgttctaatgtttttaccgtatttgcatatctccaactatatgttattatttttctttctggcatcatgcatcatcaattttcctgcatgaaaacatgatgaagccatttaacattatatgactttggcagctttcgtgagtgaggatttctcaaacttcatttattttccatcactgggaggtgttgaagcttaatcatgaggtcaattcttgcttcctacctttggacatatttctgctggtttgcataccttaggcccacgcccataacacgttaccaagaagtatgtttggtaaattctgaggattatttgttattttccagttgctatgatatgtaaattaaaaaaacaaaactcggccggcgggggaaagaccgccccctcatcttttcaagctaagaagaaaccacagacaaagctagtcaagaaaggccacgaaccctgggcccttgacaaagaatcaatttaagcagcacctctttgtttacagttgtttttcctttttttttcctttttaccttacaaaagttaaggttccagccaggcagttattaatatgaggtggtgtaaagattcagcagtttcaatgatgatgaaatcagtggttccattccggattacttcagggtcaaatattgtttagatgggactcaatgttgagaatttagagctgtatgattgtatgattgtttagtaaaatcaaatattactataaatactaaaaagttgagaatttagagctgtatgattgttgaagtatgatgtctcaatcttttaggcccagaaatagtagtttgttgatttatgctgcttggatttcagaacctgatacgttaaaactgaagggatgaaagggcaaacagagcttgtcaaagttttgtgttaagaaaaaggtgacacggctccttttgatgatggtaccatggtggaataacttacaataaggccctaagtgcttagacagatacaccatagctgctgatttgtacatgaattttgtttcgaaaaactgtttgatttttagattaaagaactttatggagttttagattcatacaccatctttttttcttttttggtgtggaaatgctggactgttaagagctagttgaaaaaaaactactgcacaagcgtgagtttagagtttacttaatttgattttactgtttttctttagctctcgtcgtgtgaagtggaatgaagacaacctgtatgagattgaatcaaataaacctgttaggcagaagataactgagcctaagacaccatatcaccctatggtagatgatgatggtacatgttttcctgttctgatctcattatacctttacttgaccatattagttactgtgtcgttgttgaatatgtcttgccattgctttctttatagggtcattgtcaccaacgcgtccttttgacaagtgtctggatgagactgttaatgctgaagctattttaactgctttaaatggtgtggcttcttcaagcaaaactgatccaaaggatgatggttgggcatcctcagatgatgatgcagatgccatggaacaagatgatggttgtgcctcttaccctgttcccattttcatatatctaccctgcatgtagtaatttgctcttatattttccctgtttcagttaaatgcatttgaagacatcttgtttttgatggaaaaattaattaattgattatcaggaaattacatgaatatgtctgaaaagtcttgtcattggataagtagcgcaaatcttactggaagttatagtatgttaacattttgtaatagtaaagcacatacaccgaccaaacccttagcattgctctactaaagcaacgtacatatctggagaggaggcatttaatagagattctgagaaccagttcaaaataaatcttgaaggttatactttgtaccagctcaaaatgatgatgattaaaacacattttttgagtttgatggtcagaaaagaacagaagtgattatcaatattcatttatttccacatgttaagctagctccaatttatctattaacttccaaagcaaattcaattttgacctagatgcatctgatgacagatgacacagctcttcttaatatatctgttttatataattagacaaatgtttagttcttgcttcctcgttggtaaatttcgtcaattcatcttaaaatcatgttgtatacggagtactttcttttgacgacataagcaagggatacataccatcattacgaattggcaataatctgttattcaccatagggaacctgaaatcttatggagtatgatagttcctgtgggatgtttcctggtatcatcggagagttagttatatgttggtgttcatgtagatccagaagctgaaaagtcaagactgagtttcaaggaacatcgtcgtgctcactatgatgaattcctcaaggtgaaggagctgatgcgctccggatcgctgattgacgatgaggctgatgaggatgatagaggtgcaaaaggcagccaagccaaagctgtaggaaagaagccagcaggctgtgacagcacacccccaccgcaaacatgaagcaatgaagttaccgttcctttttccctgttgtttgctaagctaggaaaagctcaacatagcagaagcatgtggtttgtctaaattgtgtgaagcatgctttgcctgtgtgttagatccttgtattcaaaatcagatgtgcatcctgtaaacgacgcatgccattcatcttccctttgtgtttaagatcttgatgtacctagaatggctttgatttagtttgagttgcctagctacatttacttgctgaacggtgagctcctttgcatgttcatttgagactatttatcaagagctgatactcaaaccacatattggataaggccagatatggcaagatatggccttgatttgtttcacgcataaagtgtttttttcctcaccatatatttctttaatattgtgactttgtatttcagtatttttggcgatactagtttagtttagtagcggcaaatatttctttatttattttaggtgctctgctcatcctcgaagtatacataagatgagtggaggaagacagagaagagtgggttcagccagatgaatagaatgggttggaaagatttggcctgacagggtttagggaattttttccccggattacatggaaacaccactccactacacacgcaccattatattcgacaaagacctacagtaaaatggtacttcctctggcccaatttataaatttctgtgttcagctttaattatctgtcttatttaaaaaattttatgattagtatttttattgttattagatgataaaacatgaatagtattttatgcgtgacttaaatttttaattttttaaaaaaaatttaaatacgacggacgattaaagttgaacacagatactcataactggagggagttaatcgctaagctcactggattcctaattgaaatgcatgtgtatgcctaatatttatgagggttgtgtttggcactcgtatttctcaacttctcccttattttcacgtatatatatttctatatatatatatagtatatatataaatatatatatatatatatatatatatatataagatctatttttcaagtcattttagctaaaaacttaatggattatgcactaataaacaacctcgtcttctaagcgagatgaatgagttagcaacctgtactcctgatacacccttgtatttgaattaggtttatggattttgtggatgtagtgaactactggaattaaaagaaattcgacaaaaaaaacatctccataaactcaagataaatccatgaaaaaaatttctacaagctctagtaaataaatccaacacgaagaacaaattaaacgaactccaactcaaacaaaaaaaaaactttagatgagacatcattgattcatgttaactttttttggaaaaataaattgatattattaagctttcttttatgcaaaacaaattgttgtttttggatggtccaaagtaaagcaagcacaaactacaagtcatcggctcgttaaggttcgactcgtttgagctaaacggacaactgtttgagctaaacggacaattcacgagctggcatataagcttacgagctaaatgcctagtgactcattaggagtacggctccgtttggctaatgggttatacccattgggaaatggatataatatcctggtaggatgtggtggtagtttatacgaaggaaaattttatcccatatttggttggatggattggaaaaggaagtttctagaagaatgactaaaataccccttcaaactatgctaaatgagtaaacaaacagcacagctattagctataagttcaaatggtgagggtaattcaataatttttcctagtagtcaatccaccctcaaatcaagcaggattctatatcccactcccatccacacccaaacagtagaaatatgaaaaatggaaataacatccatttcccacactcctcatcccatttgccaaacagagcctacgagttcaggtcgatgtaaactctactcctagccattgcaaaagtgagttgtgacaaatgttaaatttcgtttagatgtatcttctgttacattagaccgttcgcaaaattctgacagcatagtacatgaagctaccggaaaaaaaataccaaattggtaccgcttgacatatgatatgcgcatgacaataccgatgtagcttgagcgcgaatgaacgcatagattcgacacagaacttgacaaaaacacaaaacaggacagttcaacaggcatccgtcacataaaaacgcaaacccaaatcatcagcgtgctcgaaacaaatgaattgtgcacagttcaaaacataaagatttatgaactttagcagttctgttagaagcttgctggtaccattcaggtaacattgacaaaaattgcaagtgctcccatgaagaaaatgcttttgcagcagaggaagaaaacagaaaattctaggcatgggaaaccccagtggcagaatgtacatcatactcattatttgaaatgcttccgcttaaatgctcaaaacattttaatgaaagtaagaaacagtggtccctcagttgacaacatcaaggaccagcttgcgtgacttcaggacggaccacctcatgcgacggtagtatgcggcttggagaagtgcaagtgacagtaggaagatccatttcactcccatctacatcaaattagagtaggttggtattaggaaatattgcgaattgaaagtaatatataaatggacaaaagttgagctgattaccagtttcctctcttccatctcaggttcagctgcccatgacaagaacgaaacgacatccttgcccatctgtggtagaggatgacaacaatcatgcttaggcccttaatgctaacccaacatgtcacaactgtaagagcccaacaacgcattagaaacttacctgggcttcagtggcaggagtaccatcttcatattcaacagctccatctataagcatcttgggcatagctatggcaccaccagggaagtagggattgtaatgcaaaccctcacggatctagaatacaaatcaaccagagagtttactaatgttgcacactgcagaaagcaaataacagaacacaaccagcttgaaaaattacagctagaaaaataacacttcgtgggacaggttaggtttttttcaaaatagagttcaacatcataattatgaacaaaaatagtgattatgtagtgaattccaaacaataactgacaacaaatgagaggctgaataattgtaaattaacagagaaaacactcaaacaacaatgggacaacacaacttgaagctgagcacctccaagttcaaccagtattgcaattacagagttacaacagtgtcaaatttgatgtcaatatcatgtgtctgtaaaatatgtatccctgtgacacaagtgattcaatccacatgcaagagcatctttattgtttgtaaaggaattaagggcgatacacatagcaagtagcaactgcaaatgcctaaggtataactgacagagaatgagatttacctgaacaccggcaggtggatcacggtaaccagtaagaagagcaaacacatagttctggccattgtgccttgcctgaacatacggagtcaaacagtaaattacaacttgaaggtggaagattaaacaatgcaacgccaatggcataaaatatcattaccttcgtgataagactgagatctggtgggtatgccccaccatttgcaaaacgggctgcttgctcatttggatatggttgtgggaaccggtcacttaacttaccaggacgtgtgaacatttcaccctcatcattaggaccatcaaccacctcaatctcagcagccatagcctttgtttcttcttcagtgtaggccacaccaaccaaatctcggtacgaaattaatgacatggaatggcaagaggcacacacttgtgtataaacttgatgtccacgccgaatactgatcatagaagtgttcaaatataagacaatgagtaaacagcaagaatagggtagtagtggttaaaaggattttcttgggagcaaaagaatattgtgattcttttcgctatcctactgggaaactaaattggtgaagtaggtttgaaggattggggtaaccaagagcatggatcaattaataataaccaaataccgtatgcaaagactctgaaatattgcaatgagctaaactctattttgtaaggaagttgaaaaaggatgactcacgatgcatggtcataagagctaagaatgccagcatgtggccagggatattcagctgctgccaaaccatgctcagcttcatctgcagaagctattgtagcaaagcttaaaagaccagaagcaccaactccaagaagagccaatgctctcagtccagcggaggattcttcatgctttatccggaacgaggatagcagagatgagccctgaaaacatgattataatgttttaaaaaaaagcaggtcaccacactaaaaaggagatgatcatgggtactgaaacttatggtgaacaaatggttactgtcagattataaactttgtcaaaattaggataagtagttgatatcatggtctaattactcaaccagaacagcaaaaataagcattgtatgcataatgcaggtttaactgtaaaaagtagaataaagatcaatcctgccaaacagaaacccctaaaaactgtgcagtagtaactagtaagaatgtgaactgtgatttctttccaaaaccccatctgatacatttcacgttatagtgatgtccggtaatacctttctacatgccatttcaataatcaattcaagattggtataccataacatttcatacaggcatcagacagaaaataaatattaaaaagattggtaagcgatcggtttttgacagaagtaatacaaaataaatagttcattaaaattcttactgaggactgattatggagtgttctccgtaggagctggttaatgccccgaccagcagccatccaggatactgcatcaaatattgaaaactgagatgtacaataaaagaggttatggcatcataattagtagaagcaactgtgcatatttcatttacagtatctaaccatccaagtggagtgaatttgagtaataaccaggaggattcaccgcaaatttacaccctccgtcccaaaaagaatcaacttatggagataaatctggacatgcatttgtctagatttgtccccagaagttggttttttctggaacggagggagtatatgtcagaaaatcaacccccaatgtcaaaattaaaacaactgaatggtatttttttattaactcatgaaaagaaataagcatacatttggtgccatgcattacaatctctgaaaaaaactgtttaaattgaccttactgcagaccttaacttactacatacttgctccttgaaagaagtatgtatgctatctcaccacaatgctctacctaaacaagttacacaggtcgaaaaagggaaccttgttattgcatagacaaagcatagatttgattgtctagctacaacccctagcccccttcttatatgcaaaccgtggaagaccgcgtaatagcaactaggccaatttatccatctatgtggttaacacaagaccattatatcaataacctaattagaggatagtgctgttactgcatttgcagaagacctaatgcatgcacgtaaaccatgacggcaacatcctatattgatgtgcctatagtgacatacctgacatatcgatatcatgtaaactaatttgctaaaagtaggatgaagatagtgaaagacatatggtgcaaaacttttatctaacacctcatctaggccataactcacaaattgcagtattctaatcagtgtgtttacaagaaaatatacaaaaagaagtgtaccagatacgccagtgacctaaaacatgatatcaaagaaacaagatgaaacttgcatcgcaaaaagtttagattagtataaatggagcattgcactattgtcgataaataagcacataccatgcgaaatcatctcaattgttaggtgccaactgtaaggcacattgaacataagtagccacaggaataaatcatctcaatttttcatgatgatgtagtgatatctcagccgtgcctaatctatctagcgaaaaagattacttggtacgtgacaagaaaaagggaaaaaaatgggtatgatccatgtggtacacgatgcgtgttcacgtactggaccatatgcccaaatccacagcactagtccgtccctcatccactaggggttccattgttctaacaacaagtaccaaggaaaccaaacagagcgggcagatctaggcggttcacaggcatcaaacaaactagtcaaaatggcatcccatcccatcccatcccatggcggatggtagatccgcgtgattctccaaagcacccatttgggggcagatctacacgttccaaacaaacaaacagaagaatcgaatcgacaggttccatccatccatccaacccacccaggtaacagatctgcgcatccctagcgctcgcctaacaaatcgatcgcagggacgaactcgcaaaagaaatcatgaggagaggggagaggccataccggaaggggaggaggtgggtgccctagccctagctcagcctcagctcggtcgtccgccttaccgggagggggaggaggaggaggaggactaggaggcgagcacaagtggaggttcccaagagaagagaagagaagagaagaggagaagcggcgcaaagggcgaagagagcgggggccaaccctagcgctggaccctctctcctctgcctgggccagaactcctagcgcggcctggcctactacagagcctctaaggctcggtccacttacggaaaacaaaaaggaaataagtccaattcgtgtccctcaaatatagctccaatcctcaattgatgtcgtttgaaccataataccggatatctttgaaacccaaattattaaaaccggtgtaacttgactctctcaactgtgtttggagagtggtttcgttgacgtgacactttgacttatctacctcgatgagtcttctggtggagcccacatagacctttaaggagggctggttgttgaagttaccgttattgttgttgttgttgcctccttggtagaacgggcagggctggttccacccctggtcttctttgggatgatagccattgttccccatgaacatggcttcttcacgaatgtcggggcagtcgttccccgagtgtccagtgttcctgcagacctcacaagtgatgtgcgagtctagtgccttgacagcggcctacgggttgttcttctcctgatcatctagcttcttcatcaggaggtccagctttgcggccagcatttttgtctccttgacagtatgcatgccatgctgatgggtctggagatgttcttcactgcagctcatgttcgacactatcttctcgatgagatcaacggcccctttgaccgtctttgataagaaggcacccccagcagtaacgtccaagtgattccgggacgaaacagtaagtccgttgtaaaactctgtagaatgagccagttgtccatcccatggtgaggacaggcagctacatattcctgcagacgttgtaaaactcctggaagcttgatattctcctgcggagggcatttgtcttgcccatcaggaagaattttgagaggaacgcagtggagcacttgtcccatgtgttaactgcaacccgattcgtgtaaaaccactgcttcacttttcccaggagtgagaaagtgaacagacgcagcctaatggtgtccgggctgacacccttcatggtgtaggtgctgcagatctctaggaactgctgcaagtgagcacttgcgtcctcatttggcctgccacaaaataggcttgcatgcgccatagtaatcaggctgctcttgagatcgaagtcagtgtctccgaggttaacctgtggcccgacgggcacattgtcagcggacggagcagcgaactcacgaagtgtcttctcagccatattcctgaaacatggtgacgctgggatgactggtttcttagctgaaagtttcttctgcggagggacgacactcggtctgacgctctggaagaaagcttctggattttcgttgaagttttctggcaggtttaccagtcatgcactatcctgttttcataccctgttttcatgacacaaaggttagcctgcaacggacaatgatttatgcagaggtaattatatataaaagattattagcttatagtaatctctttactaatcttccctagaaacagcgctagaaatgctagttggtatttcttaacgacattactacaaatattcattcccagcaatggcgcatgaataatcctggtatatatgtatggtcaaagaagtaatccgcaagcgcacggatataccattgtagcatttcacccagaagtatacaatcatgtggctaataccccctaacagtgccctcctggtgtttcgagagaccatcctgggttaccgagttccttacgacaacctgtcatggccgtccaaccggggctaaatacatgagagtaccctccctaggaattagtcttaggaatatatactaacgtggaggaatacctgtattgagctgtcatcatcagtggtccacctctactgtcctgcagcatatatgcccagatagtgataattagtaatctaagcaccatgcttacattaataaatactactctacacctctggacatgatatagagcaaccgataaatcggacactaaacccatgccattgcacctctctggtaggctacccacacaattataccgacgcaaacataaagcaagagcaatactcagactaagcaaagtactgaaagtatataaagaagaatatttcattaatttcgaaagtcttatagatgaaagtagaaaagctgctagagccataccggaactcttccgaagactccgaggactccgagaactattctattctactccacttagcactaaaaatactaaactaaagtatgaagagaaatcttgagcttgcttgagtgtgttgagatagtgaatgaactcctcctgttatagggcagttatgatggttgtagctatgcgaattgtccattttcccccggaaccgtcattgggaatcaatttggagcgtccacgtggagggctgacctgagccgacgtagccagggtttggctgaacctgggctagcccagcaggtctccagcttcggcagggtgggtgacaggtgggtcctattggtggttgtggcagttaatgcggtttccaggatggttacacctgatttgtggaccctccttatccataagcttgcttaggagtgaggtttcttcactttctctttattttatttgctaaattcctgtaacaaataatactataagtacaagtggagatatgttattctaaaacaaatatgcattgtaagcatagctagttctcctttattatagttatattgacggtcgagattggtctataacgtccgtcaacagtgtataaaattaggggatcctaaacatggtatgctccatgagtggcttctcagcagaagggtgtctgtaggaagggaaatatgggtgttgttttttgttgccatacaacttcttcaaataaatgcccatccaaccaaaaagtgtataggccatggtctacttgcagcatgggaggggatgataagatttgtactagccaatatcaaagaatagtacaaagaacatagggcgggcggagccaacgaatttctccaccctagggccatccaggaagccatgaccaatacccccatgacgaaggactggacccaacccaacaacaacgaagcaacaaagccacaaagctataaaggcggctatgtaaatgcgtgaggactcaatgcccgaggaatctggcaacccctccatgcggttgtgaaaatgatcacaccaatcctgaagcgaaacttctccaccaacttcaagactcttcctaatgtccatatgtagcattaagctctttgggtacatcaagagagatggctctaactcactgtgaggtggaacgtactcttcaaaaagatcaccgtcaaggggcagtcctgagagtttgtatatatcgagtaatgtgatggtcctctcgccatgaggaaaaaggaagctgttggtgtgtggatcccatttttccagcagagatctcagcatacttggtgaatggtgatgtacagtacaaaccaagggagcaatagatagacccataaatgtaatctaccccctcttcgctaccacgcaaatgaagggaatgatgacgcaggactgctttaccccattccgcatatcctgaaggagctagaacaaattccaccttatggttttcccaacccaatccctcagatactatcctattccctaaggtggaagccttatcatctcaaggcaaaggggtgagagggtgaaaacagcggcccttgaaagcgtgaccagaagtcctgccacgagtgttacgcgaaaattcaccaccgatcaattctttatccacaatagtagggttccccaagtcacttgtttcaggttcatagggctgaagttgcgccattctaaaaagcggcaagttatgtgttgctcgagaagagccagcatctgtcatctacaaatgaaaaaaatatatcggaatatgtatataggtgcagcctaaatatacaatgaggaagaaaaggtattgttagacaagtttgacatgcaaatctaattaacaacccggattggctgcgtaacatatcacaaaatttccgggaaccccgattatacgagcaactcattctatacaaatgtggttaaagaaagttatatgtatctatcaacctgtaaaaaaaatgaatgactgaaagagggtgaagaaaatctctctgtaccttcctcttgccacacctaaatcaccaatcacccgctgaaattaagacttggtaggtttcgggcatgtgtgcatagggaagaaacccaaatggaattaattaatggaggaatgaaagccaacaataatagtaaaaaggaaacaaaaaaaaagatcgccagttcagtatgcaagatcaaatcaaggtcttacctttgatgctgtcattgatgaagtctctcctcaaatccttgcacagaagaggagaaagagggagaagactggagtagtagatgagttcaacgaacaagtgcctcactgcccctagccatagggaacgtggccaaataatcggagagatgctccttaattttctcaacaatctttcaaacaacgggcacatcgatagttgtgaggataaacttcacatgcatcatgtccctacgaatccaaaattatgtttcgagctccggatgcaaaaccaaaattttggcaagggggcatttgttgacactgattttggctcgtatcttaaataagatgtattaaattataaactaatatataatctcaaacataatgtaaaaaaataaataaacaaaaataggaataaacagtcaaaacagtcaaatgaataaataaaataaaatggcgaccaaaaatatatggccgcaatataaaaataaaatccgctcggtcagagtgaaatgatttccggcgcaaatagaaatgcgtatgcgcgtgccatataaaaataaattagcatcttggaaacacgttcaaaaaattaaaaaacgtgaacaaatattttttacgtgcttttcatcggaccgacgaacgctgatacttagctttctggtcgtgtgcacatatgaaattcgtgctataataaaagagatcgtataaatatattgagactacgattattcgctaagtacacacctggcctaaaacatatggccgtggaataggatttttcccactcacccaaaatagtcatgtcctaaatattttcaggaaaggtgtacgcaccatataaaatagttttagactacggtcatccaataaattaaaaagaaaaccaaaatatatgttcatacaacaaatgagaaaattatactcctaatttttgcgacgtgaaataaaaatgcatgtcacgtgcagaccgctataatgatgcggatatataaacacgcacgcgccaaataagagagggccagatgtcagtgagaggatacacgcgctctctctcactcaataaccaggcaattaaaaggctaactggagtaataaagattagaatgataacaataaatgggaaagcatgtaacgaccaggggcatgaccggtctgctcatgttcaccccactacctgcacgcacgttgccacattcatccagtcaaaatgaagggacccacatgtaagccaaagaaaggtgtatgctgttgagtccatttcccacgatctgcccacggatgcgcgcgggactctgttctaaaccacgaaaagctggttaaccccctagcggcaaaggaagttccaggggagattagcgtagaggctaggtgctgttcgtaggctttgcagaagcgctgcttgttgctaggcaatactgctgccgttccgctttgctcctatgccatctcgtcagcctctgcttcctcgctccactgtgctggaagatcagaggtgtttaaggtgggaatcatgctcctccttcgttattaggctcgttcattgtgtgcgagtcaaagaatctctcggttctcgttcttctgctcacgttgatgtattcttttgctatgttgttcggttcggctaatgagtacgaaccaggaagtcatcttcttgccatattcttaggcttgaccaccatgagtacaagccaaaggaatttttcgtcttttgttatgtccttcgtctcaaccaatgcatatgagacaagaaagttcgttttatttgatggcttttaacataatttcacacttttttctatggttcggccagatgagtatgggtctaggagtggcttctatgcacgttttttttcatgttatcctaccataccctctgatttggtctcgttagtggatacaagcctagacgagattctcgctctcaggttcggtcccctacgaatggatacaaatcacggatacaaacatgaaatttgcatacactactacaaaatcgatttttcatggcgttgactttttgttttctctagcggccataagtggaaaccgttagcgaaattttaacgagggatgaggcgttaaggaccgtcagcgaaaatggatcttcgctggcggctgggttaagagtaccgcttgtaaaaataggggactttttataagcggacctcttaagtgattttcgctggcggttactaaggacctccgacagcaaaaagtacatactcatagagagcagcgcttgcaaaaaaaaatcaaccgcgttattaaaaacccccacagcccacaacccaccacccaccgcatccctctcctctcccagtcgcctccctctcctcttctcccatacacggccgtctccctctcctctccggtattctcagaggtgaagggagcctgcagtggtaacaacgacggcgcgtggaggtggatccggcgatggggaggagcataggcgaagctcgtggtgcggaggcggatccaacgatggggagcagcgacgaagctcgtggtgcgccgacaacgcgagctgcggcgactcaggccacgggcggtggatctggcggcccggggagtcgcaagccgcggtgggtggtgaaggagaggggcggtcgtggtggagaggtggatctggcggcggggagcggcgtggtcggtggacccgtggtggggaggggtgcgggcggcggccaagagtggcggtctcctctcccagtcgcctccctctcctctcctcccatacacggccgtctccctctcctctcctctctagtcttctcagaggcggtgaaagggtgcctgcagtggtaacggcgacgacggcacggaagctgatccggcaacgaggtgcagcgaccaaacctcgtggtgcggcgac

SEQ ID NO: 30226 - DNA, 8251 bp, Oryza sativa
  unsure (1)..(8251): unsure at all n locations
agtggcggtctcctctcccagtcgcctccctctcctctcctcccatacacggcggtctccctctcctctcctctctagtcttctcagaggcggtgaaagggtgcctgcagtggtaacggcgacggcggcacggaagctgatccggcaacgaggtgcagcgacgaagctcgtggtgcggcgacaacgtgagctgcggcgactcgggccatgggcggcggatctggcggcccggggagtcgcaggaggcggtgggcggtgaaggaaaggggcggttgtggtggagaggtggatctggcggcggggagcggcgtggtgggtcccatggcggggaggggtgcgggcgccggcgaagagtggcggtcgcggtggatccagcagcggctgccacacgacgacgacggccgggcctcgaaggttccagcggcttcctctaaccccctcccctctcccagatccaatgggtggcggtggtgctcggccggtgctcgatctggcggcagcgactccggcggcacccatatgtttgataatacaggcagagtaaaaattaaaataattcaaaagtaacatgaattcactgcacccatatgtttaatcgaagcaatatatatccctgcatcatatataaagtgcagtaaaaaatataatattaatgcatgcgtgttgtaggttcataagcctaaaaaaaatgacaaggttaaaacataaatatataaaaatttctgacaatatgttgataaaaagtatcaaatattaaagtgaacaaatactcgcacggttatgccttgtggtttagatcacattggtagtaatacatgtgagtattttaagaaaatcagccaagagtcatatacctgctgcatatattaaagacaaaatttgctacagaaaattaaaaaaacgtataattagctagtggacaaaaaaaactggtaattagttgctggacacctgccagattatgttattatatgtgaaggaattggagagagaaacagctgtgtaagtacgattttaccctttatttttttttccttatccttgttcttttctctctatctcattctttctctcttcttcaagtgagcccgagggcgacggcgcggcgaagtcatgctgggcgcctgggtcactctcacgattgagtttgttttatgttaatttggcgaagctgcgggctactgcagcaccacaggccgcagtggcaagagcaagcagcaagtctgcaaggaagccaaggagcaaggaagcaaaactaaaaggcaaattttgctaaaggacattgttaatgtgtggttttagccctaggacactacctaaactcacttttaggggaaaacactcgatgaatatagtaatttgccagtggacaccgtgacgattaaaataataatttccggttaaaaaggagagaaaaatcacgtgaaatgtcaaaaatgtccttgggcccacatgtcagctctatctcctatctctcttctcatctctctctatcttctctcccaaaggggaacggggcggcgtcggtccctggggctccagcttgttgcggcggaggagatggcacaggaccggcggtcggcggagtggagcacagcgtcggctgcggcggaccggagctagaggccgaagcaggcgggcgagcacacggtggctggcggactggaacggggcggcggcggcggtggaccagcgtgcggccggcggagcggcagcgtcgggcgagcggagtggcggcaacgtctagcgagcgcgtggcaagcggggtggagcgcttgtggcggcgggcgatcgcacgatgaccagcggagcggcggcgggcggggcggggcggagcggagcgggcaggtcgtggctggcggaataaagcggagcggcggcaggagaaggggggaggaagccggccggatatggggagatgaggccggcgggagaggggggaagatactgctgcaccggcgggagagggggaaaaggcgactgncgctctcgccagctgctggaaggaggtgatagagagagaagagagataagagagctaacatgtgggcccaagggcatttttgacatttcacatgatttctctctcctcttcaaccgaaaattattatttcaatcggcgtggtttccactgacaaattatcatgtttatggagtgttttcccccaaaagtgagtttgtgcagtgtcctagggctaaaaccacacattagtagtgttctgtagcaaaatttgccaaactaaaaaggaataaaaagagggagaggaaggggaaggtcttggcatcacacagtggtacatattgttcaattgtttagaatttcagcacattgcaaattcaaagtgtacagatttgtgattggaaattttgaaataaaatttgtgtaattgatgcgaaccctcgcattgagataatgttatgttgtacactatcatgcattgagattttttccccatattcttgttctatactaactcttgcggataatttacgggccacaccgactgcgagggagctgctccggcctggcgggcacagggcagctgcaacgagcagtccttccccgtcgaggaccctcccccttcgtgcggcgggaggtaagctgtggtgtcaaagccaccggtggtgtgcgcgacggtgggcgtggctgggacggtgtgcacggaggaaatcgcggtagcggacacccgtggtgcgtctcccctgcacgcactggtaccgtggctctggatgtgccgtgccgagctgccggccatcgacaacaccatcgaggaaggcggcggcgccaggagaaagccaagccgagagagccaaagggcaatatggtcttttctttttgtctctttctctgttttgtttgaaaagaataaaataatgtcttcagtgtcctcaagcatatgtttttttagagtgtcatagagccaattcacgtctttgtggtgtcctatagctaattacacgtttttttcgatgttattgttgacggtcattattgaccagtttcgaccgttaatattacccaatatataaagactaactatgcttacaatgcataatttccaaataaaatatctccttccactatatactatgctactaacatgtatccaggagaagcacatataaatggaggagaatcgacagcaaaataaatgatcaatcaattggatgctgtcgagaatcagacttgtggatagatgggctgacaacacggaattaccacgagcaaacaagcccacaattcacaccactggatcaaaggaccaatgttgacggtcgttagcgatcagtttcgaccatcaatactaccaaaataaaggagaactagttatacttgcaatgcatatttgtgttagaataataaatattccactagcactaggattactaacctcttgtagagaatgacataaaatggaggagaatcgatatcaaaacaggtgatcaatcaatcggacgatgttgagaatcagacttatcaacgaatgggccaagaactcagaaataacacgaccaattgggccaaaattcataagtctgcagaagggatcgagagaggaggccacctgccgaatttggaccaggccggcccagcccatggtttggccgaatcattgggttcagccgaacccaccgtggctccgttcgatgcagggtttggatgggcggtcaggattgctcccctatggcggttggagggtattactgacctttccaaccgtcataaccgtcattctcaagctatataaagccctctcatcctccatttcaagacacacctcaagcaagaagttcatttcatctctcaagtttagcatagtttctagagtataatggaatagaaatagaataaaatcttcagtcctcagagtcttcggaagaattcgtgtatggctctagtagcttttccttttttcttttttttatgacttgtactttatttagaatactcttctttatactactttggtattgtattactttccgagtatatgaataccaactttactatatgttcgagttatatttattatgatgctagcttatctgggagatgcaatggtgtgggtataataatcgtatttatgataactctatgtcatgacgatgatattagatagtatttggtaatttaagcgtagtgtttagattactagatatcattatttggggttatatgctgtggaagcgaggtgggccgctgatggtgacagctcagtatgggtattcctccacgaatgtatatagtcctaagatactttcctggggagggtactccaccgtatttagtcccggttgtatagtcatgacggattgtcgtaaggaactcgacaatcaggggtggcttctcgaagcaccagcagggcatcggatggagggtattagctaagtaatactataactaggatgtatatataatatgtatgtaaattagaagtataggaataggatctttctatattctttccacttagcttagataatcacgagtaagaggatgaatgcttctacttagtgttattgtaccctatgaattatattaacccctgcttagactttggttataaattattcgtacagtaatatataaattattagtactgttctctctattataatcttcccacgggattaaacaaatacgatacctttggaatactctcaggtgaaatgctacaatggtatattcatgcgcttgcggatgaactctgtaaccataatataccagaagtatttttgcgccattactgggaattaaatttctagtaatgtcgttaagaaataccaacaagcatttctggcaccattgccagggaagatttataaaagagattaccattactaatactttatatttacctctatataatcattgtactttgcaggctaaccatggttgttttcacttttattgtggaaacagggtagtacatgactggtttcaacttgccggaaaactctaaggaaaatccagaggctttctttcggagcgtaagccacgagtcgtcgctctgcagtaaactcttccgacatagaaaccagccataccagcgctaccaactttcaagactatggctgacaagaccctccgcgaatttgctgctccctctgctaacaacgtggccactgggccgcaaatcaacatgggagacgtggatttcgatctgaagtccagccttatcacaatggcgcaggctagcccgttttgcggcaagcctaatgaggatgccaatgctcatctgcaacagttcctggagatctgcaacacgttcacaatgaagggtgtcagtcctgacgccgtcaggctgcaattgtttccgttttccctccttgggaaagcgaaacaatggttttatgccaaccgtgccacgatcaacacctgggataaatgctctacgtcattcctgtcaaaattcttcccgatgggcaaaaccaacgcccttctggaaggatctcaagtttccagcagacgagggatgagtccattcctgaggcgtgggaacgacttcaggaatatatggccgcttgtcctcatcatgggatggacgactggctgatcttgtagaacttttagtatcatgacgagctgcgtgctcgagacatccgaccatgttttattggtcataattatccaactaaaatgcgacttaatggtgggttgtgggtgcatggttttgctagtcccacccatggcagttaaggaccggttcacaggatgcactggaagacttaccgcgcttaccacaagcgggaatgggtaactgtctgacttgaagtatagctttcctctctgacgcatccaggcaagggtgagcgtgatggagttcggatgggccctgcgacagtctatgcgcctttttgatttgcctaggcacgagaggggactgcccgctgcctgttgaggagtgggggtgaaacctgaggtgtggtgtgcttggtcagagagggttatatgaagggtcttgtcacaatcactcgacatggtgacgtgtccggacaggcgcggtgacatgccggtggattgtgtcttttgggtacagttgtgcacctctggccagagtaaaactattcgaatagccatgcccgcggttatgggcgatcgaccagattcatcgtgattagtcacacacttattaaatcgactcaatgcactgtagttcaggtgggttggttgggcctattcaacgtggtgtagcgttgatcagtggagatttaatattaccttaattaatcaactattttactgttttgctcaataaatgttttacaattgcctttatgcaaatagcctcaagccatccttgtatccccttgcacgcctgcatcattggtgtggcttgctgagtacggtggttgtactcagccttgctattattcccccttttcagaagtgtagtgcttctgagctaaagacggagttagaggaccaaggctcagaccccagttgagttttgcctgtggagtggagctgaagccctgctaggattgcctttttccgctgctgctgctttcgtttcgggtgtgaggactaagtgcctcttctgtaagtattttacgctttatttacgtttgaaaccgtatattacttgtcgttttgtttaccctgggtgattcttggacagagatttaatgcacaaaatagtctggaaatttgggctaaatttttgggcgtgacaaggtacaactacaactggtcttcgaccagtgacgtagcagtccacgtaccacgactttaagtgatcaagaacaactacacacatggtcttcatcttgtgtggtagtcacctcagcatcctatgagcatcaatgtcacaccctaaagttctcctcctaagcctaaaattgaatttataaatcatcctaagaaaatgccggtgcaaatcaagagaaaaccttaataaattaatgcaaataataatcgaaattggcatgtggaatttttcttgagttctacatgtcgaaatacgctaacaagatttttagtggaattttcagagctctcgaaataattttaaccaattaaaattgagcacatgcaattttaaatcccagggaaaatcttttcctccttttctttttcttttccctccttttcctcttcttgggccgncggcccagtccaccccgccgccgcgcgcgcccttctccttgtgggccggcccaagccgcccctccctctctccccgggacgccgacaggtgggccccacctgtcggggtcgtccccttcctccggctgcccgccccacgtcgccaccaccgccgaaaccgccgctgtgccaacgtccccgcctcctccgggtcatgtcggccacgcccgcgcatgcgccgcgccttccgcacccactcccccttttttccgctcgcgcccgcgcccgagatggccaggattcgaattccgaatcccacctctctctccacctccacctccccgcgttggccggcggaatcccgcccctaccggccatgtccgggattcccctcccctatttaagctccaccgccactccctctctctttttccccatctcgccgaactccctcgtgcttcccatcgctcccgggccgtgcttccacccgccgccgccgcttccgctactccggctgccgctagccgccgataggctcgccgccgcaccacgccgtcgccgccgcccgtccgatcggcctcgggggcgatctgggccgtcggtccggtggaccggcagccttgagccgctgacccgggggccccacttgccggcgcccctctctccccttgagccgctgacatgcgggccccgcctgtcggcaccaccccccctttgatgacgtcagccttgggacatattgcgcaataaatgatttaaggcctttttattatagtaataaacacagtgaatcttctaaaattcataactaattcatccgtgctccgtttaagcccattcaagtctcagtaaatcaagaaaaatgtgtagaatccattaaaaatggttttgttctctgtttcagtagtcttatagcctgtttgcattgtttgctttgtatgtcgcttagattccggttcttctgatgctccggtgtacttcgagatagtcgccgaggttcctccaactgcagagcaaggcaagttatgcctgtcacttgaacatgttgatcctatattgcaaatggtctattgtttttcttcaaatactgcattgttttataatgttactatgggatgtttacctattgttacagccatgctattttgataccatgctcct

SEQ ID NO: 30227 - DNA, 29095 bp, Oryza sativa
tggacagtggatgaataatatgattaattattacaactgtttaattctttcaacttctgtttataaaagctcgctttatgcaaataaaccactctagctctcctttgataattccctgcatcatacccctattccggtatgacttgctgagtacagtgggtagtactcaatcttgctctattttccccaaccccagaagtacaagtatgtgtcagatggtggtttctccgaggagtaggcttcgtccgtgccgtcgaggatgtctgtggagtggtgttcccgctgcagatcaagtcaaggcttagttcctgttatctttcgtttttccgctgcatttatgtaagacttttatgatgtttgtaagacgtggatctgaatgtcaacattgtcgtttgtgtaccccggccggtcctggacggggattttaatgatgcccaatcatgttgttacaaatgaaagaataatgtctatctatacataataaagtaacttcaaatgcagcacaatatatgcgcctaaactttgcagtactgattttgcagttcagttttctgtgagctttatgagatgttgaaaccgaattttgttttttgcccaaagaaaataatttagagaagttttgtttcaatcattattttggcctgagtttaccctgctaaatgtgtggaaaattatctcattaaaatctcatgtacatgtttatatatccaaatcaaactatttaatgctcagcagaccgtgaaagaggaaaattgggaaacatccattgctgattcactgatctattttaagctgcatttgtacatttactagcttttgataatacatggctgctatctcactttttcttgagttatctatcgtcgtttgttctcataatagtttaactcttacaggcttaaccattatctattgcatgtagtccaaggcataaagtaatgaaaataagattctcactgaaaaacatctgttacgctatataatacaataacaaattagttttattcaatgaattaccaagacaatgtttacaatacttttatttttatcaatgattatgagctttaatttgtgagtatatgtagatgtacattagcaatgaatgcatttttcttcaattgtatatatcaatgtgctttgcacgtgcacgttcactagtttttttaatatatgacgttgttgacttttagatatgatgtttggatattttttttaagaaaaacatataaatataatttattatcattaaagatattttaatcattacttatatttttcctaagacgagtatgaaatgttagataaagaaaaatcaataacaccatctatttattaatacggaaggagtagtatttttatttctttcccttatctgtttattaatttttccttggttttttactttccttcaatctatgatagctccagctcgtgcgatttgtcactatatctgtgaggttgtgagcctgtgatcgtgagaggctatttgggtagccagctagtttgatccagactttcagagggagatgagcggcgcaggaaacactccccaatttaggtgcgtttggttgctcgtatacttctagcctggttcatctcctttatccagactaagattggcctggttaaagatatacatatgcattgtttggttgtttgtattgaataaacctgcatatggttagatattgtttggttagttgtattaaagatactgtatgcgaaagatgtttggttggttggatcaaaaatacattctggattggagggtgagtttacctccatgggtattaaattgagttttaactaagtccaagatgaagttttcggaatattgagtatagtttcttcgtattggagaggataacaacatattacatgcagtgctactgacttcttggagatgcacaaatttcaatgacgaaaaaattcgccaaactaggaagtcccaaaaaattgtgccaaacattaaattacactattataaattaatcgtcgggattatccggtcaaccggatagaaaaagaaaagaaaaaaatgaaaaaaaaaaggaagagagaaatgcatcgccatctcgcaactgccgtcgccgctcgcctacatgacgctcgccactctccctttgagtcccgctgtttgccgccgccagcagagttcatggctgcggatccggtgccgtcgaagctgaagactcccggatctagcgtgtcgaagcttgtggccgtcggatctggtgcgtcacagctcgtgaaggagggaagcggtggccgatgagggagacgatgtcggcaacgactaggagaagaggaggaagaagatggcagcgacgacgatgcccctagccctccctccgtccctcctcctgccctctctctttcttctggatttcgttgagctcaagctccccatggagacggcgccgacaactactaggagaagaggagaggaggtagaagatggcagtgccgctgccgccgacggtgcccctcgagccctcccttctggatgcatcgacccctgcgcgccgctgcacctgtccatcccgagaaaatggacatttagccacttccaaaacacggtttcactctaatgccattccgaaaacgtgtttttgctaaaatgctaatatgaagtgcgtgcttaccgccactttgcaaaattttggcccttttgtacattttcgaaatcaatttcgctcctccaccggatgatgagataaaattgcctttcatgtcctttgccgccatcattgagggagaggagctcgtcctcgtcggccatctccatgtccaccatgagcagctcaccgtcttcctcctcctcctccatggatggcatctgaagcagtgctatatggggagcccagacaacgaggtggccggcgagtcctccgacatattctcttccctcgaccttgccacctccgccgactacctcgccgcggtcgacgacgacatcccggaggtcgcttcgccgtggtcgacgatggcggctagggtttcgaggtggccccatggcctcgtcggcgacggaggcgaagggggggcctcctcgacgacctcacctctgcttccgcctcgtcggtgccgtccggatgcggcaggcaggggcagctgccggtggttttgtcgctccacgcacccagataccctcgttggcagcgggcgtggactcatccgacggcgctgttggccatcccgccgtcgtcggcagcggtggtgggctcatccgatggcgctgccaaggctgccaccatggaaggggaaggatggagggcaatttcgtctcattatccactgaagaagcgaagatgattttgaaaatgcacaaaagggccaaaatggcaaagtggtgatgagcacgcgctttatattggaattttagtgaaacgcgttttcgagatggcattctaggaaaactgtgtttcgaacgtggctaaatgttcattttctcgtccatcccacacttgcatccgctcatccccgcgtcggcgtgagctgggcctggctgaggacctacggccgatttccgcgtttcctcgcagcctggctcagcggccgtttttgcatcagatgatcttggctcgctcacccatgcaggcaaccaaacgcgttgctggttgcatgcgggatgcgagccacccccggtgcagccaaccaaacacacccttaattgccgatcaaattctaggggaacggccgggttgaggaggtttcacgggatgggaataagttcactttggctccgttaagtagcgtcctaatctgatccatatccctcaaccacaatatcagatattttgaccctctaactattaaaaccggtgcaatttgacttcctcagcggtttgaaagggcggtttcgctgacgtggcgtctacgtgacaatgttgaccaggtctttatgccacgtggcgttgacatgacgcttatgtgacattagattaaaaaattatatgtgacccatttggcatttatgcaaaatattttgtgaggcccacatgtcatgcccctctctctcccttatttctctctttctcttcaccttcatccgatggcggcaggcgagggcttgagtggcggcgacggcggcggtgggcgatgggcacggtggccggcgggcgggcaaatgctggagtggcgaatgaagcttccgaggaactcttcatcgggaaactgttttaagcattcgggtgaatgtccacctgtttcttgcatgtcatctaaatggttatggaaagttttaaaaaaaattgacatgataggataatatgaatatattacttcacaaacatgcaagttcaaatttaacttctacaagttgtaacaaaaataacaaatttgactgtaaatatacgtatactaaaagtttaatttgttattttcgttacaacttgtaaaatttgaatttgaacttgcatgtttgtgaagtgatatattacatattaatctatcttgtaatttttttgaaattttttcataattatttaattgacatgcaagaaacgggtgggcatccacccgagagattagaattcatcctcactcttcatcctctcctccccctgtctcgtatgccgcactgcattgcttggctcgtcctcgtgtgcatgtgtgtgttcgcgcgtgcgagtgctcattctgccttgcctttcgattggttactattccccttgtaatttgatgctgatttgcggtgaagtagatggattcgcctatgtgtttccacattttttttgggtcttgttgcgagcagcgtctggttgttttgtgctgtgcgtgttcggttgtttccagtttttctcccccaatttcgtgcgttctagaggtaaattagtcttgtctcgtggtcaattttttgcgggatatttcgcctccccatatttgatctctgttttggacttttggtgctatttccccccaacaaagagagctgaaataatcatgcattgcatgtgtagtttgacattcggtagagaagataaataacatgccttagagcagtgctcatgtgaagagaaaggggtgagagggaaaaagagagatcatgacatgtgggtcccacaaatcattttttgtaaatgacaaatgagtctcacatattttttttaattctaatgtcatataaacgtcacgtcaataccgtgtggcataaagactaggtcaacaccgccgcgtagatgacatgtcagcgaagccaccctccaaaaccgctgagggagtcatattgcaccggttttaataaatgagggggggggtcaagatatgcagtatcgtggtgagggatacgaatcaggttaagccactggttaagggatacgattgatttctcgcggcggtttcttaatctgatcgtgggcaaccgcaaccctgatgtcaaatcgctatggtacttcgacatgatgcaccagcagttattctatccggcaacacctccaccgacacagaaggttggcgaattctggcaaaagtttaaacaggcagctggcacgatgatggatagtatggggcttcccttctccagcatcaacttccgagcttcagctctcaacgtcaacaaccaatcgaagatggactgtttcccgcttgctagccgcgaggtgatttgcacggatcagtctggccgcgcattcctcgtcaacgcagatacgtgcgaggtaggaaccatgcccagtcttcacaagcccaagtcgatgcccttgtctgtcttcgtagttcgttcccatgatggctatggcagcagcctctttgtcatggagaggattcccaaaccggagttgggcttcaacagcgatcagtttgaggccttcgtataccgcaagtctacattatcttcctacagaaaggcctggcactgccattaacttccacctccgccttttgtctgtgaacccaagcactgtcacagctgctgcagcagcccagacccagagatcagctcctacgctgtgcttggcggtggctcacacatttgcttatctgtcaatggcatcggcacctactgcctggagacagcaagccactcatggagccaagttggcaaagtggacactgccattccatggcaggattgattatgtgcctgagttcaacctctggtttggcctctctgctgaggcccggcgcttggctgcggctgacctctctgccatggactcccagccacagctagtgggcccttggaaggaactcaacctgccagaggaatggagggagtgcaaggatccacaacttgtcaaccttggctcaggcaggttctgcatcgctaggttcttccgcagtaacagtgactttgggaatgaaccaattgccgtgtttacaggtgtggaggtagtgccacatgtcggtgatgccaatggcaatgcaaataaaggcagcaatgggaaagtgcaactccaaatgatccctcacagatcaaaatgtcacgcatctaatgccccactacaatcgatgttgtgctctgactaatattagtgctggcatccttttttatccattttgttttttatctgaataagagataacttagaatattgttgcaagagatggtctccctattatctctatttgctagtagtgcagtattgtgtcctacaatggcagattctaaaattaactgaatttactcctaccatttatatggcagtcttgttttatatttgtgagaaaattgcacttcttcgtggagctgaacggctatctaactagcaccactttacttgcaagtcgttttatgagccacttaacactttatcacaattgaccaaaatatcttttttaaaaaaagtaaattttacaaaactatatatacgtggatcaaactatcacagaactactacatgaatcacaaagctacagatttagtcattgcatcacaaaactatatatttatcacaaaactatagatttagtgaagttatcaaagaactacaaatttcactaaattacaaaatttgtactacaaattgtagagtttagatccctagcactattatttattataagttataacaattgtggttttgtgataaaattatgctacatctatatttttatatgataccttaaatcggataaatttaacacaaaatctataattttgtgatgcgcattcttttgcgatagttttcatcaaagtacatgtagttttataaattttatttatttttatttatgactttgttaccgtgtaagttggcattggaagagaaacgtagaaagaggccatcgaaacgctttgtgaacgacgacgctcttggcggtgtgtggtgaataagattattctttcgttcatgtaataaccatatatgcaagtttacactttcaactcatttccatattattactaagtgcatgctgaatggttgtttctggatgactgtttattgaaggttactgaaactatactacctgttcttttttttttatgcggggattgattccaagatatgattgatgggcatgtttatcttcagaatctcaatctgagatatatgtatctatgaatgtatgtcagatcacatggtgtcttccgatgaaatcaaccagttagaagatggtctcgccgacgattctgatctcgacactggtgctagctccaacctcggcgacgatggtgccatcaacattgactctgacgccaacctcgacaacgatggtgccgtcgacctcgaccatgacaccgatctcgatgacgataccggcatcgaccttgacgtcgtcggcgccgaactcaacatcgatgatgctgccatcgaccttgacgacgatgccgccatcaacctcgacaactttgatcctatggatatatataacatggatgattttcttgctgagttggtgtttttagatgaatatagtgagcagattattatcaggatgaaggacaagataacagctgagccatctcattgtcaacgtcaaagtggtacaagaccgtatataccaagaaaccaagaagatggcaatgaggatcttgtggccaactacttctccgagtcccctatctacaccgatgagatgttccataggaggtttcggatgaggaggcccttagtgaatggtctccttattttactaatagagtggatgccactggtagagcaggacattcaccacttcagaagtgtacagccgccattcatatgctagcatatggaactccggtggaccaacttgacgaggtattaaagattggtcctagtatagctttggagtgtttgggcaaatttgctaaaggagtcattgaaatatttagtgaagagtacttacgagctccaaggaatgatgaggttgaaagattgctacaggttgctaagtcgcgtggttttcctggcatgttaggaagtatagactgcatgcattgggcatgaaaaaattgcccggtctctcggcgcggccaatttactcgtggtgacaagggagttcctaccatgatcctctaagcggtagcatcgaaagaccttcgcatatagcatgcttttttttggtactacaggatccaataacgacatcaatgtgttaaacaagtcaccgttgttcattgatgcattgataggggaagctcctcgtgtgcagtttactgtaaatgggaaccaatataacacggggtactaccttgctgatggaatttatcctgagtggaaaacattcgtgaagacaatacaactttctcagacagatgaagatatattatatgcagcccgtcaagaggaagagaggaaggatgttgagcgagcctttggtgtgttgcagtctcactttaacatcgtatgtcgtccagcccggatgtgacagaggggtgatgctatcaacataatgtaagcttgtattattcttcacaatatgatagttgaagatgaaaaggaaatgactgaaattcctttggatttgaatgagaacccaggagcatcaatcgttctgccaccggaagtgagcaactcctccaaccccaacccatgctttgctgcagtactacgaaggaattcatctattcgtgatcgtccaactcatatgcaactcaagaaagatttagttgcacatatatggcagcgcttggaaaaaagtagaactactctatataacgaaataatgtaatttagcttactgtttgcttaaaataatagtatgtgtgtgctggtatgctcattgtctttttttatatgatagcttactgtttgcttaaataatagcttgttgtttgcacaatttatggaaggctaaaatttacatttgatctagtatacatgatgaatttattagccatttattagcctgtattaatggagagtcagctaaagagaccatcctttgtatataggagttttttcgctgacatggagtgtagagagcctgcactgggctctagctttgaacatgccctaagattactttctcattatattgttttctttatttccagatatgaacgcaatataacattaattgaaacctaatgaaggtaaatggccaacataagcaaggtgagcaactgaaagccaattatgtggagtgcaataatgaagggtattgttactgataactgagttatcaggttgccgcaagaggtgcctgaataaatttatctacacatctgcattcattcaaatgatgctttgaggacaaaattgctttcctaattagttattggctgaatcatatatttcaatggactattgaacagcacatatgcattctgctataggcaatgtctaaacctaggaggttgggaatgcccatggaccatggtggagcggatgctgcgtaggtgcaggaaggatagccccacagttgcgtcactgcatggggtgcggaggaggaaactgaggcgtctgagagaaggggaggtgtcgttcaggcggcgaagaataacactattatttgaggaactctttgtaaaataaatttctaaaaggactgggaagatatttttgccaattaaaggatccaacggcctgtaatgtctgaattgaaaatcgaatgctttataatcacttaatgatgtggcactgtagttttgcatgcagggtttcacctttcacttatttagatatagttaaacatagtgagatttatgttatgtgatattcaccatgagaaatacttttagataaaaattagttaagtgttatatctaaaagccaaaaacagcgcatatttaaaaatcggtgggagtatgatttaattggcatcactattaaggacaaaacaatcaattaaagtaaccccttgcaacattagccctgaatgaggacagattcatcgcatttatatggtaagaaaagacaattcatttaaattgaagtagaagaaatagccataagtccgaaaacattttcttcctttcatttccaattggtagctgccaaggtttgtacatgtaagctttatgtcgacaggaaacatcaacttgttacattggtcacaataaactggctaatccagaaacaattagagaatacaataacttgttgccatcaagttagaaatgaattgggatcaagctgaaatgaatatcaagaaatgcaattctagaagaatgcaaaccaatggtggctctatttcaattctaatggttccctagggaagctgtctaggatgagttatctgaaatttctgatctattcatggcactatgtatctacattattgttcatctcatcctggagagtggcaattgccactccagatgataccactgctatctgatccactagactgctactgaatacttcttttcatcgccattagctctggttcttctgggagcttagctagccttcttcagcaacctgccaagtgtgacctcctcacacaggaattattgaagctacttgattgttctgattccctccggttaatctcaatcccgagcaactttattggggggttagtggagtcattaaccattgctgccatcacagattccgaggggagttcagttccaacagaagaaacccttgacaaccaatagtccaagcattggtgacagggatctagagcctcgatttcctgttgaacaacaaagaatttttgtgtaatattcaactagttacttgaagtgaccaggtttcacaaaaataaatactgtggatatcgtaaaaatctaccttaattataggggaggataagaacccaaacatttcaagtccattcaaagaattgcaggatagaaaatcaggaaggccagattttccaaaacttatttgttttgctatttcttcatttactctgtctcttacactgtcccaacattgcattggtgatgtgtgagtaaacgaaacttctggaagaccttcgacagtcacctgttattaattcagtagcttatgtgagcacaatgaaggaaagcagacaaatcctgaaatttagaaaaacaagaagcgtttataataaaagcgtaccctaaacaatggtccaagaagcccagcatcaagaacttcggagatgtagcagcatgtccttgttggatctagtacactatgaaatgtaactcgactcttaaatcctgcatagatgaatttctattagtgatatttctggaggatgtacatattaccagaagacaaaaataatcattgcattgttcagtgtatatacctttggggaatatagcttgctgattgcaccactttttaccaatcatcattgttccactgtctagcagctcaaccgtatacttagctattgctggcttagagacttcatcagtttggctcgaggaaggcttggccaattgactaacttggccatcagaagactgtgctaaattggatttaatgtcaacaccaaacagtttctctgtggtaatggaagctagcgtagaatttcctgtttgaattcttgaagatggtaactcagatgaatgattcaaggacagtgagccactgcagtcagactttgacctgcttggattactagctgttgctggagactcaagattgacaaccatcttgttcttatcatgtttttctgaagcaatctggattcccttctcttgctggtatcctgctggctttgcggggtcatagtgatattgatcttgacttcctaagctgcagccatgattgacgttggttgctgaatccggaaattccgtgttttcacccaagtccatcttcttgtactgagtagaaccagatgggcagactaaacctaaatcattctgtccccactggtagaccgcagttggatcaccctctagagctgcaacaagagtatggagctcctctatggtataccgcaacaacgcggtttttctgtccatttcacatgaacatagaatgtttgcatggtttaagcaagcaaaacgatttggggagcattggcagctgacagctgacaaatggagatcataaaaacatgaaaagcattcccggtcagctgaatcataatccccatccattttcttatatcgcagtgccatattccctccccgtgctgccttctccattttaacccttgtctgcaatatagtacaaccaaaatatgagtaattagtctttttgatgaaaaagaaagagttaatcctttgagtcacagctgattaataatcagtgataaataacaacggcctaaactagtgagtaccttaattgcacttgtcagcattccgtcctttccgcaagtatcctgccatctgtatactccttgttcacttttgcagtcgctaaggttcatccaaagctgtctgacagcttcatttgcagtttttagtaataatttgtcatgtgatatggatgtcttgcgccgctgctccctgtagagctcaacagcacattgtccgtgaggcagccaatccacaggtgcgacatttactgcctccgcacagttgaagccacagttgaacccagaatggtaagctcgcggtagcgttagaacaaactcgcctggattctgaacaacacgataaacaggaactccttctgatttaagaacagaaggagataattgcgtaacctgcaccatgaaaatttaggatgaaaatgaatgaagatgcagcatatttatttgtacaatacaggaagataattattctcagatgaaccactgtgtagtgtcagcaagaatttgtgactggtagtaggcactaggcaatgataataaatagagtactaaaatggaacagaaaataatgttttcctttgaatttcagtacatggatgctaagttgtttccagttcgcaatatatccaaaaagtttattttgcaatcagtgaattcatgttgttagaatcacagggtcaattctattacataacaaacatgcaatttcaaatggttaccagctcatgtaggagatcaggctgttcttcaaacaatcttggtaagttctttctcatagcttcttccagcttcactgcatcagcaccaggaacaccataccatacttttggttcaccaaaatgcatgtaattcatagaataaaggaaatgatcttccacgtgctacaaagttcaagagagagatatcagccaagaataattatcataatcaattaaaaatcacatattttcctactatgtaaacattcatcttatgttaatccactaagaagattgaatagcactgccaggttagaatatcactaggctagtagcattttccaatcccatagagcaataatatgttcattcttcaacaagcaaggaagttaattagattacttttacctaggcaaacggctattatactattaccaacagaatgataacattgtaaaaatgggtcaatgagaaaataaaagcttacccaacagaatgatgagaagcacatccctacataaagccaagggactacgacgccagatatatcctcagtttcaaatgacagtacagacccaggaatacgtggaagattgttcaaattccaacaagataaaccatatggatctcgtctatttgaatctgaagataatttagagaatccactactgaacattgaagtgtccaaatcagcaccataatccacctagtcaaagagagtccgatgcttatcagtatgtattaatagttaaataggaagatgatgcacagatagcaaactaaatacctcaacttcgtcagtggggcatacaactatccgccaatattctccctctatttcatcgaccgatggttgccaattttttttcttctttttaatttcagaaagagggatttcgtcacttccctttattccaaaatactgctgcttaaactcatctgcatatttctgaaactcatctagtgtgaaatctgagccagattgaaagccaaacttctcgtctgcatctgcgcagtcttctgatgtatttgcactaggacgcctgtgagtcatcccaaatctcagtctctttctcctcttcctcttcttctgaactcgaggttgtgattttttctttgtgggttcccggttttgaagcttgtcaacttgttgaacacgggtattgaactctgtacattcccagaagttcttctccttcagagaacaaggcggtcgccaagaagatggtggaacaatacgacaaattccatacttttctgcttggggacgaatgctcgtaatatatctaattggatctttaaactcctgaagggaaagaacgattagctaactattactatgctatcagcatatctcatggaatagttatgtaagataaatgtacacaaacctcttccgttggagtgaaaacaggggcatcatcaatttcaggtctgtacgattcatgtggatgccactttccatttgtctgttcataaaagtaagataaaatagcatgaaaaattaattagccaataataataaagctgtagaggaatagaaatgacaacattcagctaataaaatcaaaacttttcaaggaattacagttgtagctccagcaacattgtccccgcaagctcctgatgggcagagatcctgaaaaggagtagtcttacaaaattagcttgtaccttgaatatttcattcatcaggaaagtgccacagattggatgttcttataggacagagaaatttctattacaagttaacaatttaacatttaccaatggaaaataaataatattgcacgataccattcatcaaaatttgtttacatatccgcatgtatatgcttgagttcatgattggtcgatcaatggactttagttccaacatcattacttgaggaaagttgatttgatttagtagaattttctcatagattggcatatatttatatcatataatcaattcatggatttgtcaatctactagcacaagggcaaatccaagttttttcgccgggccaaatcccaaattcccccaataggccaagaacatcgaattagttacagccactgaaatcacacacaaatttgcatcaccaatttacagatcgacatgataggttgggggaaattattcctttaatctcaaatcaggaacaacagaacccagagttacctaggggaagatgccaatctgttgcggcatccgaatcgcatatcaattttaaacctacaattctcaggatccataagtttttctctctaggacacattattcatcgatccacccaatgctctcccgacctaatctaagaaccccaaatcaaacgcatcgcatccagaaattcgcatctcattgctactcatccgacctgatagcacccaaacaacacacaaatagaaactccccccacatgctccataccagagaactaaattcacgatccatacagacagaattctatcctctccaatcaaaacgaacgaaccccaaacccacggcaacgattccttacgtgcaacagtcgcctaccaaatgaacagttcctcgaaacgtgaagggcgagacggaacaaaaattatatatataacaaacaaaaaggaatccaccaccacgtacgacgacgaagaaggcggcgtgttcccccctgatctaccctactaacaccacatgcaaatccggcctcgtaagcacgtacctgcggcgcggaggccggctccggcgacggggtgcggccgcgcattcgccgcttctcgccgcggcgcgggggcgggggcggcggcgcgctggcctcctcgccggggtcgcgggaggaaaccatgggcgagatttggtgggcggccgcggaagctatctccatagagaaaagaaaagaaaaaagagaagtccgcggcttggttttacgggggagggagtcggagaggggtaacgacctcgcacgtgcgctgcaccacgggggacccccactaggagttgtggtcgggccgggccggtgggccccaccggtcagcgtcagccccctctttgtgttctatacttctattcggacccggtcgggatgtgtgtgtgattgattatgtgaagaacacaaagttcagatccagcttgggctaccctgggtagggtttgctctcaagcctaaggaactaaagaacatggtgatgtgaaaaattgtgagtttgtgaatgtgatggtagatggatggccgatgggggaggggggaagggctatggggtggttttataggcggccgcggcatggagggagggacgcgtattgatatcctactaaagttatattattacaaatttggatgtgaggatgattaatatgtggatttaatggtagaaaccaacaccagaccttaggtggtggtacaagtgtcatttgagctaggttgttgttgacgtaaatctgacgtctagtaaataccaaacaaatctggttgcaaaatattataatgttatatttgttttctagatttatttcgagagatattttttatataggaggaagtgcattgattgatgtagatataggtgtgatactcatgtcataactggtggtagctaaatataatgtttatgaaaatgcaattcactagatctgtttatgggcatcccgccttgaccggcctaggttgggcctctattttcatcctaaaaacctattccaaagcctgaacaaaccaaaaaagtaaattaaatattaatactcatacttttttttattttagagtaacaataataataactactccattcaaatatggaaactgataagtattttaggttataggctgggccaaactcgggcttgtagttttctctcagctttttcatgacccagcataacctgctttgacatgtctacccttggcagactatgggcaaagatgacacattgcccaaatctgtggaagggatagagaacttcaagtggggattccattagttttcaaaaaaaaaaaagtggggattacattcatttcatatgtagatcacaatttgagatatttactatgctcaaatgatggtatggaatcatttcagtttttcacaaatgtgtgctatgggttttaggaaatatttcaaacaggatcggaaccaactacaaatcgaacggctgatttaacaccaaagtcgggcaccgggagccacaggcgtggagggacgtgcattaaatatcttgctaaacttaaatcaagacgtatttagatgcgagaatatggtccataaatatgtggatttaatggtggaaacaaacatcgcttatgtggtggtataagtgtcacttgagttgtgtgctagttggtgtaaatttggcatctagtaaatgctgagacatatcttaacacaaaaggattatatattcatttttttcaatatttatttcaagatatatttttacagaaggaagtgcactgattgatgtgatatggatgagctcatgacgtaatgggtggtaactaaatataatgtttacgagaataccattgactaaattgactagatatgtttatgggtagccgacattgataggccagcttgggtctctattttcatccaaaaaaaacctattctagatcttaaacaagccccaaaaataaattaaatatcaatattatacatttttgtttaaataatacataataactatttagatatgaaaactagtgtgggcttgtagttttctctcgggcttttcatgacccggcttaacctactttggcatatctacccttggcagactatgggcaaatatgacacattgcccaaatgtgtggaagggatagagaacttcaagtggggattccattagtttttttaaaaaaaaggtggggattacattaatttcatatatggatcataatttgagatatttactattctcaaatgatgatatggaatcatttctatttttcacaaatgtgtgatatggattttggtaaatcttcctaattgtttttgaaccgactacaaagcgaacacttgatttaacaccaaaagttgggcgcccaccccaacccccctccccaggagccacagtgcaaagggatgtgatttgacatcctacaaaacttaaatcaagagagatttagatgcgaggatatggtccattaatacatggattcaagggtggaaaacatcatcgcttaggtggtggtacaagtgtcactcgacgtatatggtggttggcataaatctggtgtctagtaaatgttgggacaaatttggatgcaaaagattatatgtcgaattattttctagatttatttcaaaagatatttttacaggaggaagtgtatttattgatgtagatgtagatgagctcgtgacataacgggtggtagctaaatattatatttacgaaaataccattgactagacctatttattggcaacccacattgataggctagcttgggtctctatttttatcaaaaacctattccatagcttaaacaagcccaaaaataaaaattaaatattaatatttatacttttttgtttaaataataataatatctattcagatatgaaaactagctcagttttgtagtttttcctcgcacttttcatggcccaagataacccgcattattcgacatgcctatccttggcatactgtggttgaagatggcatgctgcccaaatgtgcgaaagggatcaatatcttcaactggggatcacatttatttcatatgtagatcataatttgagatatttacgatgttcaaattgtggtggtacgaaaacttttctattattcacaagtacagatgtggatccggttagaggagatgatctggtgacattccataactatgacaagggagattaatacccaaaagagagaaagacatcgactacgctaatatggtggtacaagcgctattggacatgccaaaattccaatgatatatatggactccatgaagattcagaatggcaagcaagagttacaaaccctgtctttatctagggatcagggctcaatataggggaaaataaccgttataagttcactagtctttctgcccttccccctacaactcactttcgtaaaaggacccctacaagttcaatttctcttttacttcccctttcactagtttttaacgatttatcaccgttggttcaattcctcgactcctcatgcctcctgggcttcagcacggcaagacgaagttaccccatgtcgttttagcaagaacatctacctccttgtcaactacggatcacctaagttgtaaacgttcttaatagttgtgctgtgttttgtgttgaggtttgccatcaccacccctgcgctcgtggaaggaaagagaatcctagtaaacttaaatcaaagagggatttagatgggagaatatgatctgttgatatgtggattcaagggtggaatccagcgtcacttaggtagtggtacaagtgtcacttgagttgtgtgttggttggtgtaaatatggcgtttagtaaatgccgggacaaatttagttgtaaaagattatatgctgattttttttctagatttatttcaagagatatttttatagaggaagtgcattgattgatgtagatagagatgagctcatgccgtaaagagcggtagctaaatataatgtttacagaaataccattgcctagacctgtttatgggcagcctgcatttgaggctctgtttggcaaatgggatgaggagtgtgggaaatggatgttatttccatttttcatatttccaccgtttgggtgtggatgggagtgggatatagaatcctgcttgattgagggtggattgactgctaggaaaaattactgaattaccctcaccatttgaacttatagataatagctgtgctgtttgtttactcatttagcatagtttgaaggggcattttggtcattcttctagaaacttccttttccaatccatccaaccaaacatgggataaaatttcccttcatataagagcaagtttaataagagagtcatcagttagctataagccaatgacacgtcatctaaaagcaatcaaatagatagatctttgtatcaaccagctgcataacacatactccaatactaatcattcattttattatatggaggagggcccaccatcatccaatgcatgcatgagagtaaatggctgatgaagataatcggctaagttttctaggcgcctgtgccaaggctggcgattgcataagcgcccgatcccctctctctcatcttgcctctctccaccacgtcagacgaagctgagctgtacaggcttatagctgactgaaattttgttattatacttgctctaaactaccaccacatcctaccaggatattatatccatttcccaatgggtataacctattagccaaacggagcctgataggctagctttggcctatattttcacccaaaaacctattccaaagcctaaacaagtccaaaaaataaattaaataccaatatttatacatttttattttagaataataataataactattcaattatgaaaactagcaaaatactactccctccgtcccaaaatataagcatttttagaccctgacacggtttctgagatgctactttaaccaacaatatctgtaaagtaagatgttttaaaataaaaagtattgcatattatgataatttgtttaatgataaatctagtaacatcaattttacattattgatctttttttttattttttttgttactaatggtcaaagttagaaataattgatttatcactatactaaaaaaatgtttatattttgggacggcgggagtatgtattttaggttttgggatgggccaagatcgggattgcagctttctctcgagggtttttgtggctacactaacaagcttttgacatgtctatcccagggattccaattttggtttgaaaatttgaaacttttgtaattacgctcccctctagcaagcaaatatctcgcccggaatttttgctttttccccaaaattatgtgaatttggtcaaaaatttatccaaattcagtcaaagtttgctaatttttcaaataattttgggcaaaaagttccaaaattaccaaaagtttcagttgcaccaaaattctaaaattttggtaaaaaccaaaagtgaaaaacctggtctatccttggtgtacaagggttaaagatgacacgctgcctaaatgtgtgaaagggatccagatctttatgtggggattacattcatttcatatgtagatcataatttaagatatttatgaagttcaaattgtggtggtacggaatcatttctatttttcacgaattgtatatatggattttaggaaccccctcccctccccctcccctccctttcccaccttgttagaggatatgatacggtgatattccacatactccctccattttttaatagatgacgccgttgacttttgaacatatgtttgaccattcgtattatttaaaaaattttatgtaaatgtatagatataaatcatgcttaaagtactttgagtgataaaacaactcataacaaaataaattataattacgtaaaatttttgaataagacgaatggtcaaacgtgtgataaaaagtcaacggcgtcatctattgaaaaacggaggtagtatatgacaatagaggttgatggcaaaaaagtgtttggaaaagaaataattgtactagttgccttcattgttttcacttgctacgatcggtaggcactgatgagtttggtttgctggtaaagagggccagtgcattctttcgtctgtgacgtgaattggtgaatgtatgatgcacccttgatttttattttatataaaaaatagtagtactactctagtgtcaaatcccaatcagggtatcaaactatttttatcctagttaattctagtataaaagaaagcatacgatcagctaaaatggccatacagaaatatagtggttccccgaaagaagaaaaccaaaaactggactgacaaccttacatatactatatgagcagccaaaaagtgattataaaaagaccttatggtgaccatatacattatggaggtaagccacaatacactaaatggttgtttggatgctatattaacattttcattctttaatatatgagaaacgattttttatcctaagtcccaaaacataaatatctcgactagattaagaactagtaccaaagatgttttagtactagttaaagtcgaagtacctagaaacatctttattctcggttggtgttaccaaccgatactaaagatgcctccagggttagtttaaaaagaaagcagggctgaggtgagagctcttgagttcgaattccacatctcactttttttttgtcttagtatgcatcttgagatcgagatatttagtctcgatttactggatcggttgctacaaccggtattaaagatcgtttctcctgtagtttttaaccggtacaaatttataatacttttgtaccacactttagctaagttatgaccaacaaaatgtaaaccacactttagctagcaaaagaaaagtgtgccatacacttttgagttgatgacatatgggaccatgagaaatgaaagagaatcttatcacaagtgtggtcatgaaccaaacaatgagctaacttgatcaaacttgcctaacatgaggtgtaacaatgtttggcaaagtttaggaggtaaccaaacaacctctaaatgcaaaggataactccaaacttatggctcaaccacaagcaataaagtaatatgtaaaactaagatggttgataaaggtaataaactttacacttgtgaggtccatcttagtatacactcttgttttaagcattgtggcaataaccaagaaatagtgagacctaccttaatgttattaaggccataaatattggagatggagatgcctacttttttttctctctttatggatttggtgattatcgtgtgtatgtttttcaatctcctaaacgatatttttttaaaaaaaatctttttaatatgtaattcatttgtttgggcctcaaataattctaataaactcagttcaatccgatcatgtattggctataaagaagacagcgagaaaggttgaggccccttcagcctgttgggaggcatactcctagtagaaagacagctgagctgttcaattcagataacccaatttttgctaaaatttcgaacactttctttatctgttactgtaaatctgtatccattttcttggccgggctgtttcttcaaatgtcagcacatccattgtcgatgttctttctctatcttgaccaatcgattgagctaactaacgccgacgattcagccatccatgcttcttacctaaccagtttataaaccgattgagaatactaaacattgcaacaaaaggtgcttctttctgaaactgcgaactgcttcgatacctacaggctacaatgcagttctttaatagttctccaattaaagtgatccattcagtcaccaaagacttcgacgtttgactttcattaactgagcttgagatgcgattttgaccacaaattttatattcgaattagtttatatacacacctcttaccaatttctactccatcatttttcacatatacgctatccatattctaaacggtagattttaaaagaattatataaaaaattaattttaaaaaatatattaatttgttttcaagtttatttagctaatacttaattaatcatgcgctaatgaatcactttgttttacgtgcggggagatgaagctccgaatctccacctctgaaagcagcctaagtttataaggtactataagttatacttactgtatttttaaaacaaatatacataaaatatatttttttcaaattaagtatttcataaaccattgacagtcgaagcatcaaaagtttgattaaatcttatccacaacaacagtatttgcgaccaggagtataattcgtgaaatgataatatggagtactccacttcttaatagtttctgaatacaaatataatttatatcagtctcagcgtaggagcagcattaaggatttttgcgtaaactatagcagtatttatgggtcttgtttgtaccccgttgcacatgcacacacgtggagggtcatacaggggttgatccaggaacaaaatattggggattcaattacacagtttttttaacctccagtcatttagggatctttagtttatcagtcatggtgaaaaaattaaaggaggtgttccgaggggtatctatgggtcttgtgggtccccctacacccacgttgaatccgcccctggagtcaaagaaccacagggtgtaaataaacatgaaaccacaaaaagaaactctgaactatgggctactgacagtttgccacaaaacccctgttgctaacattcgatacattaggatacttacagatctcacgcatcaatgttctcaattcaagtacctttattaatttattatttctcttagatcttgtttggtcaattcctttcacaagaaaatcgaaaggaaatttcatatacctggaactaatcccttttaattccctctaatttatttctcatggggattatctgaaaagccttttccttcattgacctggcaatgccatacaagcaatgatgaaagaacattaccaacaatctctgtgcgcgctgtgaaattattgataaatcctcagctaagtcatttaccgactccgacgaccaccttaatataccgcggccgcaacaactcgacgccaccacctcacaatcaaggtcgctaacgcaccggacaccgccgccacagcaccaccacctcatcaccgtagtcggcaccccacgcccgccaccaaagtcacggccacgggccctcgctacctcgcagccgccgccgctaccacacacaaggggaattaaactagggtgttcagctagagaaaacttatctacacgaaaagacaaaaatacctttccaccactctcaatacaggtggtaccatctcataaaaaaatatgtacctggaggtaccgtatgtttccaaccgttcgatcgggcaggatgaagggccgagattcggtaccgggagagctgctggatgggagcaaatattctttctagcaaaggagctagtattcagtagattaaccttactgcatttccaaaatacaacacatcaagttatgatagtcaggtaacacatatagatgcatgggaacacttaaccatcgttctggccttaagggacttcaacttcttcaatacccttcacatcaccacaaacagcgtaatttccctgcaataaaataacacaacatgacaatggtaccaaatagggaaccgaaaacatcaaatgaaacacttgacacagtaagtttgctagctatttgaactctttctttttcatctacttcgtcattgcagcatcgcataattgttgcaccgtttctgaatctagaccaacacactaaccatagcactgctggcagcatctgaagcatcctacacagataatgaaaacttatcgatttcgaaggtaaaaaaaaaaatcaaggtagagatatctcagtgttttttggacagtgaccagcacggattctcctctaagcttgacagcttcaaaccatccctgcatgtttagaactatgattaagtatacaaacttggcacatagcagaatgaaaaagtatgatgcttcaattaggaattccatcttacaggtattaacaaaagatcgatcaaatcaaaccattgtatatatgttcacccccatgataggcaaggaacccacgtgcttattgtttcaaaacaaaatatgcatgattttatgaacatgacaaaggaattacctgaaaacaccagcaaatgcaagtgcagtgtattctcataagctgagactgcatgcgacatctacagagtcaattacattttggtctcaatcacgtgcacgcagtgcttctacagctgcaaggctggtacttcctccatttcgcaatgtaagactttttagcattgcccatgttcatttagatattaatgaatctagacatatgtatgtgtttagattcattaacatctatatgtatgtgggcaatgctagaaaattttacattatgaaacggaggaagtccatacatagatggctaaaaaaagtattgttctaccataagaattcaacttttttaactgacaataaccggaaccatatctgaaatatgtcatacttggcactcaaacaattgttgataaaatcatagctgggaattctcaaaaaaattgtgggctagacttctagcagaaattgcaagatgaaaatatagaggtgtttaactaggggctgttcagattatagccaaaataaacattatcaaattttggcaatgctagaatgttggtaagttatcaatattgccaagtttttgcaggattccttatgtatttagcaatatttggtacaaaactaaatgtatgcacatctttggtaactttagaaaatttggtatggtttaaaatgtcatcaatctaaacaacccctagattcatcaacaaacctaattgaatcaagcttttcttttggtccattgattcaaagatccaacaaattttggtccattgatttaaaaacattagcatgatcactatttttttcaactttggagtagagcacagaaacttggtaacatggcagaacaagtactctgaaacaggtgaaatcacattgatagaataaaaggttgggggatacccagtacatcattggccttaatcaaatagtttggcagttgctggaacattcagtgcttctgcaaccattccaacaatctgagcaccctgaaaagtgaataaagaaagaataaacacatagaagtaatgcagtagatacactgcaaatgtttatttaccctaaaattgtgcatatggttaaactgggaatgtctctacaccatactatcgcacaggggtttaattcagtttggatcacatggattaaacagcttttggaatccggcaaagtacacatcatgattaatggaacaacactaatcaaataccaacgaagagtcagggtgacccttgttaaaaatatacatattgatttaatttattctataaataaatcataagattgaacatgtaaactagcataatcgtatcatacaatctatacatgtaaactaaaactagacagtacgtaaaacatgaatagattgaatatacgaaacagagtgaatgcgtaccgagggttttggatgttcaactacacagcaggaagaactcacggtaaggtgggagccggtttccaaatggtttacacaagagcccaacctcaccgatcaaaccgtcaaacctccaaatcccctagttaaggaatgggtaaggtggaagccaaacctgaagttgttcatataaggctcgatcactaggacggttattccttcagctgaaggtggttgtgatgcctagggtctaaaggcggatttaggcgcaactcaatttgttggaccatactattgatgctaaaaatacacactgacctgggagatctgcttagctccagtgcaggtccaaatcttgatgatatgcgagcgtgccagtcagtttgatcctgcaaccgacaagatatataatcaatagataaaacagctgatcggttgacaagccgatggaatagttctagccgataccgataccagccgatagcgatagggtttcgagtaatcggctatacgtccaatgtatataatgatataaagacaatcggccgataatcaatataattaaacaatataatccagtagaaaccagtcggctagaaatgatatgatagaataagcactgatccgaagattaaagcatacatcggctagaggtctgatgtcataaaatccacaagattggataaacagtgaaacctttgttgcaattagctaaatccaacttgtatgtaatgcttgtaagccgatgcaacatctagatacctcattggctgaaaccccgatgaaacccttattagcagtcaagaagcaggctagagattatggttctaaacacggtttagtagatcaaacttaactgatgcagcactaagtatgaaaagaaacataatatctagacaatcaagcccttgactaattaatttttaaggtggtagatgccttatctaatctaatctagtaaaacaatttagccgataccggcagaaaccctaaagcgagagacaaccgatagagctaaattgatatactaagaatagattaactaagacatatgataaaaaggcagacaaatatatcatccaaacctgagcaatccaagaggtcgaatgtattgatgcagccttgaacgacgccaacgtagacgatataattgtctaggccggcggaacatttgacctaccccttcgccggagatcgaaaagcgatgcagccccgcgttaggtgccaaatcccgtcggacgataaaataaaatagaaaaggtaaaaggtgacgatggcccgaattgtattgatcgtggagatctcttacaatgaccccatgtgtacatatttatacctatggggacatactagtacttgtaggacaataaagaaactttcctaaagataaaaggaaaacatataagtccttataggacattaaatacactttcctaaagatgaaaagaaaactaataaattatttctaattaatagataacttgtcatgccgcatccttcttgaactctgtcacttctggataagctttctttgatagattaattttcttaaccaaatatagcaggaatctgactattggtgatgtgataattcttttaggggcttaccaaatttcac

SEQ ID NO: 30228 - DNA, 635 bp, Oryza sativa
tgcagcggaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtac

SEQ ID NO: 30229 - DNA, 660 bp, Oryza sativa
tagttctcttgttaattaaatgtagaagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatggg

SEQ ID NO: 30230 - DNA, 541 bp, Oryza sativa
tgacggagcgtggggctcctcactgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctatgttctggtggatctgtgtgtgaaggaatccagcgagccggagagcgagagagagttcaggctctagaacccctttttcttctcttctcttctccccttctaggcctgggcctcctttttatctggtcaggggtcaccacatgggcctctagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggactggatctgaccgggactgacataccaactc

SEQ ID NO: 30231 - DNA, 11836 bp, Oryza sativa
  unsure (1)..(11836): unsure at all n locations
nnnnnnnnnnnnnnnnnnnnnnnnnnnnnnnnnnnnnnnnnnnnnnnnnnnnnnnnnnnccactcactcattctttatatgttccataactctgtgtttggtttgcttgtgtgctgatcagtagaatcgactggtttctcaacacgttatcagcacgagactctaccgagctaaaaaggtaaaaagaacatgtcggacatagcaaagaaggaattcgtcgagcttgccttggatggtagtaactacctcacttgggcattggacgttgagattaaactcgactacatgggtctcgatcatactattgtgctgcccgaagttggcacggtggagtctacgaaggccgagaaagcaaaggcatttcatttcttgcgccaccatctccacccagacctgaagtttgaatatatgaccgagaaagatccactggtattatggcaatccctgaaggatcgctttgaccagcaagggtcaattgtgctcccacaggcacaacatgactggatcaccctacgcttccaagacaacaagtctgtggcggcgtataactctgctctccataggatcatttctcagttgcgtttatgtggcctgaagatcactgacgctgagatgatcgagaaaaccttatctacctttcatcccaacaatataatgctgcaacagcaatacaggaactcaaagtacccgaagtcctctgatcttatctcagtcctgttagttgcagaaaggcagaatgaggttcttctaaagaatcattctgctcgacccactgggtctatggcagtgcctgaagcacatgccaatgttgttggaaactcgcgtggccataaaagaggccacggtgagaagaaagggaaaggtaagggaagtatcatattcaagggcaagagcaagggtaaaccctgaggtaaaggcgaactcaagaaggttacaggtgaatcatctggggtaaagcaggataactgctatagatgtggaggcagagggcattggtctcgtaactgccgtgtccccaagcacctggttgagctctaccaacaaagcatgaatgagaaaaagagccaacatgagtcccacttcaccattgagcctgaagctcagattgaaaagcatgatgacatgcttatcaatgttgaggatggtggggacgtccgtatggacgatgattgggacaaccttcttgaaaaagatgatgacatatttggagacctgaagtaatctcctatatgtcagtcatatgcagtgttctgcatgagtagcacatgtagaactttggtcatgaataatgctcctgaagagcatgcttagtcttttactgggcctgaagtccttgtaatgtttcccttaatagaatcaacttactccatgtttaatttcatttatgtttatgttctataaacagactttgtgggaatcccatggcagaagaggatatatgtctagtagatagtgccaccactaacacaatcttaagggaaactagatatttccacaccttaactaagaaaactggaaatattatgaccattgccggaaacaatgctcatatagtaggccctagaagtgctactcttgttctccctatagggacccataactttgtaaaggatgctctattgtatcctgattgaaagcgtaccctcttaagctttaaagatatccgtgcaaacggtttccatatagaaaccgagattgagcaagatgctgaatatctgctcataacaaaaatagatggatatcaaaagcaagtggtggaaaggctcccttcatcaccatcaggtttgtactacacgtacataaagcccactgaggaatatgttgcgatgaaaaccatatttagaaacccagagtcatttagagtttggcatgacaggctgggtcatcttgggtttggtatgatgaggagaatcatcaacaattctgctagccacaatgttgaaactaatgacttccctaatcctgaagattttatttgccctgcttgtgcaaaagggaagtactaggccatccctcctgaagattagggatgagtcacctgttttcctggcaaggatacagggtgacatatatggacctatccagcccttgtcgggcccgtttagatatttcatggtactgattgatgcttctaccaggtggagccatgtggatctgttgtccacaaggaaccatgctttttcaaagctaattgcccaaatcatcaggctaaaagctagcttccctgatagccgcgtacaatccattcgaatggataatgctggtgagttcaggtcgaaggcttttgatgattattgtttagccatgggcattaaggtagaatattcagtaccacatgtccacactcaaaatggcctagctgagtccttgatcaagaggatcaagttgattgcacggccactgttgcaggattgtaggctaccaaccagttgttggggccatactgtgttgcatgcggcaacactaatccaactcaagccaactgcatatcatagtacatccccccttcagctagtgcgtggaaaagaaccaagtatttcccatctgcgtaatcccaccaccacagcgtacttctatgggaccccaccggaagttggggatatacgttggttatgagactttgtccataatcaagtatcttgagcctatgactagggatcttcatacggctcggtacgctgtttgtatctttgatgaggactattttcccagcattagggggagaaaggcatccagaagaatgccgagatataatatggaatgcaactgggatgcagtccttagatccacgcaatagtgaagctgaactggaagttcagagaatcataaatttgcaaaatcttgcaaataagttgctagatgccttcactgattacaagggaatgacaaggtcgcatatacctgcagtaaatgcgccggaaagagtagaagtaacccagaaggttactgactctgctcttaccccccatcctaggaagagggggagatctccgggtgttcaggacaaggttccgcggagacgtccgcggagacaaggacctgagccacttgttccactcaaagaatcagttgaagaagctcaacctgaagttgagaaagccccagaagaggcaactcaacctgaagttgagatggtcccagaaggacaccatcctgaagatggagaacccagtgctttacgcgcgaaccttggcactggaagatcggaacaccccaactcagtcgttatggcaaatcacgacgagctggaggaaataaatgaggagatttccactaactatgctgatataggagagtaacatcatagaaagaccactattgtcgacattcactttgcctcaaagattgctgttataatggatccagatccagaaccaatgtccatgattgagtgccagaagcactcagattgggacaaatggaaagcagcaatagaggcagagttgcgctcgctttataaaagagaggtttttgggcctacagtcccaacacctcaaagagtcatccctgtaggatgcaaatgggttgtcctccggaagaggaatggccaggtggtgaggtataaagcgaggctagtggcacaagggttcacacagagacccggtattgactaagatgaaactcactctcctgtgatgagtggaatcatgtttcgatacttaatctcaatggcaactaatatgaacttggatatgtagttgatggatgtagtgaccgcatacttgtatgggtcactagattcggaaatttatatgagggtccctgaaggactcaagattccgaatctgaaaggaaatcgcaacatgtatagtgttcgcctgcagtgatcattatacggattgaaacaatccggaaggatgtggttcaatcgattaagtaactatctcctgaagagaggttacttaaaccatgatgattgtccctgtgtgttcataaagaaatccctgaatggatcttgtatcatcttggtctatgtcgatgatcttgatatcattggcaccacagaggacattaaagaagcaatggcttattttaagaccgagtttgagatgaaggacttgtggaaaactaagttctgtttggacctacagctcgagcacctccctgaaggagtgttcatgcaccagtctacctataccaagagggtccttggtaagttcaatatgaataaatgtcatccgttgaaaacccccatggtggtccaatccctggaagcggataaggacccatttaaacccaaggaagatgatgaggaagtgttgggacctgaagttccctacttaagcgccattggagcactaatgtatctagccaattgcacgagacctgatattgtttttgcagttaatctattggctagatatagtgcaaccccaaccagaagacattgggttggcgtcaaaactatcctcacgtaccttcgaggtactcaagatcttgggttgtggttcccgaagaaccaagatccatccatggtgggatatgttaatgctggccatatgtctgatcctcataatgccagatcctagactgggtttgtatttctttgtggtaatactgccatttcctagcgatctgtaaagcataccctggttgcaacgtcaaccaaccacttagaagtaattgctctatatgaggccacacgagaatgtgtgtggcttagtcggatgatcggtcacatccagaagtcatgtggcctaaacattgataacacccccaccattatctatgaggataatgctgcttgtgttgcacaaatacatatgggctatgtgaaaagcaatttcacaaagcatattgctcccaaattcttttatcctcacaagctccagaagagcggggaaataaatgtcttgcaaactaagtcatgcgaaaatctcgtagatttatttataaagtctctgccagcatgtcacgcccggaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaataacgatctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaaacatttaagagaagtaaaacagtggagtaattaatcagaaattttaatcaacactcagcaacacacccatgctgcacaggcccaaccatcctgaacaaccatacccggctgtacagatctaactccaaaccaggagctaagcagattattaccagttataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacagtaccctttgcacaacacaactcaaaacagtgcaccgttcctggatcataatctccccctcaaaaccagaggcaatggactccccagcgacccccacggacttctcgccgcttcacagtctagcacactatgatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccagattttatttatcaattaattaacatcacacgattaaccatcgtgagcgaccattaaatataaccataattaaaataatataatatagtttataattatcccctttagttagctaatgtttctaagcatagctaagcacacatacatatagcatttagctgaaccaatccaatatataaggttcatgctactcaaattataacccataggaaaataaagtcatcttaggccattaattaacggggaaaggttcaccacccaatgacattcgaaaataatgcatagttgaaataaaataatagctttaaacgggttcaacatgctcaaagggttatttgggatctgtgtgacttgccttgcaataatcggtcttcaattaatcttcttgaatacttccggcgcattcacgaaccttcgcaacgatggaaacgacaagctaacacgcaaaacgaagaaaaagactaataaaaaccaaataaacaatacaaaaacaagcataaacagtacatgtggatatttttaacatgtagatcttgattttagaaaaatttagcaacttgaaccacctgaaacggatctacggttatttagttatgattttccgaagatttaatctattagaaaaaaaaactggaaaaggggaagatgataatgtcatgatgacgtcatcaatggcggccggctcggatggcgacctcgccggagctagagtgatcggccgggattttggaggacatgtacacgtagaggacgacgagacgaacccaacgatactcaccctcgtgccaaacgacgaccgacgacggccggcgacgaggaggcgacggcggcggctcgggttggccggtggggacgggctacggcggccggcggcgaaggagaggcggcggccgagcttctccacctcttggcgaaaccaacggcggcgacggcaagcgacggcgacgacggaggcggcgtggcggcgcaaccggagttcggccggcggcggcagcggatggtttcacgcggcgacggctctacgggtcacgggagaggacgggagagggggcaaacgaaaaagaaggactagggggtcctatttatagccttggattgaagagatcggactcctcccgcaagaaaatcgactcgggaaatcaaaaactcggttttggagataaactcggaaacgagttcgattcgggcaagatactcaacgatttgctccgatttttgggggtaaagatagaggaggatgagaggataaaaactcctcaaacaatcggaagaaaaagggccggattgggtgcggatttggaggggaaaaggggcggctcgagctagcaaggccggccggccggaggtaggagaagggcccgacatgtgggccccacatgtcggtgtcccatgagaggaggggcggccggctcggcttgagccgactcgggcggccttgggccggctccggcgtgcggaagagagaggaatgttgggccgaattcggcccaacggcttagggaggggtttttgaactttttaattaaaataatttgtgaaatgttgtttcaattattaaaaatacttcccttgctcaaataattcccagaaaaatctagaaaatagaggaacaagcaaagtatttaataaaattttatctagctcatttttatgttgaaaattttcctagattattagagtttaacttgtaggcttttaaaataaattctaataattccaattaaacaacaatttatatatttaggatttttagggcgtgacacatcatcaagcttttacaaatgtgttcatgacatcggcatgagacgactttgtgaattgcaaggattagagggagcaaacaattagcccatgattgtgatcctgaagaatcacaaacaagtcctgaagacttgatcaactgttgtactctttttcccttggtgagtttttttttcccattaggtttttctcacacaaggtttttaacgaggcaacaggtgcaacacaatatctagagtgccatgtactcttttctcctaccattttttcccactgggtttttgggaggagtttttaatgaggcatgcgcataattcaaattcgtccaagggggagtgttatgaaacctatcttattatagacaaattaaattatgattgggaagcttactacaaaagaaagcttacgccagaagccagcttacagaggaagccagcttatggcgcaagccagcttacacgagaagccagcttacgctgtaagccggcttatgatgcaagccagaaggttcaaggcttacgatgcaagcctctaccctcctccgcctataaatagggcccagaaggtccaaggcggggataaccgatcttcggtctactgcttcttcttttgtagcttgtactcaaatccagaagaaataaagcttccgctcgcttattatttctgtgttccataactctgcgtttggtttgcttgtgtgctgatcagtagaatcgactggtttctcaacattgtcaaatctgaaccttccgataatatttccaattttaatacttcaattggtaaagtcctttataattttattttccttaaccatcagacaaacggatgatctctacattcgtgggcaccgtcctggttctgggttttacggaagtaaacaatcgcgtaggccgcacgacacttcaagatagggtgcggcgcactgcggccaccgtcgatgcagatgatttggccggtgatgtatgccgctgctggcatacacaggaacgccaccagcgaccagacctcctccggcttgcctgcacgccgcatcggtgttcgtgcgatttcctcctgtacgaaatccggcgaagtcacgccttgaatatgaggattgttgccgctcttgcactgtagtagagagcatttatattcaatgggagatgaaacaaaaacgaaataattaggctcgattgcatatatagttccgataattccaatggtaaaaaactggttcaattcattgccacccgggtaaaaaagtgtgtaaattactggagcgtgtttcatatatatacatatatggctatcaattgtgcattattctttaggatatatagttcggataaactattcttcttgagtgaaaaaataacttctatctatctatctatttccatctatctatctatctatctatctattattcttcttgagtgaaaaaataacttctaaaagcactccgaaacagccatgtggcactctaattaatcagtggacccactattttaggttttcatctattagatttacacttatatgatcgacccgacattatatgtcattagatctatttttcaaaaaaaaaaaaagaaaatcacatcccctcccgtgtcgcttatgtacgtgtccgtgtacgccctccccctttttatttttgaccgggtgtacgccctcccctttgttccttttctctcctatttttatgctattttagttagatggaaatcacaattatttataatatgtttttagaaaataaaactaaatcattgtcctatacatgtatgtcgacgtttgatgtcgtgattccggtatttgcatagtatggagatcgttgatactagtatatacgcgagacttaggtaaaagacacagagacgaggatttttatacaggttcgggcccttgaattgtcaggtaataaccctacatcctgttggccgaagccggtcgttgctcttatttatcataatcacaccagtacaatatttggggtagcctatctaactgttgtcgacatggcggtctgaaggtctaactcgtagtcgataacagggtagccttcctcctcgaatccacatccggcgagatcagagacaacgctatatctctcctgacggtatccataggcaccgtaggggactagccatgcctatctctgaagtcgatatccggcgtcttgtcttggcgtatgttggcttgtatgttgatctattgtttcgtgtcccctctcctcctagggggtcttgtatttatacccataggtgttcccttgtccaagtagaactatggaaaccaatatggatacaatccgagtagtccttgtcgtttccatgtagaactctattcatcctttcttatgcggaactcctcctatatccgaaagttgtttccgtataagacatgatatgtggtgggttctgccgagatttagcccataaccctgacaacgtacttatagtacgccctcctccccatgttccttggcaggtgtccaccctcctttttttaattatattatttaaattcaaattagaccaaacatttttgaccattaaattattagttttcactattagatcttatcttcgagaaaagaaatatgtatgtttctctctccctgtgcacgtatttaagtttcaaaaagacaaaaaaaaatcatcacttccatctcaggagggatcccatctccctgctgtctctcctttttctcttctattctttagctatcaaccaaatatataaaaaaaaatactcccaccatattatgacgccgttgtctttttatcaatgtttgactattcgtcttattcaaaatttttgtacaaatataaaattatttatgtcatgcttaaagaacatttgatgataaatcaaatcacaataaaataaatgataattacataatttttgaataagaggaatagttaaacgttggtcaaagagttaatggctttatacattaaaatacggagggagtaataattagatagataaacaatcataactctcgagtacatatccaatttttaatttgtttaaactattatttatttaaatgttatcatatgtttctctacaaaaattataatacgtcacctggatatggcgaacccaagaaaagaattatcagggcatcgcatggatatatgccctttctttcagtggcgaggctagcaaaaaattatcagggtactacacatataaattatgcaattgttgattgctatatattgattaatatgaaatgaatatagctagaatcgaataatctacccaggaaggtgaatgtagttaggccaatgtatcttttgcatatcaatcaaacaaaaaaaagctattataaaaaaatgtacatatattttgtcatcttaaaccatttaacgaacatactccgtgaataaattttcatataaaagaaacattaaaaataaaataaacatgtattatgtgatcttaagttattccacaaaattgcatagctatatcagattgacggcgttaaaataaaaattataattgcaaccatgaaaataaatttatgcataaatttaatttatctagggaccacactcctacactttgaatgtaatccaaattgtcatacaaaattgtaaaataatttaacaacatataaattactttgcaagcatgcatagaaaaaatagatatataatatgtaagtgaaaagaaaaaaattaactatgaataacataaaaattataaaaaaaattgtacctttagttggatgcaacaatatctaattaattatgtcttttgaaatatgctcaaccgacgagataaattaaatcggttgatttgtacgtaagcgttctaaaatatagtatacattaccatttaatggacttagaggtaaaaaaacaaaagaatattactatggcttccatatcttttagatataaagataaattagtctattttatatgcgtagaccgttaaaaatgtgaatactcctatatatgaatattaataggctacgagcatgtccgttgttcgtacgcatgcataaccaactttaaaatccatttcgattttctgatataatttactatgtatgaatattaatattatttagattgactatagtttttctttaaactattgtatgggtctcacgtatcatagagaaacaatgttt

SEQ ID NO: 30232 - DNA, 36227 bp, Oryza sativa
  unsure (1)..(36227): unsure at all n locations
caaatcatatacatttgtcagtagtaaaagtttggcgaggtttcttaagaaaatagaaacaatggatcgaacgtatgttattatatattaaaagcacgttaaacttcctacaaacgctcttaaaccgccacgtgtgactcctacaaacgttcctaagtcaccacgtggcgctctaataaattagaggaatttctaataattcttagaaaaagaaaaacatctaacaattgattttactttaaactcagttgttggtgatatgggtgcgggggtattacgtttagagggaggaggccgcccccaaacccacgtggcaccccccgaggggggtcgagccccgggtgcagcggcggctacctcctcatagcttggggtcgggctgccccgaacccacgtggctccctaggaggggggtcgagcccggggtggagcggcggctgccccctcccagcttggggtcgggccgccccgaaccccatgtggctccctccgaggggggtcgagcctgggccgcagcggcagctgccccctcacagcttggggtcgggccgtccccaaacccacgtggctccccccgaggggggtcgagcccggggtggagcggcggccgccccctcccagcttggggtcgggctgccccgactccctccacgtatcagcccacgtgtacagggttcggtgggtgtgcctaacgcccaccttactgcatttaaagcggtccatgcagccgcgccatgccgcatttaatgcggcgtgctgcgcatctgactggtctgtgatcggtcgaatgaccgatgggacggcgactgtgtacccccgccctgtcagtgtgtcaagtggtgtgcgtcgtgctccgtcccatcccatcataatgatgaggggcttcacagcctcttattgcggtcagagctggtccaaccactctgaactgacccgggttcccgtttcctggtgcaaacgggaacccggaagtcctcatccattaaacggtgaatgacaagggtgccccgcatgatttgatgggccccgcacagcagccgacgtgtagatagcttctgggctaaggcacaagacatgtaattaatatagagaatattttcccttctccctaggtagcactcacagcacatgtggtatccccttagaaaataaaaggaggaccatgcctagcgggaaagggggatcgaactctggatcctaagccaaagcttgtctagccctagcttgtacaccagggattcagagactttctaagcacagaagaatcatcatacacacaggagtagagtgttacgcttcatagcagctcgaacctgtataatccctctctcccttcctctctgatctacatctcgtgggcctagctcccgcaaattcaccgcggttgcgtcgaaagagactcctcaggatttcatccgctcccccggccgaactcacaaaggggggcctcacagcctcccgctagagagcatcacccctcgacatcagtggacccactattttcgaccattagatttgctaacaaaaagtaaaagcccctaaggcccataggggctgtccatatcgtttacgcgtatggtgcatgtacatacgctacatcctcccctcttattcaagctcccctccactgtatagaaaatatattttgtgataatctaaatcatagagctaatattttacgtacatcattagattatttattacaaaatttataattcaagacccaaaccattggatttatctcaaaggaaacagacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccagccgggactaaagatcgagctgaccttttttttttttgcatgcccctgttgctgcatggtttatatatatatatataaaccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaacctttcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctatgttgtatggcaacagtatgaacgtcttgtaatgctgcgccttcagaagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacatatagtaagaaatctaactgaacgatatacttacaaaatccagcaactcataatagagacgtcgagggcgtccagctggtatagttcgtagattcccctaaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtttcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctagaatcggcctgcagtggtaagtacctgaagggtccgttgggatggccatgcccgacgccaccttcatgttgtgagagattatttgttagtaatcaacatatataagcagcaactagcggaatggctaaatcttacctttattgataagttcttgaagggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactaccctcttcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaaatctaattacaaataaaataatcttatattaaaactcaaataatattacatgctaagactaaaatagtcatgtacatgctaagtgtttcgtgcgtatatgctaagtcacgagacatttatgttttaacaatctaagtgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaaccttatatgataagtctaattacaggtctaataatcttaattaattgcattacaaatataacaatcatttatattattacgtcacttgcctgctccaattccttatagggctagctcttccactcaggcttgacggacgactccgacaacacgtcttttctgcaagatacaaaaaaatgtattaggataaatgcgaagtaacatatatacatatatatacatatatatacatatatatatacatatatatatatatatatacatatatatatattgcatttcacgttaacgttcgtcctcgttcgttcgctcgttcacgttccctagctcgttcacgttcgttcgctcgttctcattcacgttcgttccctcgttctcgcttgtcttcgttcgatcgttctcgttctcgctctcgttcgttcgatcgttctcgttctagtaacaaaatgtcgcggcaacgtacgttgacgtgttcgttctcgctctcgttcgttcgatcgttctcgttctcgttcgttaacagcggtgtgccggcatcgggcggcgggttggcacgccggcgtgtcnacgacgctgtcggcgtggcgttgtgggnccgtgacgccgccggcgtggcgtgacggcggtggcgtggcgtggcgtgccggcgacggcgtggcgtgtcggcgtcgacattgcgcgcgcggcggtgaagacggcgccggcgtggcgacgtcggcggcggcgtggcgttggcatcaggcggcggcgttgcgcggcgtcgaaggcggcggcgtggcgcgtcgtcgtcgtggcgcggcgtctcgtggcgggcggcgcgacggagagagatcgagatcggagagatcgagatgcatgaagggagttctggcggcggcggctctcaccccaaacatttgccgacaccttaggaggcggcgaggactacgagctctagacaccggcgagatacgtcggcgtcggcgcgggtatttgccctaggcagtgtcggcgaaggagagagtccaagagagatcgatcggccgaaaacgtctaagtgttggtgaagaagacgagggcgcaccgggaatatatatacccccggatctttagtcccggttgttctcaacaaccgggagtaaatatcttttcccgctatttcgaaattctttttaaacccggttagggttaagaaccgggactaaagtggctctattgggaaaaagtggctctattccagccactgccccttcacgccagccatccctatccatttcctcgcctcatctcttcctcgcgtcgtctctctctcgctcctcacaaccccgcgccctcgccgccgccctgcgttagcccccaccgcagctacgcgctagctagtcctctgcccgccgcttggttcgccggtgtcgtgcaagccgacgccgctcgcgcaagcctcacgaatcgcgcatcagcaatggcgggtggaaatcctcacgatttcttctccagtcgttcaatgaagctccaacgggccacatggacggctccgactacggcttctcgcaggggtcttcaggatatggtggatctggcaccggcatccattttgggggagggggatcggggggcctcgatctgaactcccaggccgacgccttccccgatttcgcctcctaccaacagatccttgaaccgggtagccttgtgttacctccgattcgggcagggagcagatccacagtccccccgtcacgtcctcctccagcggcgggagggggacgtggcagaagtcgtggagggagaggaggaggacgaggccgtggcatgtcgttgaccaatggcgctggatctggcaggggaatgcgaggatttgttcctcctggctcatcgtctggccaaggaggcgtccgaggtcatggggcatccatgtcgcacagcgggccacccgccttcaactttggagtcttcggaggaggacggcgagccggtgcctcgtcgtcccaagggacaaatgtgtccgaggacgacggcaacgaagaagacgaagaggactttggtcctgatggtcagcacatggtaaaccccccatggttactttctgttatgtttgatttgtgctattgcgaaatatgccaattgttgctcatgatattgatactgctatgcatgccgtgatctaagcatgtatatgttgttttacagtatatgttgttcattggttaatttagggttaaatcatgtttttctttcctagaatacgtatgacaaggcaaattggacagaagaaaaaacttacacattgtgtgaaatagcatgtgaggaaataagggatgggcattgtcctaatggagcatggacaactagagggtaccagaatttgaaggccaaatatttccaaagggctaacctaaggcattcaaccaaacagataaagaatagattcacccatctaaagaattattacattgcttgggtgtggctgaaccaacaaactggagctggtagaagtgctagtgaagaaataattgcatcaaatgcttggtgggaaaaaaaaattaaggtatgcagttgtcaaaaatttagctagtttacatgattttagagttttctgtgatattgatttagtgtcaatacaggagaagggggacgccaagaaatttcgccatggcaaccctgagtacttagattttcttatagagatatttcaaggagttgcagttgatggttccacagcatacatccctggttttgaagatgaagatgaagaggaaggagaagaagaagcaggggatgcaggggaggcagctagaggggaaagagctgtaggggatggttatgagaacagccccatgagcactaacagcaggaagagagggagtagcagctgtaatgtgtccacagcttctagtcctgggaaaaaaagcaagagcccagtggtgaagctcatgcaggggctgctcaattctttcaactttgattgtgataagtcaaataccctaattactgaacttgttaacagcaagaagttaaaggagcagaagaaagaagaaattgttagttcattgacaaactgtcagaggttgncagtagagtgtggtgcacaagaagaaagtgtgcaatacttttgtgccacacagttgtttgcttccaaacataacagagttatgtttaagaacattagcactaaagaagcaagatttatgtggctgaggagatggtgccagcagaagaatttgtattagatgatccctttctttagctgcatatcatgggtctggtctgcattagttgtgtcttagctgcattagttatgatctacttttgtgttgaactatcaacttgtttgatgtgatgtgacgtaatgaacatgtgatgtgtggacctatttaaaccttcccttcttttcttcttgaagtttgttcatattatatttatgatgtgctttctttctatgcatatgtcactcctgcaggatggtgaaggcagtggtgatgaagatatctctgatgaagatagcagtgatgatgaaattgatcttatcatttatattttgaagaaaagagaaatggacaggagaagagcatgtatgcttgccgccatgattggtacgtattacttggaactttactctaataaggctccaagaagggtagcacctgagtctggacatgattgggttatgagaacattagctaatagaactgtttgttacaacatgtttaggatgcacaggccagtttttgagaggttacattctgtgcttgtggaatcatatgagttgaagtccacaaacaacatggattccatggagtgtttgggtctttttttatggatagtaggtgctccccaatcagttaggcaagcccaagacagatttgttaggtctcttaaaacagtacatagtaagttcaaagcagttttgaccgctctactgaaacttgcacaagatatcattaggccaaaagatcccttattcacaacagtccataagaaattgctttctcctcagtacacaccatatttggataattgcattggagcaatagatggtactcacatccaagttgtggtgccaaattcagctgctgttcaacataggaatagacatgaggagaagagtcagaatgttatgtgtgtctgtgacttcgatatgagatttactttcgtgcttgctgggtggcctggttcggttcatgacatgagggtattcaatgatgcacaaactagatttagtgccaagtttccaaagctacctctaggaaagttttatctcgtagactcgggatacccaaataggccgggttatttagcaccatacaagggtataacatatcatttccaagagtacaacgaaagcacattgccaaggggaagaagggagcactttaattactgccattcttcgtgtcggaatgtcattgagaggtcatttggggtcttgaagaacaagtggaggattttgtttagtttaccaagctactcgcaggaaaagcaaagcagaattatccatgcatgagcacttcataatttcattagagacagttaaatggctgatacagagttcgacaattgtgaccatgatgaaaattatgatccattgggtggaacctcttctccatctagcgaaccaacaaacgaattggactcgcgtgtcatgaaccaatttcgggactggattgccgatggattgtggtatttgaaaggaatgtaatgaatggttcaatttttcttgtgaattgtatttggtttaacttgtcaattgaaccatgagtgcttgtaatttgtaacattgaaacttctgtgatgtatttcaacaacttgagatgtatatgagcttctttgaatttctgtgattgggctgtgatattgatgatgaaattgagcgtctcgtggcgggcggcgtctcgtggcggcgaaggggagaggccgagagagatcgatcggccgaaaacgtctaagtgttggtgaagaagacgagggcgcaccgggaatatatatacccccggatctttactcccggttgttctcaacaaccgggactaaagatatcattagtcccggttgttgagaacaaccgggagtaaagaaaatatctttactcccggttggtgacaacaaccgggactaaggattatagcactgcatatgattttcgcttacatatgtgtttataaaatagaagttaatgcattaacattatttaaagttcaaagattaatgacaattacttcgaaaaattatttttgtctgtaataaattaagtggataaatcgtaataagcaaatatatgacttataattaataaaaattccaatatatatatatacttagcatatatatgaatgatattattatattggtaaaaactctagtcaattataattagcatatgaatgctagtaaattaaatgttaaaaactctaattaacatacatatgaaattgccacctgtgtgatttaaaacttttaaaaattgtaagtatcacatataactagcatatacatgatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaattggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccactttattctgaagggtttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaattgcttcctttctcctttggttccgggtgaaggtcgccgcgttgttccatatgcttcagatcattacgtgcttccagtgtatctttcgactttccgtatacacctaggaagccaagaaggtttacgcaaaggtttttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcactcgtaggttaaactcctcctgtttgtcctcgaccgacacggggacaccttccttcttccacaactgtttaagatctttgaccagtggtcttaggtacacgtccatgtcgataccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcatcctttccaaattctttaaattttctgtcgatgtttcgccactgcgaaccatcggcggggtgtctcagcatcccgtcctgttgacgctcttcagcgtgccatcgcaacattctagcattctccttgttcctgaacaaacgccttagccgcggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccccggaagaatgttcttgacgagtttcaataaatcgccaaatgccttgtcactaaccccattttttgccttccattgcaacaactccagagtggtatccaactttttgtgcccctactcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccatttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaataaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccatctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaacattggaggatgaagttgcaaaccttttaggcacctccgatttgtatataatcaccaaaataaattcaatagaaattttggcatgacctcccctcttttttgaagtaattttgaagcttgctcgggcagctggaggaggaagaagacatatatatatataggggtgggactttagtcccggttggtagcaccaaccgggactaaagatcccgggggggcctgacaggtcctgacagcattcgaaccgggactaaagatgatgtttagtcccggttggtaacacaaaccgggactaaagatcaaatatgcccgtttcccttttgaaccgggactaaagatcatctttaccccggtttttattgcatccgggactattgtggaaatcggccgaccgacgaaagatggtttctccaccagtgagaattcctcccctcctcatgtcgtacgtacatgtgcatgtctcccgaaagaaaaatcaggatatatctactctatattcattgatgcatatgtaaatatgtataacaaattacgttaatatgaaccaattaaaaggagggctagcttgatggtacattattaacaataataatttttcgagatttattaaaaaaattgccccaaaacattcaattaaaaaagaaaaacacattaccttttaatttgaacttaatttgttacacatgttttctaaacgaactaagtctatctccattttaaatggtgaagaagaaaatgataattacgtatactgatgcattaaatattacatagtagaaaggtaacagatacctaacaaaatttatttaagcaaagtcggcagataaatttatgaagaaaacatatttctgaagtttggcaagtatggttgacattcattcctggtaagtttttcaaatatagcctacgatatacatgcccgcacaaatgtgcgggctaccatcctagttatatataaaagtagaaggaccattatcttagaatttcgatgtggaaatgaagaatataaaactgggaaataaatatatatagtaattgaacagcttatttggcatagctctagatctcacattcacggtacacttttagtttgtatgttaaaatatttaggtttgaaattttaaatttttattaattaaaatgagaataaattgattatccaaatattatcaaaataatcgtagatctggatttataaattagatttatagaattagaaataaccaagttaagaaaatcttgaatgcagagctgtgccaaaactaacctaattgtgacggaaaaaagacacccgcctttgtaacagaattggtgtacatatgtgggagtattaattcaacgtacatcatcaacaaggtgtgtagcgatgacgcctggcgcgatgcagttcacacgcatcctgtcgctcgcccattcaacagctaggctcttggtaatttaatttgattcatcgcttctgagattagtaagggtattatcttgcgattaattctaactaacattagtggagaatcgatctttactcgatcgaccaaaatcggtactaaaacctttataaccagacaataagaccaatgtactaattaagtacaaaccaaaatcacaaacgagaataattattttctaattacactcaaggaatttatgaatggcaaaatatccagtgcacacaaatttctcgtgctgcctctaactaacaaaattgaccaaaagacgtcataacaagccatatcttcgtatgtctactactgtgtcttaattaattagttatatcgaacctatttgtatttactgagcttttttgtataatatatatagtcaattttatttgttgtttttttattgtttgtatgggtctggatatgtctagtgtaattctgtataagccaaaatatagttaatatggttaacttgttaatttaatcaacaatgaatacatatatcatggtaaaatctaaaccgagaagcctctcggtttagtgctaaccagcgacgatccaattgtgagaagaattactgctacacgtgctgatgtgcgtgttgtttttcctcttagacatgtgtgtctttttcttccttcttataaagttttctcttaaattacttatccgatttacaatccaattacaccattgtgttcgttacaattaaatcttcacaacaagatcttacatgattatattacgatgaaaaaatatttatatttgtaaattacttttattatatactaagttacttttataatatatataagttacttttagatttgactaaattacttatatacatttataatgctctaagttaattattcttattattgtttttagttaattctatattttgtggactttataaatcttctctacactttacttgcaaattcactctacatagtttcttatttcagctcactcacaatataattatttctactacagagagttactccccccgtttcataatgtaagtcattttagtgttgcccacatttatatagatgttaatgaatctagatatagttctaaattaaagttactttctttttgttataagttacttctataatatatgtaaattagttttaagctttactgaatttacttttatatgtctaagaagtaacttagtgaaatctaaaagtaatttagacatatcataaaagtaatttgtgattcttcatgaaaatataatcatgtgagatcttgttgtaaagatttaattgttacgaacacaacggtgtaatcggattataaatcggatgagtaatttaagagaaacttctctaagaggaaaaaaaatacataaatattgagtgaactagtagcttttttttttttggaaagaatggtgtctctttttagcactatccagctagcactctcggtgtagttgtgtccatatatcatttagaaggtataatagttttgaaaatatgttaggcaataatggttacatttcagaatctaaacagcatcagctaaacaaaaggaaggaaagagcttatagtagaagagagaagtagagtgactatacgtaatagggaaacgtaactatacgtaagtacgtcaagtatgtgcaaggaaatgagactggtacatacgttaggtaggtgggatgggaggtggtgctgtgggttttgttttttccattgcaagattaatcctatggcctacaattgcagatgttctattttattttttcaaaatttctcgaatttatctaatctattagatcgccagatgacgacctatgagcatctgtaagatgtttaatctattttgctatagatagaagatgacgggagctgatgctttatcctcccttgcacacgcacttctaatattaccagagtttcaacttccttgaaaaaaataaaaaaaaaatctaaactattaattggtgcgcacagtgaatacgttctaaattttgtgctctttttagttaccttttgctgcacagaaagcacaaatgggaagagatgggaacccggtaacagttgatatgccggagatgttgacgacgttgcccttgccggaggtcttgaggagagggtgcatcagctggcttaggtggaagcatgactctaggttgcccgccatcactctggagagctcctccggcgtcacgttcacggctggttttaggaagaggaagccaacattgttcacctgcaggtaagttaacaaattataagtcatctaataaccattttctgtatctctacccaacttctacacctctttatagcattgagagaaatagattaagaaaatgttcaagagatggatctgcaaccaagaaccaagtgtactagctccttgtcgcgatctggcagacacgccgccacaagctagcacatgcacacatgtgaaggttcttgcattttgtaagggaaaaaaatggagatcaaggctaggtcgtcagtttgtcgtggtttggtgtatgcgtacaaggatgtcgagcttgccgtcgaacatggcggtgaccctgccggcgagcgcctccctgtcggcgcgggctgacacgtcgcagacggaggaggtgatggagagcttcttggcgctccactcctccaggcagctgttcagggtagcctcgttccgggcgcacgtgtgcaccgtcgcgccgaagctcgccaactcctccacgatggctcgcctggatgatgcatatataaatgcttaatttctgccactaagctagtagtaatgtgccgaagcaacgatatgatcaaactgacgatgaacagacaggaggtcagaaattaaggcacacaagctagtactgattcttttttttttgagggaaactacggcgggtgtttaacaccagcctgaagctagtactgattctagagaggctatatagtctattggtgccgatttcggtgcgattagaactaatgaccggatagacactaatcagaaaagtcattggtgttgtttctagctagggtagcgctggtagcctcatagacgtccatgctaggccagaacatggtgatgaccgggttgcgcatataattaagaacgtaatctaaagagcttgaattggttggagagctagctgtatttgggattttgggatgaggtcctcgagcgccttaatttgtttcctcttctcaaacagatgtgaaaactacgtggaccttggattcgatgaagggatgaatattatttagttacccgattcctttgctgccgccggtgacgagagctgtggcgccggcgaggctccaccgcccggtctcctgcgcgctgctgctggatgccatcatctcttggggttggtgtgtgagggagacaatagagtggagtacttgagtactacttgtatgggcataaagcgtttgacgccatatatctgcacaatattttgggtgcttgtttagccgcaagcccgcaaggcccgcaaccgcttgccaagcccccttccttgtgtccacctcatgtctcttctcgtcatctctatctcttcttgtcatctaattagactcgtttagcaaggacatactttctattatttatacaaggatttccaaaaaaaaaagtcttatctcatcgtatccacggtagagacgtagattaccttctaattgtaaaatgactagaaaaaaaataaatgtgcgttataataggtgaagatatttttcacgattgataaaaactttgccaatagaaacgctaaactgaaataagacaaacaaaacaatgggaaaaaaagttagaaatcacatataacattgtacccggttgcgaagtgagcatagctcaactggttaggttccttgtggtggaaccagcccacccgggttcaaatcctagatttgacacgggtgctcgcatttacggctaattattctttcagtggtaggcgatgtacccgtcgacagcgaggcgcctgtggtgacttcgtcaatctcaaaatatgccgacccagtcttccggaggtgctcatagtgatagggtgtgcgtgtgtgcgttcataggggtgagtgtgctcgaggcgcctgtggtgacttcgtcaatctcaagatatgccggcccagtcttccggaggtgctcatagtgatagggtgtgcgtgtgtgcgttcataggggtgagtgtgctgccggcccagtcttccggaggtgctcataggggtagggtgtgcgtgtgtgccttcataggggtgagcgtgcgcacgttgtgagcgcctgtgtttgatagggtgtgcgtgtgtgcgttcataggggtgagtgtgctcgaggcgcctgtggtgacttcgtcaatctcaagatatgccggcccagtcttccggaggtgctcatagtgatagggtgtgcgtgtgtgcgttcataggggtgagtgtgctgccggcccagtcttccggaggtgctcataggggtagggtgtgcgtgtgtgccttcataggggtgagcgtgcgcacgttgtgagcgcctgtgtttgtactgtgtttctcaaaaaaacattgtacccggttgcactcgcttcatgcgtcatcccacacgaataatctcttatatacaccattccatagcctcataaatcgatcgggtggctatgccataggttaatgcatatggattttgctatacctcaccgactaatgattgaactttttaattattcaattagtgaaaggtttttttaccatagatagaaaacttctacatggtaacaaacttgccgcatatcaattgtaatttcaaaaggaaaatatttatgagagaaatttggaaaaataaaagaaaaggaaaggagagggaaagtgaggtaattggaaggagagggagaggattaggatgatcggaagaaaaggaatgaacaaaaagaaaacagatcgcgcaacaccgagtggaggtgcataggatggggaggcaggatggtgtgggccggttgggattgggtttggagatggaggggccgggctggaatgctggaagtgagtgtatattagttattttaggcttatggtgaattggatataggcgacgtagacttatggtgaattggatattggcgacgtacaactaactcaaagacagatgacgtactaaaattttcgtgtaaatatcttttaatttttataatagtagagaaaaggaaaaaaatatatgtcattaagttagaccacaaaatttgatatacaaatggcgtctcccagttcaaacagaaatcactttgtcccgcttaattacatgtaaactctcataacacaactacttattatcattgtctggcaatgatgggtccatttttaattgatgaaattgtatatgtaccacaaaaatgatcccgtttcaaagtcgaactaccattttaagcccgctttttcaagtttgctcattggaccattctttttaaaaatgaaggttgggcctgacctattacgtgaaagtaacctaatggtgttaactcactaagaaaagatgttcataccctttgccatttgaccctactttcccaatttttttattcaatccaacttttttgcaccgccatctgagagctcaaaaaagtgattaggctttacatgattactgtcaatcaaatgttaacagaaagacataaatctcacctctgggtgccactgtgtgtcacacacaacttgcttaaggtgtggctgcgtgatttgttgccaacaatgtatcctgaaaataatggctacttgaaacaaatattgaacttgcactttagcataggtagacttcactacctgaataggtcagcctcgttcccatttctctggtccttcacgtttttttgctagtaccattcctgatgtacgtgagagtgtcccgatctttcgatgagaggataagtcgttggatggagcaacgttggtaatccaactataactatccagggacgttgcgccttagcaatcgttacaccaactgtagaggtagtcgtgaatgtcaacggatgcacggtcagcctaaccacgaggatatttgttcctgcaagcaatcgagaactagcaattacaagatgaacaggcaactcaatttgcggaataaagttttaagattgaatcaacaaaagtatcacaggtggggtttcgtaatgagcaaaccagcgatctaaccgatcacgggattacatggtaaagtagcaagctaaactttgatctaaacaaagcccggattgatctacggcagctaagggaaataaataggtgggaggacaagttagggtcgccctctaaccctaagatgcatccctaatggacccaacttgatacacacccaaataaggtgacgcaacaccatggatagaaaaaggtctctatggtaaaacgatgattgtggcctctccagaacagatatggacattgtagattatgtgatctactaaacataatttgctaaaccgatacatgatcaccctaatgcggaattttaggattacactgaccgttatttgaagccatggatgcgattctccctttgttgtcaaccggagtggaagtaggggatcgagaacctcgaaccacctcctcgcttgtcggtgtaggtgaagtagattgtcacaccctgaagttcttctcccaagcctaaatttaatttataaatggtcttgagaaattaccggtgtaaaagcaagagtgaaaccctaatcaaattaatgcaaataataatcggaaatggcatgtggaatttttcttgagttctacatttcgaaatatgctaacaagatttttagtggaattttcagagctctagaaataattttaaccaattaaaaatgagcataagtgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctatgttctggtggatctgtgtgtgaaggaatccagcgagccggagagcgagagagagttcaggctctagaacccctttttcttctcttctcttctccccttctaggcctgggcctcctttttatctggtcaggggtcaccacatgggcctctagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggactggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacgccgcgaccggtcacggaccggataagcgtgcgctgcgccgcattaaatgcggcgtggcgcgctcgtccaacccgctataaatgcggttaggtgagccccgctgtgctcacctaacccacacacgtggcgccaaaaccacagggggtcagggcgccccagccctcggggccgaaacgggggcggcccgacctctcggggagacagagggaggggtggccacgtcaccctcgggcccgacccccccgagggggtcaggccacgtgggtgaccgcggctacccaagcctctagtcacgatacccccgaccccatgtcaccgacagtagcccccggcgttacgccaaggcgatcacctccctcgagggaagcgctcgggcgtgacgccactccttaggcccggtgacaggtggggccggtccctacaggcgggcagaaacccagcggtcgcaaatcgcgcgcatcggcaagggaaaaccgaccgacaataatgagcggcctctttaagaccgctacattactcgagcagcgcgcgattcgggacgagccggttcgtttcgcctggagacatgatgatggcgcttttcgcggttggcgagcgtagttaatgcgcgcacgatctgccccatctcaaccgccacggccacacatctgccgcgtgcgccgcaaacgggtgagtggggttagtggaggcgtgggcgcgagaaacgagggggcgaggtagtgggcgcgggaagcgaggagccgggcatagcgttggcaagggtgtaaagacgctgaggaagggattcgtttccttcctctcgccactcttccccttgccttcgccactcgcgctccaactcttcgtttcccgtgccctacccttgccgcactcgctcgctctcaagctcctcctccgccggcgtcatggcacggggctccgcaccgctcgacggtagcatgctgccgccttcccgcatcgtgagcgagaggcaggccgggctgccgcgccgattcatgccggaatctgccaccggccgggaggtggtcgcgctaggcgagggactcccggcgccacactacccggggcggtccgtcttcttcctctctttcgcaatggcggggctggtcccgccattctctatttttttcatggatattctggagttttatgatctccagatggcgcacctcacccctaacgcgataatgacgttggccatcttcgcgcacctgtgcgagatgtttatcggggtgcgcccatctctccggctgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacacccccctcgccgatgaagcgcgcctccgacttccgagccagccgtagatctgggagatggctacgacgccgttcttgaccgcctcgcgggtctgcgatcccaggggctcacgggagccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctttgctgcgatccagagcgcgccaacatcctgaccatcatgcaggaggtcggggcgtcgggggagcgggccccccgaggccacgatggcgcgggcgggagccgcaggggggaacaatctaccccgggagggggtcgtgcttctgggccccgcgacgggggcccggagggcagccgtcctgccgacgcccgggagaagaggaagcaggagggtacccctcccccatctcctccccgagggggcggggtggtgcgtgccagcagcaggcgcccggagggtgccgtgctgacgccgcagcccgagggggagcgaaagaagaaacggctccgcaagatgggggggaccgagccatgccgggggaacctcatctcgcccccgaggtggtcgtttagccgacctccccgcaggttcgtccccgcgcccaccgcggccgtattcattctcctatctcccaaggcgagttttcactcacccgtttctttttgtcttctggtttttcttctgcctcagcgagatcctgtcgcgccccccccccccccgcccgccatcccaagtccggcgggtctgaggtcgaggagacggcgaccgcggaggcccggaggcgggaagctgaccagcgagaagccgcggaccgcctccgggaagccgaggaggctgcccaggaggccgtccgggttcgccaggctgaggaggccgctcgagaggaggccagactccgccgggccggggagtccgtccgggaggcagaggcggcgcgcgcacgccaggcggcctgccaagcccccgacccgactccgcccgaggcgacgacgacttccgaggccacccacgacgaggccgcgggcgcgccgctcgggcccgacccctcgggcgacgcttgggacgagccagcttcgggggacgcccccgagtctggcacgtcgatcggcgggccgagccgcgcggcacccacaccgagacggctctcccctctgccttccgctgccccactgagcgcggagtccctcctgcaggccttggccgccgcgaacagcacggtgctggacgggttaagtgcccagatggaggccctgcaggcggagcgggcggagctcgacgcggcgtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagaggagaagctcgacgccgcccggggagtccttgacgccgccgctgcccgggaacggcgggcggcggagaacgaggcggcgtcccggcagcgcgaagaggcccttgaggctcgcgccacggcgctggaggagcgcgcccgcgccctggacgcgaaggagagagacctggcggaccgcgaggccgccgtcgccgcccgggaggcaacactggcggcgcacgaggccgcctgcgccgaagaggagtccgcactccgcctccgcgaggacgagctcaccgagcgggggcgagctctcgaggaggccgaggccgtggcgcagcggctggcggacagcctgttcctccgcgaggtagcgcgggaggagcaggcgcgccgcaatctggaaggcgcccgcgccgagagggccgcgctggatcagtgggccgcagagctcgaggcgcgggcgaaggagctggacgcgagagcgcacagcggcggggcggccgcgggccagggcgacctagccgcccgccttgcagccgccgaacacaccatcgccgagctgcagggcgcgctggacttgtccgccggggaggtcgaggccctccgcttggcgagcgaggtagggcccggcatgcttcgggacgccgtctcccgtctagaccgcgccgggcggcaggcgggcctctggggcaggcggtacgcgaagtacgccgccaaccaggggggcctcgcccagcgcctctcagagatggccgggaccctcaagcggctccccgaggagctcgaggagacgatcaagtcatcctcgagggacctcgcccggggggcggtggagctcgtactggcaaggtaccaggccagggaccctgacttctccccgtgggcagcgctggaagagttccctcccggaaccgaggacggcgcgcgcgcgcaggtccgggacgccgccgaccacatcatccacagcttcgagggtacggcccctcggctcgcgttcgccctcgactccgacgaggagggcggtgacgacggtgcggacgacagcgacgacaaggagggcggtaacttttccttcttcttccgaggccttcggcccccttcttgtatagactgatttaatctgcaatcaagtaaagaggaaatttctgcgtcagttctgtttgttgtgtgtataagacgaggatggtctgtgccgcggtcattctgtgtcttagcttgaacaagggctcgtgcccaggtcccagcctcaaacggcgcgggtcggggctagtgcctggggagatcctcgtgtcgagactggccaggctgggagcgcggtgaccgagggttatggatgacccgattgtgggcctttgccgattcccccccgaagttcaccacgccccggggcacggctcggttctgggccccgtttggcgattttagccggcccgggccaccgagggcagggtcaagcacgagcgtgctaattcaagccaagattcttcaaaaggaaacgatggcacagacacagtcctcaggaaatcgaaaatgcttttattgaaatacggaagagaaaaaaggtaagtatatgcatgtggtagcccaggccaaccctgcacgcccgggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagttcagcacgcgtttggacgcggcgtaggacgaggtcgtcgacgcagagtgatcgggcccggacgtggcactgatggtagcgccgcaggctctgctggtagcgcgcggctcggagggccgcgcgccgtcttcactcttccaaatagtcgaggtcgtctcggcgaagctgatcttgatcagcctcggaatacatggtgacccgaggggacctcagggtgagctcagatgggaggaccgcctccgcgccgtagacgaggaagaaaggcgtttccccggttgctcggcttggcgtggttcagttcgcccagagcaccgctggcagctcctcgatccacgagtcgccgtgcttcttgaggatgttgtaggtcttggttttgaggcccttgaggatttccgcgttggcgcgctccacttggccgttgcttctggggtgggcgggggaggcgaagcagagcttgatgcccatgtcttcgcagtagtcaccgaagagttcactagttgtcacgaccgaaaataacccaacgggcgttccttacgtgcgtgcattattccttgtcccaggaggcaaggtacaccaaaagttgatacagttcagagttcaacaagcggaagcgtaaatagttaatttattacatgggcagcgaaggcccagcacacacaaagacaaacgagaaacagcggaagactagggcgacgaccacaggcgcttgacggcaggcacgagctagacaccaaaatcttcatcttccggagactcctcttctgggtttgggaaaaattgagcaagactgagtacaaccaccgtactcaacaagacacaccgacaagtgcataataaatgcaagggagtacaagggagttataatataaagggttagggttgcagtaaacagcattaaaagacacttagttgctcaaagctattttgtaaacacgattctagaactatacaatattatttatcaaggccgtgaacccacacgaacctgccttaactcaaggcctacgatgattcagaccgaaccggcaacccgaccctgggtcccagctcgtcccaagccaacccaggccaaccattcctccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccgcaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaactattttgagggttttgaatagagggggaggtgtgaatccaattccacaataatcaaaccaatccatagtgtccaggtgatacgaatatcccaaagtctagagttgaaaaaccacctaatgttacctaattaaatagcgaagcatctacctaaaatcatactagtggtaccatgagtagagtgtccactagttggggttttgtttattctagggtgaacaaggaaataataacaataacaataataaggtcataacaaaggaaaataggcatggctagataaaacagtgataacgcgggaatttaaataaagcgataatgcaataatttaaagcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtctaattccgagttcaaatggccaagttatggccatttgaagtttatatgctctttaaatgaatatttgcgaatttcttcatttaaattttaatttaaaatggatttattgcgtcagccgaggggaggggcgcgcggactgggtccacgggagtggggcccacgtggcagccccacggcccacggtggaccgggcgcacccggggtcgcaccggccggcgccgtgggtcccacgcgtcagccgcacctaagggcgcgggcggctgacagccgggccccacacggcagccgcggggcgtgcccaaaggcggccacgccggcacagccgacgggaggcggcgcgcccgcgcccctatggtcgccggtggcggccataggtacggcggagcggcggccgagagaggggagggaagggggaaacgaatcggcggtccacggctcaccccgggtcgatggcgacgacgggaacggcgaccggagctgaggaaggcggcggcgcggctcgggtggacggggtcgacggtgctccggcggtcggcgtgcgaaacggaggggtggacgaggtcggcgaggatgcggcgaagccgaaggaggcggcgccgaggggagaggtggtccggggcgacaacggcggcggaccggagctcggcggcgacggcggagagagagagcgacggcgcgagctcgattccggcggggagagagagcggcgagtggcggaaacggtggagggaggcacggggagggtttatatagggttaagagagggaaggggtggccggaggagggggaaacgggcgcgggagtcccggccgccattaatggcgccggcgaggttagggggaaagtttccaaatgaatccgagggagagagagagggaaaaatggggggaaagagggaggggatcccggggaatatttcccctctcttgattgcacgcggggcggacgggggcggcgggattcgcggcggcagcggcggcgctagggcgcgggcggggcggcgggagcggcgggaggaaggggatgacgggtgggccccacccgtcagcgagggtggcgggcgggcccgcccgtcagcggcgcgcgcgcggggaggaggccgaatgggccgcggggaagaggagagagagggaaagagatgggccgagctggcccaagagggggagggggaaaaaaggactttttagagcttttctttttataaaaccattttaacttcgtttatttcttaataattattatttgtgctctgaaaattccactaaaatttatttatgcattttaggcttttaggaaatatacaaaaatcctccaagccttatttgactttttactttgcacattttaattgttggaggctttcacatggattttaattattctaggcataatttcgaggatgtattttagagtcgttttgagacgcgacactagtgaactgggtgccgttatcctatttgtcgtccagaagaccaccgattcgtgtggtcttggacgggccgtcgctcagggcaacctccttgaccgggacctcgtcgcacgtgaccatccgctgccttggggcggccgggacggaggtactgagcctctcgtcgccacccgcgggcttggacgccgcggcgaggtggtccgcgcgctgctccatacaagcaagcgcgactttgaggtcgccatggacggtgatggggccaccggggcccggcatcttcatctggtgataggcgtagtggaccgccgccatgaacttcaccaacacgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggatggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccaggcaacgcacggcgggtggtcggtctggtcgaaggtgagggcaacctccgaccaccgcgcccgccgtgtcgcctcatgggtaggggccgcggccagaagctcgcgcttcatggccttgaggctccggcgagaaacgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggccttgccctcacggcgctcctgcctcttctcctcctcccatttcctcgtccgctcagccaaacttttgaccgcgcggcagtccgcgagatcgtggagggtggtgttgtgcacggtacaccacttgccggtcgggcgctccctgctgggagcgccggcctccttctttttgtcgctcgcaggcctcccctttcgtggggcccgcgaagcgccctcgacggcgaggacatgaccctcgtcgtcggaacgggccgacttcttcttcctcctcctgtcccgccgctctgaccgagcggcggacccgggggcggccagagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgccccccctgaacacgtagatcaccgcgtgtgcggggatacacggtatggtgttgcggacttgacagaaccgctgaatgtacgagcgaagaggctcatcgtcccttcgctgtaccgcatgcaagtccgcttcttcgcctgggcgcggatatgtgccctggaagttcgtggtgaactgctggcacaaatcctcccaagagtagaccgacgcgggtggcaagttcattagccaaccccgcgcctgacccttcagggccatggggaagaaattcgccatgaccctgtcgtcacccccggcggcctcgatcccggtcgtgtagatctggagaaactcagcggggttgacgcttccgtcgtatttttcggtgatggtggaccagaaccttgggggccaacggacgttccgaaggctcgccacaaaggctcgacagccggcaccgccaaccggggacacggggggccggcccccgtgcccggaccgaagtggcgctccggacgaggaagcgccctccgttgcgtcggcggcgcgacgatcgtcgcgccggcgctcgatatcgaggcgggcatccggccccccacgcacatcttcttgggtcggaggcgttgacgagggaacggcggacgaacggcgggtaacggccgccgctcgccgcgccctccgcctcgacgacatggagccggcggcggcagcgccagaggcctcggtggcggaggaccgcccgccggcgcctaggcgctgctgcgccgtcatgaccaagtcagccacgtcatccagccaacgtcgggccggagtctctggatcggggacgacgggcgggtgacgcaggagcgcgcccgcagcctggagcgcgccctggggcatgccgccatcgccgtagacgaggcggcgacgcgccccgtctcgccgtcctcccccgtcgcccgcgggcggcgaagtcgcggatcctccgacctccccgagcgcctccccccgcccaagatttcggcgagagggggacggtggggtgcgagcccgacggcgcgggttctgctccccgtcgtcaccgctagcgttcggagagaggctgtgcaccactgcccgttcggccattgggctgagcgggagaagcttggcgcacacgaaagaggacgagggcttagaaagtcacgcgcgccccctacctggcgcgccagatgacggagcgtggggctcctcactgggagaccgcgcaggcccccctttgccggttcggccggggacgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatccagcgagccggagagcgagagagagttcaggctctagaaccctttttcttctcttctcttctccccttctaggcctgggcctcctttttatctggtcaggggtcaccacatgggcctctagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggactggatctgaccgggactg

SEQ ID NO: 30233 - DNA, 10092 bp, Oryza sativa
tcagcgagggtgccggccggtcccgcccgtcagcggcgcgcgcgcggggaggaggccgaatgggccgcggggaagaggagagagagggaaagagatgggccgagccggcccaagagggggagggggggggaaaaaggactttttagagcttttctttttataaaaccattttaacttcgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcgaggatgtattttagagtcgttttgagacgcgacaaacctaccccccttaaacggaatctcgaccccgagattcggaagaactggcgaagagatcgggatgggctgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttcgcgaacttcaatttgctctgagtcggtctgctcggacggcacccgaagacatttcttgagttgcgacacatggaacacatcatgcacgttgcccaaggaggcgggcagctccaactggtaagcgacttctccgcgtcgggcaatgatacggaaaggacccacaaaccgaggtgcgagcttcccttttgtctgaaacctgtgtacacctcgcaatggcgtgacccgaaggtacacaaaatcgtccactgcgaattccaggttacggcgacggttatctgcataacttttctgccgggactgtgccacctttagattatcccgaatggttctgaccttcgcttcagcttctctcaggatatcagtcccgaacacttgactttccccaacttggtcccacaagagcggtgtccggcatttgcgcccatacaacgcttcataaggtgccatttgtatactggcttggtagctgttattgtaggagaactcggcataggggagactcttatcccaggtcttcccgaaatctaggacacatgcgcgaagcatatcttctaggatctgatttagacactcggtctgtccatccgtctgcgggtgatacgcggtgctgaaatttaatcgggtatccagctcttcttggagcttcttccaaaagtgagaggtgaattggcttcccctatcagatacgattttcttgggaacgccatggagactcacgatcctagcgaagtagagctcggctagtttgttccctccataggtggtcttcacaagaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaggtctaagtacatcttcgtactgctagggtggatggaataaggactttcgtgagcttcctgaagtatcagttgtttaagttctctgttatctggaacgcatacccgatttccgttccatagggttccgtgttcatcctctgtgaaaccagcggctttaccctgtttcatattattgaggagtccatgcatgtccgggtcgttcttctgagcctcgcggatttgatcgagcaaggtgggcttggcttccaacgcagccaagaatccacgacccactatgcttagattcagggcttccatctgttggttaagttcgggtggaatgccacggacgttaagagtgttgcaatggcttttttgacttagagcgtcggtgaccacgttggccttaccaggatgatagtgaattcccacatcataatccttgatgagttctagccatctcctctgccgaagattcagatccgactgggtgaagatgtatttcaaactcttatgatcagtatatatttcacagcgattcccattgagatagtgccgccagattttttagagcatgaaccaccgtggctaactccaaatcatgggtagggtagttgctttcatgaggccgtagctggcgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttggaacgccttctcgcattgcgggctccacacaaatttctcttctttcttcaacaactatgtcatgggtcgagcgattttggagaagttctcgataaacctccggtagtatcctgccaaacctaagaaactgcgaatttgagtgactgtcttgggttacttccaatcagtgacggcggtcactgtttcggggtccacagcaactcctttagcagatatcacgtgccctaagaatttgacttcggacaaccagaactcacacttgctaagtttggcatacaattgatgttcccgcaacttccccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggttaaaccgaatgacatcaccgtgaattcatacagtccgtatcgcgtggtgaatgcggtcttcggaatatcttcttcacggatgcgcaactggtgatatccggaacgaagatcaatcttggagaataccgtggcacctttaagctgatcgaacagatcatcgatccggggaagagggtacttgtttttgatggtgacttcattgagagctctgtagtcaacgcacatcctcttcatcttgtctttcttctccacaaaaatcacaggagcaccccagggggaagtactcggacgtatataccccttttctttcaactcttccaactgtttcttaacttcggccagttcatttgctgccatacggtagggtcgcttgtatagaggagtggttcctggagcaagatctatccagaactcaatctctcgcttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggagtctagaagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggaccttgaacgtccctgcggccttgaccaggctgcacggctggcataggaggacggggcgcacgagtcccttgttgactctgctgttgctgcggctgtgggacgcgcaccatgaattgaggtcggggcgcggagcgaggttgttgctgctgttgctgctgcgaggacgatccccctggatagggattggtgtagcggaccctttggttagcaccctgttgatttgtcacccccggaaattcactagtaatttccgaacttatttgttcataaaatcctcgtccaggaatcagccgaggtacacaaactgacaatttaatatacagattcatcaaattaactaaaacgataaatacttacttaagaggcacttagtcctcaccatgaagaaaagtgcagcggaaaataaaatctagcgaagctccggctccactcccacaggcagctcaactggggtataagccaaacgtcttctccttctggatcctttttcttcaactgaggttgattgattattgcaaggatgagcatatgacatactcagcaagccacacagcaaatatgcaaagtgcacaaggataccaaggatggcattatataggctcatttgcaaaagcagcatttagcaaaacatttaagagaagtaaaaacagtggagtaattaatcagaaattttaatcaacactgaacaacacgcccatgctgctcaggcccaacccttctgaagcaaccatacccggctgtacagttctatctccaaaccaggaatataccattccaaaccaggagctaaacaaattattaccaagtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcccggatcatagtcacccccttataaacaaggtatggactccccagcgacccccgtgggcttatctccgccacttctcaacctggtgctctgcaatgaaccatgctatacaaaaggtaaagccgttgcccacgctggcttgtggttggcacgattaatgtttcacaacagtagctcacgaaccggtccttaattgccatgagcacgactctcaaaaccatgtgctcacaacccaccattatcaagttttagttggcaagtaattaattaaccaatcacgattgaccatcgtgaactatcattaagccatcatgaaataatagtgagtcataagttatcccaatagtgtgctaatgtttctaagcatggctaagcaatcatatctaatatctagctgaaccaatatataaagctcaactagtcaaattataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggaattgtgtttaggatctgtgtgacttgccttgcaataatcggtcttcaattaatcttcttgaacacttccggcgcactcacaaaccttcgcaacgacggaaacgacaagctaacacgcaaaacgaagaaaaagactaataaaaaccaaataaacagtacataataagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggacaattttaatatgtagatctttattttataaaatttttgcaacttgaaccacattaaactgagttcaaatgaattagttatgaatttttaaagattaaatcggattaaaacacttatatggattttaattgaattatgacgcaataatgaattatttttgaaaaggaaaagagaattattgcgtcagcgagctcgggttcacggtgaaccgagtgcacggcaacggttcacgggaactgacggtcgagatcaaccctatccaaaacggacggccgagatcgaacggatccaccgcggctcacggacggacgacgacgatgacgtcaggggtgacgtcagcgatgacgtcagcaccgacggcggctcggcggctcgggagcacttgctcgccggcgaacgacggcgcgaggacgcgaacgaagggcaccaacgggtagagggcgacgcgacgaactcaccggtgaccaaaaccacggcggaaaagcaacggacggcgccagcgacgaggaagaagcggcggcgaagatcgggtcgacggcggcgacggttctccggcggtcttcagcgacggtgaagcggtggacggggaaggcgacgaccttgcgaacccgatggtggcgacggcgaccgacgacggcggctgcaacggcggcgcggcgcggctgaaccgattgcaacgacggcaacggctagggctacgcggaggcagcgctagacgcgacggcgggctaaggcaaaggtggcggcggataggggagagctcggagatccttttataggggcaaggaggcggcggcgaaggcccacggctgccggcgacgagaaggaaagttcgggttcggaggaaagagatgaacccgaatcgaactcgaatccaccggtttccaaacgaaattgaccgaagagtccaaaagagaaaaggtagaggagatcccgaggatcatttcccctctatcgattcggccggaggaggaaaggagcgacggaattttggaagggcggcggcggctcggacgcggctcggctagggttccgggcggcggcggcgcgaggaggaagacggctccgacaagtggggcccacctgtcagcgacagagaaagagaggagagcggcggctcggcggactgggccggactgggccgggaaggagagagaaagagagaggttttgggccggctttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctagcccaattttatattgagatttaacaaattaaaattagatcttctcttttaggcttttaaaatcatttctaataattccttttaaacaacaatttatatattttggatttttaaacaagaaaagctcttaacaattataattagatcattaatgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattctatcattaatttattaaataatttataaatcctgaaacaaaaatcaggatgtgacatgattgcggaaattcgccaagcggcgcttgtgcgactccagttccttgtgcttggcttccaagcggatgctcttgtccaccagacgttggaaatccgcatagtcaccggagactagacgcacggatagctcagggtccattcctgccaagaacttctcctgcttttcctcatcttcccgtacatcctccggggcgtaccgggccaggttgttaaactcatgcaaatactccatcacggagcggttgccttgcttcaactctcggaattcccttttcttaagggccatgactccggcgggcacatgggtcctccggaaggcggcggtgaagcgggcccaagtaataggctgcccctctggctgcgtagcctggaaatggtcccaccatagagatgcgggcccctgcagttggtgggcggcgaagacgactttctcctcatcgctgcactgcacggtgtctagctttttccccacggcatgcaaccaatccaacgcatccacggggttgttggagctagagaaggtaggtggacggatgcggaggaactcggcgagtttagagtgttgtgggggtggtggtggagcattctgttgtggcggattttggaggtggtggaggaaagcagtcatcatgttggcctgctgggcgaggatttgagtgagaatggcgttggtgtctggtggtggtggtggaggcggaggaggaggtggaggtgggctgccatggttgttgtggttgctgccttcaggttggttgccatcaccggtggcagcacttctcctggtcgtcaccatctgaaaaccccacacagaaccagcaaacagagagagctgacaattaaagctaaccatccacgactaccataattcttgaatttattactgctattaaattggttcattaaagttcaagttgcttaagcaaataaaataaagacaggctccgacacagttatgccacacaccggcataaccatgccccacacgactccaacaagaggacaaacgagaaagaacacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctcaacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctaggtccttcttcagctgcagattctcctgacgcagctccaggatcttcatgttgttctcgaccatcccacggcgcaccatctgatggaagtcgatacgagccgcatcgtacgcctccaccatgcgcgccaggtgcatgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagagcggcgttctggcaagcggcggagaaagaatctccacccgcggtgactgccaacgaagtcctctcgggtgagccagtgaggatcactgcagtaacctcccaagcagcgtggggctctgcatcgtcaccctcctgctccaggagcagcctgccctggtagtccactccatgcggataccccaggacaacgcacatgccccgcagctccaagacgaaaccagtcaggtccagaccacgacggctgatgctgccggccatctacaaacaaaaacaaaaagaaaagcaacatttaaaagtcagattttggcgataaatgaagcagcaggacagagagagactagagggttttcacaattaagacaggatttttagttttgaaaatattgctaaggcttgggatctaaggctcgtcctagggtcaagggggctctgataccaacttgtcacgaccggaaataacccaacgggcgttccttacgtgcgtgcattattccttgtcccaggaggcaaggtacaccaaaagttgatacagttcagagttcaacaagcggaagcgtaaatagttaatttattacatgggcagcgaaggcccagcacacacaaagacaaatgagaaacagcggaagactagggcgacgaccacaggcgcttgacggcaggcacgagctagacaccaaaatcttcatcttccggagactcctcttctgggtttgggaaaaattgagcaagactgagtacaaccaccgtactcaacaagacacaccgacaagtgcataataaatgcaagggagtacaagggagttataatataaagggttagggttgcagtaaacagcattaaaagacacttatttgctcaaagctattttgtaaacacgattctagaactatacaatattatttatcaa

SEQ ID NO: 30234 - DNA, 17678 bp, Oryza sativa
acccctcggggagacagagggaggggtggccacgtcaccctcgggcccgacccccccgagggggtcaggccacgtgggtgactgcggctacccaagcctctagtcacgatacccccgaccccatgtcaccgacaataagcattatttaaatccctggaaattctttcctttttttctttttcctttttcccctcctttttccctaatgggccaccagcccatttcctcctccctcccgcacctagctgggctggccgaaggccacggcccagctgagcccgcgcctcctccctcctcccctcgggtcgtcgacaggtggggcccacctgtcgggcccgtccccaacctccagccgcccaccgtccgcagccgccgcctcgcaactgcccgcgcccgccttccccgcaccacatcggccacgcccgcgcgtgcgcccgccttctctgcgcccctcaaccccctctcccgctcgcccgcgcccccgagatggctgggatttgaatttcgaatcccgcctctgtctccacctccacctccccacgtcggccggcgaaatcgggctgctcccggccacgtccgagccccctctcccctatttaagcatcaccgctctcccctctctctttttccccatttggccaagctctctcgtgctttcctccgctctagcgtcgttgccctcctctccgccgccatttcggttgccgctagccaccgctagccgccaaaccgagccaccgtcgtgcgggccgcctcatccacccctcctccgtcggattccggggctggaacccactccgcaccgagcgttggtgagttcggccatggtcgccgccttcggccggcgtccccgccttctatgatctctctctccccctctaacttctcccattttgctccttaggttgtcccggaccccgtccgccgctcgttgacctctctccgtcatttctcgtcgccgttcgccgtcgtctccctccacgccagtcggacctcttcggtgaggacaccccctccttcttccccctgtcttttcctctcgtagcgccaccgcatagctgccgccgggccgcccgccggtcaccgccggtgtcgcgccgtcgtgcgcaatggcgccgggccggcttgagccgagccccgtgcgcgccggccgcatcctcccgccgctgtccgatctacccgggggtagatcggggccgtccgcctcgccacccacgtggctgccatgtggccgccacgtcagcgccatgtggtgtgctgtttttccccggttcgtggacccggtccaccacggaccgcaaccccgagccactgccatgtggggcccgcgtgtcggtgccgccccttctctctccagggtttatttattgcgcaataaatcctttaaggatttttctgtttatagtaaaaacacagtgaaccttctaaaattcatagaaaactcatccgagctccgtttaagcccattcaagtctcagtaaatcaagaaaaatgcaaagaatccattaaaaatggttttgttctctgtttcagtagtcttgtattctgtttgtattgtttgctttgtatgtcgcttagattccggctctcccgacgctccggtgtactttgaaatagtcaccgagattcctccagcagcaaaccaaggcaagtcatgcttgtcacttgaacatattgaacctatattgcaaatgctctatcgttttcccttaaacattgcattgttttataatgttactatgggatgttgacctactgttacaagccatgctatctttgtaccttgctcctttgttagcatgggatatgacctgattagatgttggattagaaattgcttagccatgcttagttcaactagcacacaatggggaaactacattaatgtatagctatcacattctagtattgttgagggtttagtgccaccgctttggtgacggttaattaaaatatattaaatggtgggccgcgggtgcatggttctgatggtcgcgcccatggcatttaaggaccggttcgcgggaaaccctggaaaaattcctcgtacttaccacaagccagcgtgggcaatggctgggcttgtattgtagctttcctctagctgacgcatccaggcaagggtgagcgtgatggagttcggatgggtcctgcgacggcctatgcggctttcggattcacctaggcacgagaggggactgcccgctgccttgcgaggagtgggggtgaaacctaaggtgtggtgtgtttggttagagggggttatgcgaagcgtcctgtcacggtctctttccggtatgtcgtggtggcatgtcagcgcacggaaacgtgtcgtggggctgtgtcttgtggctacagttatacacctctgatcagagtaaaactattcgaaaacgtgcccgcgattatgggcggtcaaccagattcaccatgattagtctcaccctagcttagtctaatggaattgattatttcaggtggatggttgggcctgttgcaacgtggtgtagcattggacagtggatgagtaatattgattaattattacaactgttttaccgctttcaactactgtttataaatgctcgcttttatgcaaatgaaccgctctagctatcctttggttatatcctgcatcataccccggttccggtatgacatgctaagtacagtgggtagtactcagtcttgctctattttccccaaccccagagtttgagtatgcgccagatggtggcttttccgaggagtaggcttcgtccgtgccgtcgaggatgcctgtggagtggtgttcccgctgcagtccaagtcaaggatcagctccagttatcttttattttccgctgcatttatgtaagacttttatgatgtttgtaggacgtagatctgtatgtcaactttgtcgtttgtgtaccctggccggtcttggacaggggttttaatgcacatgttgcttggaattctattcggaaatttctgggcgtgacatagatgtaatagtagtagtagggacgccggcttgatcccgaaggggtcgccggcgatcacttgcggggtagcggtggacttctggtcgccacctgcactatccctgaaccgcctcacgtttcccctccagcgccaatgttgatcggggtttagggttttgttatcggggagattgagaccgagagagatcatcatccctcttgggctggcctccccttttatatttagcactgtagggaatcaggggcgactcaataggaaataaattgggcaccaccgatcacggcgcgttagttaatctggaattaaaacggattcagtcgctgtgatttcgcgtagacaaggggtggaaaacggtctagcacgatttcctcctagcgcggtctcctcccggttttccaaaccgagagatcaattttcccaacattctcccctttgatcttgaggttaatgaattctttcttaataaaatagttcaccaaggcaacgcgtcatggcagttatcatatcgtaccaagactccggtacctatagttcactataaaatttctaaagaactctatctaatcttaatgggagttagttaggactaatgcccctatttccaggatcttagtcttaatcaaaggcaatcagttattcccatgccggctacatgatctttaaataagttgggaagtaagcctttggtaagcggatccgcgagcattgacttagtactaatatgctcaatcttaatggtttgatcctggattctatctttcacaacatgatacttaatgtcgatgtgtttggcagcaccactcgacttgttgttacttgaatagaatactgcagctatattatcgcagtataatgtgattggtctagaaatgctgtcgaccactcttaaacaatggataaaaatcttaagccatttggcctgccccgttgcttcaaaacatgccacaaattcagcctgcattgtcaacgatgcagtcaaagtttgtttagagcttttccatgaaatagctccctttgcgagagtgaagacataacctaatgtagatttcttagtgtctacacatcccataaagtctgcatctgaataacctaggacttcaagttcttcagacttcttgtatgtgagcatgtaatccttagtgccttgcaaataatgcaagacctttttaacagccttccagtggtctaatcctggattagactgaaatctgccaagcatcccggtaacaaatgctaagtctggacgcgtacagacttgagcatacactaggcttctgacagctgaagcgtatggtaccattttcatctgatctaattgtaatttatttttcgggctttgaaatgatccgaatttatcgcccttaactattggagcaggtgttgcagagcacttactcatattatatctttctagtactctgctaatgtatgatttctaagataatcccagtactcctctagacctaaaacataagatacctcaccaagatccttcatatcaaaattagatgacaaaaattctttagtctgatgcaacatattaatgtcgctgcttgctaacagtatgtcatccacatagagtactagtattataaattttccacccttagtattaatgtaaatgcaattatccacctcattctccttaaatccgaatctcttaattatttcatcgaatttaaggtaccattgccttgacgcttgtttaagtccataaatagatttcttaagtttgcaagccaaatggtccttgccttccataataaaaccctcgggttctgccatgtatacatcctcatgtcagtcaccattaagaaatgcagtctttacatccatctgatggagctctaaatcataatgagcaacaagcgccatgacaattctaaatgagtctttcttagagacaggagaaaaggtttcattgtaatctattccctctctttgtgaaaaaccctttgctacaagccttgccttgaacctttcaattttccctttggagtcaagcttagttttgtagacccaattacagcctactgttttggctcctttaggaatttctactaagtcccagactccattatgactcatagattttaattaatcttccatagcttcaagccatttggatgaatgttcactcgttattgcttctttaaattaggtgggatcatctaccttcccaatatcttcacctaaataaacctcataataatttggaatggcagatctcctctcccgttgtgatcttctaagtggttcattttccatcactgacggttgagaaggttcctctagaatttcttcattttgtgcctcagaagtatgttgagtgtcattatttaattctttattattttcaacagagtcggtattaccagaatttttatctggtgctaccacggtctgagtcacaggtacaacatgaggtaccaaatttattggaatattattctcttggatttccggtgtaacattagcccgaatttcctcaagattaatttccctttcttgtgagctcccacagacttcattattttctaagaatacggcgtgtctagtttccaaaaatttagtgacacggtccgggcaataaaatcggtaccccttagatgtctcagggtatccgataaagtggcagcttacagtcttaggatctaatttctttagttgtggattaaatatttttgcctcagcacgacaaccccacacacgtaaataatttaatgtcggttttcttccggtccataatttataaggtgttttgggtaccgacttacttggaactcgattgagtatgtgtgcagctgtttaaagtgcctctatccataaattcacagacaaagtagaataactaagcatactccgtaccatgtccataagtgtacgattgcgatgctcagccactccattttgttgtggttctccaggcatggaatattcggcaattattccatgtatctgaaggtattgggcaaatggaccaggactttgcccataaggagtatgtctcccataatattctcctcctcgatttgatctcactaccttaatttttgcattatgctgattttcaatctcagctttgaatattttaaacttatcaagtgattcagatctatctttaatggggaaaacgtatccataatgggagaaatcatctgtgaaggtaatgaacgagtcatatccatcaacagatgttactgggaacggtccacatatatccgtgtgaattatttctaatggacacgtgctcctagtagctctttcttaattttcttagtgaattttcccttaatacaatctgagcaatgatccacattcgaaaaatataagggttgaagtatctcttccttaatgagacgctccattcttcccttagaaatgtggcctaaacgacagtgccacaatttcgaagacgtctcattatcattacaggcattcaatatattcataatatgatcatccaaagagagcaaatagagcttgtcttgcacgctagcaagaccaatatcaatattattatacttaataaagcatttgtctttagaaaaattacaatcataaccactgtttgttaaaaccattacagaaataaggttcctcttaacagagggagcataaagaacatcatgaagtaaaagattattgccgcttagaagtcgaagatgaagctccccaacggccatcactttaatttcagctccatcagcactcttaggatccgctccccctttcttagcgtcctcacggaacggaaatccctgtaatgagttagcaacgtgcacagtggcacctgagtcaatccaccctgatttatgagaaaattcaacataaagtaattcatcaacattagagacaatattaacattagtacctttcttagcaagcgaagcccgaaagccttcacagttcctctgtgcatgaccttctgccttgcaaaacttgcaaaagaacttaccagcagagttctgacctgctggaacctgagctttgcccttatgggcaccattagaagcctgagtggaaggagtgttgggcttcttcttcttgttttgggagttgctggactccccttgatagaactttttcttaccgcccttagcactatgaaggaggttcagctgatccttatgcttctgtttgtcagccttttgacgatcctcctcctcaatagaatgagaaatgagttcttcaatggaccacttatccctatgattattatagttaatgatgaaagactcaaaatcatcattaattcccatgtccatactcttaagctctccattcatagcacccatctgcataatgtgctttctcacaccacctttataattatagcgcgtggacgttaggcgcttaattatagagctagcgtaagacatagaagaactcctgaagttcctatcaatattttctaagtatgtcttaacatcatcagagtcctcaataccaccaataatgacatttgatatggcactcttgatgtacatgagagaaatcctattggacttctcccattcattagttttctcacgatataacttcagtttctcctcataatcgtgctgaacactaaagggttcctcaggacggtcctctctaatggcataatcataatcaagtatgcctaagttgagcaacacgtcagccttccacttagcataatttgacccttcaagaggctcaatgggtcggatgtcacgcccggaatttctatccaaaattccaaacgcttacatgtgtgtgaaccctcgtccaggaatcagccgaggcacacaataacaaattgataatagagtacaaatattactctaattaataagcgaataaactgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttaacaaatatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgaatcattagttatcccataagtgagctaatgtttctaagcatggctaagcaattatatctaatatctagttgaaccaatataaataaagctcaactagtcaaattataatatcccaaggtatcaaggaataaggtgatcaagaacaaaagggctatagcaacaataggtcaattccactcaatgacattcgaaaatagatgcaatagttgaatagaaacaatagctttaaataggatcaacatgctcaaagggttgtttgggatctgtgtgacttgccttgctgccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcgattttagaaaaatttagagacttgaaccaactaaatcggagctaagatgaattagttatgaatttttaaagattaaatcggattaaaacacttaaattgattttaattgaattatggcgcaataatgaattatttttgaaaaggaaaaggaggattattgcgtcaacggctagggtttggtggaccgggcgcacgggcgacggttcacgcgaacggacggccgagatcgaaccaatccaaaacggacggccgagatcgatcggtctacgaccggctcacggaagagggcgacgatgacgtcagcgatgacgtcaccaccggcggcggcggctcggcggctcgggcttgcatgctcgccggcgaacgacggcacggcgacgcggacggaaggcaccaacggaccaaagcgacggcggaggaccaacggacggcgacggcgacgaggttgaaacggcggcggagatcgggtcgacgacggcgacgatgctccgacggtctccgacggctgcgaagcagcggacgaggacggcgacgacttggcgagcacgacggcggtcttcccgaacgacggcgacggctgaaacgacggcaacgcacggctggagcggcggcggcgacggcggcgctagggcacacggcgctagggctcttccggcgacgagaggcgaaggcgagggtggcgacgggtagaggagacaccgggggtccttttaaaggggctaggaggcggcggcgaaggcccacggcggcggcaacggcgaaggaaagctcggacttggagagaagaaagccgatccgattcgaactcgaatcaaactcattccaaaccgatttagccgaagtttccaaagaagaaaaggtagaggagatcccggagatcatttcccctctatcaattcggccagagaaggaaaggaacggccagattggaaagcggcggcggcggcggcaaagctagggtttcggcccgaggaggacgacgatcccgacaggtgggccccacctgtcagcgggcggacgcgcgctcgcgcgcggcggactgggccggctgggccgaggagagagaagagagggttttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttagtgaaattttatctggccccattttatattggaatttattaattaaaattagatcttctcttcaagacttttaaaattatttctaaaaattccagttaaacaacaatttatatattttgaattttcagggtgtgacatcggatctgaccaaaagctgaaaaaatcatgaagaaaaaatatccaaaagtacatatatgcaattaatttgcgttggctcaattaattacataattaaacagaaatgaattcccctaattacatcaccgttgggcagaaataattttgggaaacataatcataaataaatttacgtgaatttataatcaatgtaggtcagaaaataaattcatatcatggaaaacaaatatctagccaaatttctcgttggttccatttagctagtattaaattaataagcctccataaaaaatttcataatttttcagcaattttaagcaatataaatggtactaatgcaatttctgaaaaatacttaaaggtggattaaaaaattagaaattataatatttgggccggcctggcgcgtgcggcccatgatgcatggctcggcccaacccggagggcgcgctgcggcctgctaatggcagtggcccgatcggaagcgatccgagccgttcgcttagatggacggctcagatcgattaatattagtaaaagaagaaaaaaaaattaaaaacataaaagtgccggctctaaccctaaccctaaaaatttccccattatgtttctctctcccgaaaagaacggctgcagcggcgattttcacggtggcggcggcggcagcggcgcttgtgaggcggcgccacgccatgacgtcgcttgaggcggcggcagagtgcagcacgggaggcggtggcagcaaggcgcagcacgggaggcggtggcggcagggcacagcgctggtggcggcggcggtagggcgcaacggcggggcggcgcggtgcgcagcggagaggccgcggccggcggcgcctcatgcggcaggctgatgccgcacagtctgatgccgtgccggcacccgccgtcccggttctcctccacacgcagccggggccatggcagcgaggctcaacctcgcgcggctaacgggaggcaggtgcgaggccggtccaggacgacggcaaggacgtcaacgagcgcgcgggcgagctgatgccacgcgcggcgacgacaacgtgtttgtaatgccggtaagtgagttgctaatttggggattttagggttctaatttggggaattatgtgattagggtttctgaaaattttggggaaatttggggattgttactatccgccgaaattcacctccttctaattgctacccaagccctaatcgatcttggaacgtaaacctaaacttaataaaccatgagcagcgcttaatggaaacataatccgaataaaacatgattaattcacattaatcttaatgtaatttgcatcaaaaaccgacatggaaatgaggcttagatgcatcttatggcttctaaacaggatgatgggatcattaggctatagcagtggctctgataccaaatgtagattatgtgatctactaaacataatttgctaagccgatacatgatcaccctaatgcggaattttaggattacactgaccgttgtttgaagccatggatgtgattctccctttgttgtcaaccggactggaagtaggggatcgagaacctcgaaccacctcctcacttgtcggtgtaggtgaagtagatgtagcagtagcagtagggacgccggcttgatcccgaaggggtcgccggcgatcacttgcggggtagtggtggccttccagtcgccaccagcactgtccctgaaccgcctcacgtttcccctccagcgccaatgttgatcggggtttagggtttggttgtcggggagattgagaccgagagagatcgtcatccctcttgggccggcctccccttttatatttagcgctatagggaatcgggggtgactcaataggaaataaattgggcgccaccgatcacggcgtgttagttaatcgggaattaaaacggattcaatcgctgtgagttcacgtagacaacgggtggaaaacggtctagcacgatttcctcctagcgcgatctcctaccggttttccaaaccgagagattaattttcccgacagacatgagaccggatccatttgaaaatagactttataagctttccatgaagtgcttgcactcccaaattggagttcgtatgaagtcgtggcggtcgtcacatggtgctttccttcagtccgaatccaaaccgcacgaatactctccccttttgatcatctccatcattcctgagtaaaacaagagcccatgcgtctccggggtataaataagatgaacatgaactcaagaatgaagtcacctgatagttgagttgatgtgcacaagcgcggacaataggaccatgaagttgtacttgtagagacgtggatgtatcgatggtgttgatgtcctcatcaattcctgctattcacatagtactatatagttttcttcttgatggaagtgtcaaatacttactaggaagtccccgtgggtaatcaccaaatgttctagtatgagtaaatctagttccgggtggtcatctagtatgggacctaagagaagccctttttgtatgtgtatgtcttacttgtgtccaaatttatttaatagtactctagacatactgtttttctcagttaatgggataacaccgttgacattagacatgaatatccctctaacgggtgaagtcgacggtgatgccatgaaatctttgccccgtatcatagaggatggcataggtaagcatgcatgttgaactataccgataacagtggactcccaccggggccaccttatgtcgaaactagatttcgtcaatactaaaagggggtggcgaacaagctatgaaagtggatgggttaggaaacaacggatttatacaggttcagcccttctcgatgataagtaataccctactcctatccgaggaaatattccaccgatcgtggtatttatctgatgatcttggatgtgattctcccctcagggcacccccgacccctccttatatgggctaaggagtcgggattacaagagagcttatcccttacgatctaagttctatatatactttacaattgtaaccgactaagactacgggatacttccttgacatagaagttaacataacacccgagtccttatctttacatattttgttactctgagttacccccgatatccagtcaggtaacgtagccctgtgggtatatggtacccataatctccacagtagcccctgagagcttcatagatgacgagacaaccttctcccgagtggtaatgatcttttgacgagtgatttcatgaagaattcgagtacttgaatcatcctcaccacaactcccgagtacctcaatcatctcaagctatgaagggctaaaaaagaaaaaaaatctaggtgcatcgactagatgcaccaaattaggtgtagccccccgactatatgattagttgaacaacctaaacatatagtcaataaaaaaataaacaaccgagtggtttataaaaaatatagtcaccaaaatgattgaatcaattagaaagcatatgcggcttaaatcctcaaaaataatcataattcattggatataccgactgcttttgatatagaaaaacatttagcctaagcataaatgctgattttaataatttacttacgtgataataacatttgatatagtaataaaaatgttgtattaaaccccacaacttttgcagcttataaagaagcccacaaaataagcataacaaagctataaactatagggtaccttttaaaattcatcgtagcaatttcctaaggaattatctaacagcggtataaaaagatatgtaacggtattgggtaattgatcacgtacaaattgccgaagcagagtttgctgaaatcccaaaggaacgtgacaaatcacaccgaaggatatgggctgaaaacactatacgggcctcggcccaacactgttttccaataccctaaataaaaccgccgaaatgaagtcatcttcctgcgctgcttcgtcttccttgcagaatcccctcacaaagcgttattcaaaccttcacgccgccagagttagggttcagatccactgcagcattcgccatccaaaaacaacaccaactgcacaaatcaactacgggcgaacccatctccatcttcccccaaacgatttagcaacaatcccccgcaaccctctcaaccaatctcacggaaatggcagaggagagagaattggctcaaagccagtgggctttgtctgacgtcaaggaatctaccttgttggagatggtggaacactgtgttcttcccagcaaagagatcatcggttggcatctagcattcggtgaggccttccccactccggacaccgacgaaatcatggtatttactcacttcttctactccggcttcgctttgcccacgtctgatttctttcgttgtcttctggaattctacggaatcaatatttatcaccttaaccccaactcaattcttcacatttctgtcttcattcatctgtgcgaagccttccttggtattcagccccattttattctttttcgctgcatcttcttcctcaaactccagcctaacaagagaaatccctgtctggttggcggatccggcctgcaactccgcgggtccctctccaaaaaatacttcagtcttccttttaaatcatccaataagggctggcattcgatctggttttacatccataacccttctccttctctacccgagtactcttgcactcctcctgtctataatgaaatctggagttcactcccgatgggagacgagttatctcaagccaaacaccctcctggaaaaaatgctgaaaatcaaagagcagggactgcaacgggagcaagtcacctggcacttcatcaaatgctgactagctctgataaaagagaggtcaaagcctgccttcgagtacaagggccaaactgtcccaatcatgaagaccccgactcactggacttcaagatcacgaaggctagaatgtacacgatcttctctacgggcattgaggtagactacagccaagggctgcctgttacccctttcaacatattcaacctgcctccaaaggtaattgtcaacaaacttctgccttcttctttcagtcggtatcataaattgtaattcgctttcttgattgttgctataggaaaatgctctttacagctctaagccattctcctcgctaccaaacgactaactgaccaacaggtggcccaaccatcaaccctgccggccaagaaaaacaagctacgggcaaggatagccaagctatgatgaaccctgagttcctctcgacactcaaggctgttgttggcctgatctttcggtgagtactgataactacgatttttggagaagacgttgacgatccgactacaaccgtacgagacgttatgttgcgccttagcgatcgatacacctctccgtgggatgttgatcttgccgatgcaaatcaaccttattcctgcaagcaaatcaaagaaacaagcaagaacaagataaaagcaatctgaattgcaaataggaatgaatacacaccataagttggggttccgaagaacaagcagacggatggtctagccgacacacgcgctgcaagcaagtagcaatggctaaactttaatctatcaaaaccaaagaaacactgaaggggtacctaactatttatagtggtgggaggacggtcgtcctccacctggttggggcgcaccccacatgggccccacttgggccggggtcccaaacaaagttacaagcccagaggcccaagataggtgatgcagcaccttgtttatatgattgcggccaaatgacttggaatctggcgatgaggcaagatccgttggaaagagggctccgagagctttccatcaagtattcacgggccaaaaacaaaggtcgtatgcagattcgacggccatttgaaatcagcagtatagcaggtggccgaatcggattccagcacttggaggacttgaacttgatatcatgctgttcatccatgatgtgagcaatggttgtatccatagtagccatggtcccatcatcctccccttcttcacggaaaaccgtcctcggtttttccatatggtgctcatcacgtggtcgatttaaaacaacctgtttcatccaatcaaaagaagacaaactcgaagtaatatgattagaaataacatgtctctctagcttgcaagttttatccacatgtacaggaggttctaaatccgagcatatataaactctatgcaccaaatatatttctctatcattatattcgccaaagatatgaaaaatagcattagttggacatggcaaataatatttagcaaataatttctccttcaaactatcgagctcacaaaaatcatcacactgaacatagcccaaagtatttaaagaagaagtcaattcacattcctctacttcattagcaatttgaataacatgcttaaaatcatcgcataaagaactgacattagaaatagcatgttcattcactagttgtggcattgatataagtgaagcattatcacacaactcttctttatcacaaggaacaacaaacaaatcaacttgtgacaaaggaatctcagcagttggttacactaatggttgctctactatagcatgaaaagtggataaattcaattcattaacaacacactcaccttgattaatttcagcaccattaagtttacctttgatgccctcttcagatgatggaggtgcctcgactttgagtgtgaacaatgggactgacggctctttcatgtctctctcctccttgttgcagttgttcacttcctgcaaaatattagtaataggaggtacgtgcacaacttgtttcttgttcacatcctcaattggtttttccacatggcaagcaagttgtaacaaatgagcaaaagagctataactttgacaaacaagcatgtcctgaatttctttattaagcccacgtaaaaacctcaactctgtagcttcttcgtactcatctaaactacaacataataaacaagcataatacatgggaacataaacatctctgaaata

SEQ ID NO: 30235 - DNA, 3747 bp, Oryza sativa
cacttggaggacttgaacttgatattgtgttgttcatccatgatgtgagcaatggttgtatccgtagtagccatggtcacatcaagctagctccaggaagaggccaagaaaactgatcattgacgacgatgatgaagactcggacgaccaaacgattggcccgactgcctttgcccagaagaaaccagccgacagattcgtcccctaaatccaaaaatcttcaaggtaaagaaaaaacacttcttttgacgcataacacttgatggtactgcaatgaaatcaatgaatgtctcttctccgactttagaaaaccctcgaacatagatccgtctggcaagacagagattctggttgccagatcagagacagttggtacaaaagaatcagacgccaactccaacccaaacgctgaggaagaggcaaggaaaaccagcggcgcggctgataacaagcccccgactggaaatcagtcggctggcgccaacactggatcgaaccaggagcccctggctgaaaaccaatctggtggagaaaaccatgacgaccaaataccaagtttccaagagaaaacatctagcccaccacctgcccaggaggaaaaaaccactgatccagagctcagcggtggccctcatcacttccatgctgacatcatcaccggttatttctaaaattcgtcactcgtagcctctcacagtctgctttataaagacccaataattagagaaaaagaagaaatcttccgaataaaatctaccaaggactctaatcctcctggcaagctgacatggagagattttcgtaggcggatgacaaaatcaagccccgtcaacattttcgcatgcggtattttagtctcatctaaaatgtccgcgtgcgaaaacaaaaggctctattatgcgaaaatcattttcctaccagtgatttaccgattagcttcacacaagtgttctcgatgcccactgtcgaaagaacggctatgatttgaagtcgttattaccttcatagagggtgatatcgaacaaggtcaaataatttattcgtcgaattgcacagacacattgcttaatcggcacttcgaactagtgatttgttctcgaagaattcaccacaagttaaaaacgctagatccaaggtaattaattatttaaagtaaatattggttatctgagctagcatcccttctcccgtacttctagcttttgggatcatatatcacagattaataactaattgatctaactggataacaatgtccctagatcaattttattttaccgtccgattaaatagcctatggattcaggattatcgtaggaatgttgaatgttttttaaaaacttaatttaacagcatctcttatgtttttgaaatcaaagtattaactttcaaatatttaactcatacatttgtaatctccattaattgtcataaactcgaactttttaggacgcatcactactcactcacgtatatagtcatgtttttttgtgagagcgatgctttggtactctactggtagtattatcctaccattaaaaatatttgttactaagaatatatcagtaaattactaatacagtgatatattagaggtaattttgtcatatatgttttttcctaactagattaatatgcggtcatccattgcgttggcatcgctttccatcggaaaagccaaaaaagatgggaaaaaaggtttagtcactgctaaataataattatacctattcgcacctttttttcaataatatgtctctttatttttctactaccgctaattagaatagtagtataaatccgaccttttcgatcaaatgaaatcaactatgtatattttttttatactagtagtagagggcatcatagtggagcttaattgcaaaccgggaactaattcgaagaatctgcgcacatcgatgtgcatcaagtggagcggcaagacgattaatttattgaacaacagttaattaactaactaataacataacatcatcgcttaattcatactcctaccaacatgctgcacacggtaacagatataattaattaagctcacacattaacacagcacacgtcaactacgacgtcatcatattaagcttttgcttccgacgcacgtacacatggcaatgcgcgcaaccacatagtcctcacggatgcccgccagcgccgccgcttccggcaccgccgccaccgccgccagccgatccttcctgccctgagccggacccactccctccgccactgcccgtgccgccgttcgcgcttccagagccctgcccggtgcccacggcgttgccggaacgtccagtcccgctacctccgccggaagcaccacccccgccggatcctccacctgcgccgccaccgccaccgtgggtgacggtcacgccgccagggccgatgtgaatgcctacgccttttccgccgccgccacccacgctgccgtcggccgagctcgcggcaccgcctccgccaacgccgatgccgacatcgacgccgcctctgcccacgtcgacgccgaccccgacgccgacgcctccaccggcgctcgagccgccgccacggctggtccagacgccgccgccaacacctccgccgaacccgatggtcgtgtcggacccgttgtgcgacaccatccaaccgaaaccatggccactgccagagccactcccggacccggcggctttactcgggaacggcagcgagaacttgctgccactgacgacggcgccgccgctcttgtcatccgggaaggtcctcgcggcggcaggcgggaacacaaccgccgtaacacacaggagcgcaaggaggaaaaaggggaaggcactggagctgctactactaccactagagatcgccattgttgaggtcgtgtttgtttgatgtgtgaagctctcgtcaccccaggtggggcttttataggggattaggtatcaacaagtcgcggtatttgggtccaaatctagaggcagagatgagcatatgagctactaggttttgtggcagcttgcgtgtggagaaaaaaacctaacttagtatatatgcggcttgcatgcatgcctgtgtggcgtacgttgaccgataattcatttggatttagcgaattaaatgcgaatttaaaataaattatggacggtgtatgaaatattcatggagtgtagtttaagctcgacagtgactgatttgtttgtgttggccatttgggtggcatccagattactgttgcgtagcttaatcacgccctggtttgtgtaatttacttacaaaaggtatggacgtaactatatagctagtgatagctggttttagctattacttcatctataagagacaccatcaacctatactttaaatacaattttctcttaaactactcatccaatctacgatccgattacaccgttgtgttcgtaacaattaaatatttacaataagatctcacatgattatattttgatgaaaaatcgcaaattacttttaagatatatctaaattacttttagatttcactaagctacttcttagacatacaaaagtaaattcagtaaagcttaaaagtaatttacatatattatagaagtaacttataaaaaaagaaagtaactttaattaataccttttttcattgaacaaagtatcatatatatataagttacttttagattttagatttgattaaaatacttcctatacattcataatgctctaaggtgattacttttattatggacgtaactacac

SEQ ID NO: 30236 - DNA, 5616 bp, Oryza sativa
ccaaaactcctaaagtactagtacgtgggtgtctctggttaagactaattggagatgcctctccaattagatttaccgttttattattgtttttagttaatttcataatttgtgctgattaatttaatttctagatagagtcatgtttttatctctacaacatatttacttcaaatgacatgccaaagttacattcatttttttctaagttacttctataatatatgtaaattacttttagaatttacttttgtatgtctaagaagtaacttagtgaaatctaaaagtaatttagacatatcataaaagtaatttgtgatttttcatcaaaatataatcatgtgaaatcttgttgtaaagatttaattgttacgaacacaatgtgtaatcggatcgtagattggatgagtagattaagagaaaatttcataagaagaaaaaaaaatatgcacaacctaatagcaaaaactacttgcatcttgcatgcatgtctgtaacgctactagtactttccacataattgtccgcgtcgctcgttaagtctaaatcgatatgcctctcgaaatagattttacgaaaaggtatacgtactcctagaagacatatttgtttaaaagcatatttgtttcagttcaaaaaaaccatatatgtttatctacacatatattttggatgtaaaaaatattcgttttattgcttggggtgctgaaaaactcggtttggggctcagctcgaaaaccaaacgagaaccaagcccaaacttccttcgcagctcgagaaaatcaaggcaaggtctcgtttttttacccctattgcgttttcagtagaaattccttgtcatctatccatttgatttttgcctagataagtacgtttcagcgtgggttatagtgtggtgtactcataatagatccgtctctataccagtttgagcgtacacgcacggatgtgtgatggtgtatgcatattcgtatttatttatgtaatttttaacttagaaaggaagacaggagattacatagtggtctacagctacaaaattaacactatataagagtactttcaaatgagaatataatgatatatattaaatgcgtcacactaaatatatatattatttattagttcaattactggtcaaaattacatttgttaattagaaatctgcatgatggaaggcttaaaaatctgtcacatgatgtataagcagttccttgttaattttgttggaaatttggtcataattcggcatattttaatccaaaataacaagataataaacattatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctaaaaaaggagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagcccatttcaagggtctcttctctcagtcacacaatagtttgtttcaccatccaaattcacgggatctctgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcattgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttacaagacttccaggaaacatcgccacctccaagtgtgaacacatatccacttgtggcttttatctcatcagcatcagatatccagtttgagtcactatacccttctagtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcatagggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgttcacaacaaagcctgcagatgtaagtgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactagtgagtatgtgtcgaagaagtcctcgccttccttttgggtataacccttggccacaagccttgccttgtacttttcgattgtaccatcaggcttaagctttttcttgaaaacccatttgcatcctacgggcttgcacccatatggacgctcaacgacttcccaagtatcattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtccttctcaggattttcctcaggcgtttgatcattgtgttctatcggtgcaaagtgctcatggggcatgacagtttctttactagaagtgctaggtgtatatttcataggaaattattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgccttttgggctataggtacatttaccttggccaaacagccccatgttcgtaggtatgagagatttaatttcttcctttcccattcctcgaatggtgttatttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagaaatgcaatgcctcatccttagttttcaatagatacacatagcaaaatctagtgcaatcatctatcagtgtcatgaaatatttctttccccctttagtcaacacgccgttcatttcgcacaaatcggaatgaacaagttctagaggtgccaaattcctcacctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaacccttctctacacaatagagagccgctaactagattcttctttattgaagggacatgctgcacgttcttcagctgcacggtctttcccgaagtaaacttcagatcgaccgt

SEQ ID NO: 30237 - DNA, 28259 bp, Oryza sativa
atattagcaccagtgtccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactatagaacggtcatcgaccatcttgtagtcatagaactgctccataacatacagctcactgccggcgtcagaaactccgaacttggcctcaagtgcatcccacatttccttcccagaaggcatgtacatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaggcatgtggtttcagtgtagcagcaaagccaactaccgaaaatgacctatcaggtttttagattgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcagaggcctactctcccaacgcgtgtgcacacactcgtcgggatgggatttccgtagcagcaacagcttttgaaaatggatgaaagtgtgtcttcttcttttagcgggagatcaaatccattctcattttataagaggaatggaagatgaagagtaagagtcatgcaataggaagaggaatggagcaactaattgtcatcaactagccatgaaccatcctccactacgcaaccatcaaccgacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaaattttacatagaacattagttaaggacacattatattttgggcgggatagagcaagtataatctctattattttggtaaaaatatatgatatgggtgataaaagaaagattgggagcctcgattattttacattaattacgttagaccaacaaaaacgtgcatacttacagctgcaatttcatttttctatgtaaaatttatactttcggaaattaagataactgattaatattctatttccggactgtcatgcacttcggtttctttttgactttagatatggccgtgccttcgctttcaactgaatgtataattttcttgctaaaggtcaacccttccgaaagtaggataaaaaattatcagcgtatatattaacaaagtcagatacaagagttcgacgttcaactgactaagaaaacaatcttctgccaagttttccctataatttgccttttccgcattttctcgcgcagattatatcttcgtttgaccttacgaacccgatttgttccaaacagttatatgtacgtatcaattttcgatgaaacttatgaagcatatatatatatatatatatatatatatatatatatatatactagtatggtccaaattaagaaagatgaactactgttcagacacctttctgtgaacattgtttgtttatatactataaaggctgtgaggtttagaatctctacctaattaaccagcttccagatggatatattttgtactttccacggaccaaacttttgaccgtcgattttaccaactacctccactgaaactgaagatggctgtgaaactgaagaaacaggaagccaatgaggggagagagagagagagaaatgtccaggggtttttcggctagctccacaaggtggtgggctagacgacctgggttcaaagcctcaccccttctaattatttgatattagatccttccctaatattcgagttttaacgaggggagagaggggacaacaatggaaactctttcaatcacccaatcacccaggaaaacatccacccttttattgtaaatatatcatctaaatctctactattataaaaattgaagatgtttttaccggtgttttggtaggcgatccgtatacgagaaggttttaagttcgtttgcttttggaaatacagatccgtatttgagttgggttttaaatccgttcgcttttggaaatatagaaggagccgtatcagaaatctctttaaaaaaattgcatactaacttgacatgattttctggaaaaatatatatccaagcgaattctcacagtgaacaataataataagattaaaacagccttcacccattgcaacgcacaggtattttttctaatagttataaaaagaaaaaaataacagtaagatggagcaatatgtaatatatcactccgcaaagatgtagcttaaaattcaacttgtataaattgtaacaaaaataataaataaactcaaattattatacttatatttacagctaaatttatcatttttgttataacttgtacaagttgaatttaaactttcatgtttgtgaagtattatattacatatttatcgatcatgttaatattttttaagaaaatttataaccatttaattaacatataataaacggatgaacatcgacgtgattagaaccatcttggggataacaggacgaggagacgccgtcttgtcagcaattcgagtcggctcaagtcactcaacagtcaacacattcgagcacaaattggacgaacacctagtcggctatgcgaggaaacaaagcaagaacaaagacatggtttgtgctgccgaacacatcgcagcttgctccgtgccgaacagagacataggcgtgtgaaacaaacacataaacacggcggttaagccactctaataatcgtgcgccatgaccgtccattgtccgcacggaccgcacaatcacaacacgcacgtatgaaaaaacaggaaaacatgaaaaagttgaatttgttgagattataggcatataatgatttaatctattccataaataaatcatgacattacagacgaaaactagcatgaacgcatcattagatctacacatgtaaattacacagtataacataaacagatcaaatatgtacaacatattgaacacgtaccgaggtgggggaaagaccggctgctcggacgaaacttttcgcaggcgtctacgaaggcacgcaacacgcgaacgaagaggaagacgagccgacgcggacgaacagggagcagtcgcgcaaagcacttcccaaaaaccttattgccaccttctcccggtgcaggagtcgaaggcagagattccggagacctgctctcccgatcgcaggtgcacgagcgacggtgcagcacagagtaggaggcaaaccctagattgatttcgcgtgtgttgcgtaaagatggcgggtcggtttatatagagaagggtcgcttgatcagggcgcccgtacgatctccactgcgcgtaaccttaccggataagtcgcgtgtaacttatccagactccacgccctgcgcaaggtgaggaaccaattttggtggaccattcgacgcgtacgtcgtgcacgcgcgccgcctgccctgccctgccctgccttgccaggtgaggcgagcgagcgcgcgtgtgttccccctcttctctccaccacacatgcttcaagtggctaggagggtatcctcccttttaaggaggtccccctctcctagaataagcaaggtggtactaaactccacatgcatgctatcctatgaggtgggcttttgtgattttccagagaattaatcttcgagtgggctaaggcccattcattaattccagcaatcccccaccaaatctcaaaacccactgagatttgccttttccaatgtactgtttatataccagcgattcgatggagaccgattaaggttgaacatccacctagaactccaagctacacttactcacaacttgaacaatagactatgccttgaattgcaagtcttgtgtaagcaagtttcactcagagtcttatctggtactaaaccgtctgtagactacccctcgggtggagcatataagtcatactcctaggtctatagtaagcttcctagaagattcacccaaaatctccatagactgcgaccaacaatcaagctcacaaaggtgagttctttgaagaatactctgcaggacaacatcttcgctaattaaagccaacagaactcattaaggcatagccaacctgccttgtagctcacgagagtacatgcatcttcacttagagagggtatagattggtactctcctctagtttattaatggtttgttcttcccagattctaattcacgggatcttcgatcacatagactgggttaccacgatagtataactcacatgggtctcaaacccatctccttcgatgcattgtctatcacatttcgtgatagtcccttcgtgaaaggatctgccaggtttctagctgtttggatgtaatccaacgttataactctagagtttcttaatttcctgacagacttcaatcgtcttttcacatgtctagacgatttcatattatccttagaactattcactttgacaattaccatttgattgtcacagttcataaggatagccggcaccgatttttcaacaataggcagatccattaatagatcatgcagccattctgcctcaacagtagcagtatccagtgccatcagctctgcttccatggttgacctcgtcaaaatggtctgtttgcaagacctccattaaacagcaccgccacccagtgtgaagacatatccactagtggctttgatctcatccacatcagagatccagttagaatcactataaccctccagtaccgcaggatacccagtatagtgaagccccaattccacagtacctttcagatagcgcattactcgctcaagcacacgccagtgatcatctcccggattagaggtaaatcggttcaacttgctcacagcaaaggagatatcaggcctagttgcactagccaggtacatcaacgagataatgatttgggagtattccagttgattcctagcaattctcttgttcttgcgaagcaacaagctaggatcatcaggtgttggagaaggcttactatcaatatagccaaagcgattcaagatcttctccacataatgggactgcaagagtgtaatcccattctcacctctaattagcttaatgtttaagataatatcagctactcccaaatccttcatatcaaaattttgagacaagaatgatttaacctcatttatcacctcaagatttgtctcaaatatcagtatgtcatcaacatacaagcataaaataactccctcacccccaccatggcgatagtacacacatttatctgcctcattgactgcgaagcctgcagatgtcaatgttttgtcaaatttctcatgccattgcttagaagcttgtttcagaccatacaaagacttcaacaatttgcacaccttgccttcttgaccttcaactacaaacccatcaggctgatccatatagatctcctcatccagctctccattcagaaaagttgtcttaacgtccatttgatgaacgagaagaccatgtgaggctgctagggaaagtagcacacgaattgtggtcaatctagcaacaggtgagtaagtgtcaaagaaatctccgccttctttctgagtatagcccttagcaataagccgagccttgtacttttcaatagtaccgtcaggcctaagcttctttttgaacacccacttgcatcccataggtttacacccatagggtcgctctgtcacctcccaagtcccgttagcgataatggaatccatttcactacggacagtctccttccagtagtcagcatcaggagatgcatatgcttctgaaattgacttaggagtgtcatccacgaggtacaaagtaaaatccttaccaaaagacttagccgtcctttgtctcttactccttcgtggagctgcactgtcatcctcctcagtgacatgttcatgtgtatgttcagtttgttctggtggtgtgattgaactgggaattatttcagatgattggctcgaactactatgtgtatccttcattgggaaaaagctttcaaagaaggtagcatcacgagactccataattgtaccaacatgcatgtcaggttcctcagatttaactattaaaaatctataggcaatgctgtgataagcatatcccagaatgacacagtccatagtcttaggtccaagtttgcgcttcttcgttattggtacattgactttcgccaagcaccccatgtgcgcaagtaagaaagtgatggttttctcccaatccatatctcatatggtgttttgtccttatttctgttaggaactctgtttaacacatgattcaaggtcaacaatgcctccccccaccatgccttaggtagtcccgcagtgtccaacatggcattcaccaagtcagtcagtgtgcggttctttctttcagcaatcccattagactcgggagaatagggaggcatcctctcatgtatgatgccatgttcctcacagaataagtcaaactcgtttgagaaaaactctccaccacgatcagacctaagtctttttatctttctgtcaagttgattttcaacttctgccttataaattttaaaatagtctagagcgtcgtctttcgttttcaacaagtacacatagcaaaatctagtagcatcatcaatcaaagtcatgaaatatcgttttccaccctttgtcaacaccccattcatttcacaaagatctgaatgtaggagttctagtggtgccaagtttctttcctcggcagccttgtgaggcttgcgaggttacttcgattgcacacaactatggcacttagaacctttgacaatggaaaacttaggaattaaacacatgctggaaagccgagacatcaagccaaaattaatatgacataaacgtgagtgctaaacattagcctcatcatccacactgccacaaatatggttcacagacttattgcagaaatcagaaaggaaaagcggaacaggcctccgcactcataacctttaccaataaaatatccatgtttagacacgactactttattagactcaaaaaacaacttaaatccgtctctagtcagacgggagccactaacaagatttctgtcgatagaagagacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccctagtatcaacccaccaattagtagactgattaactgaaaaaacagtaggtaaattaccacacccgcttccatctctagtgttgccaatggtcacattagcagacttagatgtctgccctgcaggtgtcttcatccccttgcgctgtggacacttactagccagatgaccaagttggccacacacaaagcaagtccattcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcctgagctttctcctcaacatcaagagacgctatcaacccctcaacggagtattcctgtctcttgtgtttgagtgcagtaccgaaacttctccaagatggacttagtttcgcaataatgcacccggccacaaatttgtcgggtaagacacacttaaggagttcaagttccttagccatggtttgtatctcatgagcctgttcgactatagaacggttatcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctattctgcagtaagaactccttcaggtttgccagtactcacccagaagcatttcatagctgtcagccatagagtgaccctgatctgccatctcttaaaatgcacaccggtgaatttatccggcctcagtgcattggcaaaaccagccatagtaaaatcaaagtttttggattgttgagattataggcatataatgatttaatctatttcataaatgaatcatgacattacagacgaaaactagcacgaacgcatcattagatctacacatgtaaactacacagtataacatgaacagatcaaatatgcgcaacatattgaatacgtaccgaggtggcggaaagaccagctgctcggtcgagacgtttcgcaggcgtctacgaaggcacgcagcacgcgagcgaagaggaagataagccgtcgcggacgaacagggagcagtcgcgcaaagcgcttcccaaaaaccttattgccaccttctcccggtgcaggacgtcgaaggcagaggttccggagacctactctcctgatcgcaggtgcacgccggcgagcgggatggagtaatctacgagcgacagcgcagcacagagtaggaggcatactctagattgattttgcgtgtgttgcgtgaagacggcgggtcggtttatatagagaagggttgcttgatcagggcgcccgcacgatctccactgcgcgtaaccgtaccggataagtcgcgcgtaacttatccggactgcacgccgtttgcacgcaccggattttggcggaccattcgacgcgtacgtcgtgcacgcgcgccgcctgccctgccctgccctgccaggagagcgagcgcgcacgtgtgttccccctcttctctccaccacacatgcttcaagtggctaggagggcatcctcccttttaaggaggtccccctctcctagaataagcaaggtggtactaaaatccacatgcatgccatcccatgaggtgggcttttgtgattttccaaagaattaatcttcgagtgggctaaggcccattcattaattccaacagaattaacccctcgttttttatacacccttcctcccaaaatataaggcacaaccacttttctctcatgtctcataaatataatgcatgtatacattaactagcacctcttaatcctataaaattgatttattttaaatcctataccatcaaacctcccaatcatattgtttgcacgagtcaaggtgatccaaccaagaaggcgattaaacattttcttggttttttattacgagtggttgagccttctacaataatattgtaggatagagagagtatatctatatgtctactatcataaaaattgaaaattatttcgtcaaaattttggtatgtcatctatagaaattggtttttatatgtttataagggcatctctagtgtgagttcaactgtaccatccatttttagatgatggaaataggttacatctccggcctctgcccgtaggcacacagccaaaaagtccagaagtgaacagaaaagagcttaaaaaaaaggcgagatgggacaaacccactacttctgccaataatatgatctagtaaaataatgtttttaaaatcacgtagattctatcacaaaattctgtaggtactacgccatccaaacaggaataaaagttccttggctaccaattccaagcatagtatcctgttgttcctgtgaaagcatcatacattaagagtagagccaatttgaacacataaagataacctgcatgatgttaggcatttttttatgattaaaaactatatcattacggcaacgccaaattgaccaacatagagcactagctccaaataagattattttttgtctaggcactccccttagccatttaccaaaaataacgttgtggggaggggaatattgaaggcaaagaagacacattgccaagtaaaacgtgcaacatgacagtcaaagaaaagatgttggatggtctcttgtatattaaaaaacaacattgctggtttaccctacattttctctttatgaggttatcttttggtaagatcatttttttaagaaaccacataaatactttgatttttaactgtatcatccataaaagcgaatttcacttctactcggtgcatgcagtgtttaaagtcgatctgcaggacctatgtataaaatttaaaaatgggcaaagatcgacttcagccgagacgtcgattttcattctgacaaataacaaccgactctcacaacgtgcatggttcagttttttttgttgcaagtgtcgatttatcatcacgctggagttgctctaagtcgtctgtatctaattcaacatgagtctagaataactatcatggatccttctcctagcccagcccaacggaccaacaccttccaatgcgcctccactccgcgctgcacgcgctcctcccctgatcgacgtctttttttctttcccttgttttgttttctttttcttcttttcttttctcacagccatactgatcccttctaatctcctctcttttctctttttcctttttttttctcttccaaatttatctcatcaaaaatatcttccttttgaaattattattgtttaaggtgtatatgagacaagtttgttatttgcaattgctttccatttacagtaaaaaaattcactaactgaataatcaaaatttcaatctttggtcaacttatggaattgtcacagaatcgatttgtgaagctatggaaaggtatacataaaaatcatgtgatgatgcatgaagtgaacgcaactggattcaatgctatatatgatttctgactttgttttgccattgttttgttttgttttgtttcaatttgtcgtttaaattgacagagttttatcaatcgtgaaaattgtcttcacctgttgcaacacacacctatttttctagtcacctaaaagtcataaaaaacttgtaaaaaattggtaggacaaattacgtgatacatcactacaaaaatatataagtgcaaattcaacttatataaaaaaatatgcacatctctatggatttgtatgacaaccaccattgtccacgccatatttcataaagaagaggttttccattaccattcttttcttacaacaaaataacttttaattatatatacttgagtgaaggcaaaactagcgcacaaaaaatcatcaatataatggaaatagaagcatgattcaaggactcaaccgaaagttttagttgtttacatgagtgtgtaaattaaattttcttttagatttttaaacccaacacaagttttaattatttagcaaccaaaagcaaatctttaactggttaatcaaatctactaaaaatggcattgccatttagaacttggattatctactgcctgctttgataccatcgtatcaattgtagtgccgagtgctagggcgctacccaacataaaaatccggacagagccttctagtatatatgggatccattagtgactgtctacatgaattttaagcacattagccataagcaggaaattaatgagtgtgtccgcttattgtgagtgccgacgtttgtaatgtgtttaaaaaacggtttggctatttatattgagggtacagagagggctgaaatttctgaaattttagatattttgtttagggaaggcactgtaggggaagcccccacagttaaatagctttattatagaaaataaattacaaaagatataacaaattcaaaagggactgtctctcagaaacatttaatctaaaaactaaaagggaaagatcactcttaaagagagctttccaagaagaaattgagggtgctaaattctggaaaatcagggagttcctctgttaccaaatattccaggctgcataaagaatttgtagcgaggtggtgtggcctttgtgcttgcaagctggaggtaccaaattttagatatttcagtacgaaataatttgaaatgttttaaaaaatggtcgaatttgattttatttaataaattcaaaaaaatttgaaaaaatcctcaaattttgggcaaaatagtttactatcgattttggaaattccactccaaaatattgaaccttgccttttgaatgaatgaatgacccctggaggggcaaaaatacaccttcgattaatgatattgctttagagtttcttaagtgtggttttaattttgatatctcctcattcttttcatctcatctaaatagtcactaaaaagttataaaaaaagttaacaacatagaatatgagatataccatgacacaaacatataagtttaaattcgaattttgatatattaaaaaataacaaattaagctattatatgtactttttaaaatttttcttaggacttgtaaaaagtaaattttgacttatatgtttgtgcagtgatatatcttatattaatatatctttttatttttttaaataatatatatgattatttatgtgacataaatatagaggatatgtcttcttgatagcaacactttttttttcaattgtagcattttggagcaggcaattggcccaaccattaaagaaaaactagatgatgccacgctctttaatgtgggatatttcgataaatatatgttaaatgatggatgaatttgcgaaacgattacaaatcaggcacctgattttttcccaaaaatcgggcgctatttcatgatctttttatgaaaatgtttcaatacttgaaaaaaatgtgtcagcatttgaaatgatgaaacataaccaaatcattcttgaaacattgggctaaaacatatgaaacattgatttcgaaccattgaaacattaaaaaacccatgtgcatcaaagatgaaaatatgaaacactatcaaaatatccactgcaatatttaatccaaacaaaaagaaacatcacaagtgcaatagctgaaacacacaaaaaaaaatatacccggtctgtactacatcttcctcccctcttgctaaaacaggcttgctgagggccaccggttttgtgctctcctccgatcttcgctggagatacacgccgagacgctacaacacactcctgctacgctgaggtgagcaaccgccgcttccctatcgctgctgctactgggaactcggtatgccatcattgtcgcttgggcaaaacggaatccacgccaccaccagatcctcacagggttcgtcatcttcctcccagctcctggcctagctagagctatgctgatgtgcaccggcacgccactgcaaccgcgaggaaccctctccggccacgacaaccatggcctggccgctgccatggagcccatgcagtgatgcttggtcatcatgagctcgtacatgtgagagataaaaggtggctgagaaggaagcgattacgtggcgatatggaataggtggctgagcaggcgcctgatgtttagttagccatcaggcgcccaagcctaatcgttttcgatgaatttagatcgtgaaaatgatgagaaatgatgatttagcatgtttatatgttgagctttaaaatgtaataatttgtagatgatagacgtaattaaagttaagtttttgtatgtactatggtggtgtttgaatctcttgaagatgaagatgaagattaagtgtttcacgcaaaacgatatggtaataatgtgtgattaattgagttttaattattacaaacttgaaaaatggattaatctgatattttagaacaacttttatatagaaagttttcgcaccaaacacaccatttagcagtttgaaaaacgtgccattttaatccaaaatttaatccactcttttaagtggattcaaacagggcctatacatgttgatcttttagtgcttagtgggttgatgtgacctacttgcatgttactaattataattgctatgcttacatattgtgttttacatgtttagtaggttgtaacttcgtagaaatgtataaattcacacatcaacaatcatatgctcaagcagatcaatatatttcacaaggacaggggtaaataaattaaaacttcacatagattgctccaactttaggatgatttcagcgcaattcctaattcgcgcatatgcgcccgctgcgtccacttccagcccacatgacccatgcggcaccgcagaagcttggcactagtttctttcttttttttcatgaaatcaggcgctagtttttttttgggaaatcgcttctttttttctctccacactcgtgcgtgttttgcgatattttataaattcaatatttcaccttcaataatatccattgagagttttgaatttgagttgaaagtttcttaaattaaagttgaatgttttgaattttgcgatgaaagttttcaaatttaaattgagttttttgaatttcgaagtgggagtttttaaatttgagttaaaagtttttcaaacgtgagttaagttttcaaattttgagttaaatgttttcaaatccaagttgaatgtttttcaagtctgaattgaaagttttcgaatccaagttgaaagtttttaaatccaaattaaaagtttttaaatcttgacttgaaagttttcaaatttaagttaacaatttcaaaaaatcttaacttaaaatttcaaacctttgttgaaagtttattgcagctaaacgtccatacttgttccaatttttcgcgtgctaaaaaaataactgatcagagtaattaacactaatgatagtaattagtgggatccgatccactaatcaggaggacgtggggagggggtcgcccattaggaaccccctgattttagacaaatgaggggacatctcctcgagatatcagattcccctccaaaatttacaagaacacggccttcgctgacctgctcatcatccaccttttaattttccttttcttacgcatctgcatcccaattctacccctcgtcagcacgacgcacacgcattggagcactagtgcgttcctcagcagcagcctggccactgtcgcctgcccgtcatcaccctcgtagtgcaccaggttgatctccttcacccgacgccgcaggcaccggatcgccgagaagctcgcgataccaggggagctgtcttcttcgctgtcgtcgccatcttcttcgctgtggctgttgtaaccgatgttgctgccgtagtcatcaccgtcggtgtcgtcgtcgtcgtcgtcgctgtggctgatgtagccactgtcactgctgccgtcgctctcgctctcactatcacagttcgtcggattacatttttctggtttcaagaacagggtgagagactccaggtttggggtcatctccaggatcctcctcatggcgatggctacgccgcaatctgggacgtgcccggtgagttccagccgtcggaggttcgtgaacgtccggaagccggcggccgggaagaggtcactatcgatgcacgaaccgagacgatcaaacttgaggtggaggtgcgtcgagcctgcaaacatcgcgagaaatctttttgcatactgtcgaattcctcctccgaggtgatgagttcctcgctgcagaaatccacagtgcaggaggttattgccagtgagccgtgcatcgaaagagtatacgacggatcgtccgacacggcgcccctgtacgcaattgttgtgagctccgacgcgtcgatggcgacgttgtcgacgttgtggcagcaccggagggcgaagctgcggaggcgcttgtcaagtagggagagggtcttcagctggcggagggcttcgagcgtcaggtcggcgaggcgcgggcagctcgagatcaaccgttggattctgctcctggagccgtggatgccagtcaagcgcattgtcttcaacaacgacaggtcgatggattccagcaggttcaggtcgcagtagcttaggcacagggtctgcaaggcgacgcaggagtagagcgaccgtggaagctcataatggcgcccagggaaaacagggggctcgctgtcgacgatggtggagagtctgtccctttcgccgccggcgcagatcgggccgatccagaagcgcaggtcgaggtggagctcctgcgagctatggcacacgacataggtgacccacgcgtcgacgatgaccctgtcccagacgtggtagctgtcgcaggcgaagtggaagctgcgcagcggcacgtggcggccggcgcagcggcggcggcagaggagcgcggcgttcatccggtcgaggagcttccagctcatgctcttcttctcctcggcttggaagtacatggttatccaatcgtcctccctctcgccctcctcctcctcgaaggagatggtgtggacgtagccgaagatgtatcgccaccggcgggacagtacggcggtgcgggcggccaggttgttggggaggaaggagagaatgtggccgagcaggtcgtcggggagctcactgatccgatcttctccgtccccgccgccggcgatgcgcctcttcttgctttgagaagccatcggtcgtcggctcgtcggttgtggccctaggttcgtgtcgaaacaagatttcggcaataataaaagggggtggctatcaagctaggaaagtggatggatttggagacaaggaattttatacaggttcaggccttcttattcaagaagtaataccctactcctgtccggggatgattccgccgagtgtgttattgatcgtatgatctgggaaaaaagaaattgtcccgagaggaacccggacccctccttatataggggaagagatccgtattacaaaatacagtccatatccctaaaggaatatgtgattacagataaaatacaatcttaaccgactaagatctcgggtatttccttgacatacaagttagaaactaacccgagttctcataaatatattctatctatatttggtaccgtatatccgactaaattataactgtcatgtagatatggggtatccataatctccacagtagcccccgagaccttcgcagttgacaaaatagccttctcgaaacaaaaaacagtaatccgagtgcttcaattcaacttgctccagcttgccgagtgctaaaatcaaagactgtgaagggcgaaaataaaacatggtgcatcgagtagatgcacctaattaggtgtagccccccgactatgtgattagttgaaacactaaacatgtagccaagaaccgagtggttttatagcgaagtatgcatggtactcagtaaaatacccagccgactacttctcaacttgaacatatcaaggataaaaaatacgaaaagggccgagtgataaacactcaaaaggtctaaaaatagacatatttgataggaatccgagtaagaaactcttaaaatgatccaccaaacatgataaaaatcatagtaatcaacgagtctaatagcctaagctatgactctcaccataaccaaattaagcatataacatgctaagagaatgactcttaataaattagtcatctccaatcaacccaaacagcttttgcagcctaataaggcttacaaaaatagtataacaccttcctgtcaggcaccttttgtttgcatcgtgttaattccaaagaattatcaaaccacattaaaaaggattttaacagcattagtccacatcattgtgagcacaaattgccaaagcaaaaagcgcctaagtccctagagatcacaacgggccacgctgaaaataaaattgggctaaagtactgtgtttaggctaataacaccgaagtgaaataaaacgtctcttcgtcttccccgccgagactctcgccattttccccatttcctgctatagtacaaaactgcgccggcaattcatcaatccgctccaatccatcctcaaaaacttcacgaaatttcaccccgcgtccaccgcttcaattccccatccctttccagccatatctcggatcaaattaaaccattcagttcacattcatggcggaagaaagagaaagcttcgagagtcagtgggcgccctccgatgtgacggaaggtaatctgaaggagatggtggcgcacggcgttcttccggcgaaggagattatcgggtggcgaccggcattcggcgaagcattcccgacccccgatacgcatgaagtcgtggtatttgctgatttcttctatggcggtttctcccttccaacctcaagattttttcggggaattctgaatttctatggaatcagcctgcatcatctgaacccgaactccatagttcacatcgccaattttattcatgcctgcgaagcttttctgggcattaggcctcatttcaccttgttccgccgaatcttcttcctcaagccctagccaaacaagagcaaaccatgcgttgttgggggcactggtttccaactcaggggaacactaagccaaaaatacttctccatgcccttcaagacctcaaacaaaggctggcacgccaactggttctacgttcaaaatcctgaacctgcccttcccgagtactcttgtctccctccggtctaccaagacacatggaattcattgcctataggagatgaggctgctcaagcagtggaactgatggagcgcatgataaagctgaaggagcagggtttgcagggagaacaaatcactcggcacttcattaaaagccggttagctccaatcaaagagagatcccgcacagcttttgagtttgacggcaaacatgatccaaatcgtgcagatccagactctcttgactttaaggtcatgaagaaaaggatgtacaagatcttctcaaatgctatcgtcgtcagttattcgcacttgctgccagtcgtgccattcaatgccttcaatcctcctccaccggtatgtaatcaaacacttaaacctttcacaaaatatggtcttgtctttttattgaatcagttaacaatgaaggatattacgcccaggaatttgctttgatgaagttggatcccccaatcactcaacgccgatcaccccaccaccaaaccggtcaagggagcgggggtcccaaaatccgttccgaagcccggccaaatacctctaatccagccggccagccagattcacgcaaaaggaagttggtgtcgagtgacgatgaaggcgataccgctagaaagcctggagaccgagaaacaaccaagaaactgccgaagcaggctactacaaggaaaaaagcatccagtcgtccagtgccaaagatcaggaagtcttccaggtacaaaccacataacgatcttccttgcattgatgtgtacccagtgtagtaataatactgataaccaaacttgtaggaaaccgtctgatatagacccttctggaaaagactctaacccaaccagcacgggaacaaacttaaaagaaaccgagccaaccgctgaggatcatccgagtgataaccagccagcaaccgataatgtaggatctggtgatcaacccccaaccggaaacgagtcggccgaaactggagccggggttaatcaggagcccccgactaaaaaccaggcactgggccaagtcaagagattccagaagttggagctcaggcagacagccctcgtaaagaagacaccagcagtgacccaacgccaggatctcccgttaagacgcaagaatcgactcatccccgtccggaaatcatcacgggtaaacaccttgcccgaaaccgtgttgatccaaatgactctaaccaatcgtctaccctttatacgtggatacattaggaccaatgattggtgatgaagaagaaattccccgtatacaggcggctgaagactcacgccctcccatcctagttaagtggtgggacgatgatatgcaacctcaaggaatcgtgataagcaagcagaaagaagatgaagaagtatgcttgttgaaaaaggcactcagccaggccactcgtattgtaaatgtaagtccatttgtgcatagttttaattgtcccctttcatatcttgctgaaacgccgataaattcatattgcagagaattcatcttagaaatgaggcgaaaaccacaactttggagaaattagttccccatcttggaacccttgaagctactaaaaaccagctacatgaggtcaaagagctcgcgagaaaaactgagcatgatctaaggaatagaatctccgagcttcaagaatccaactatgaattgaatggttcgtccaaaggtaaataccatatctgtctgacgtattcgcgaagccttccttgtcatatcaattaaccgaaaagcattacagtacaagctgccaggatttccgacctagagaagcaggtcgaggccctggagaaggacaaggccgaattagcaaagcagagggactcgaccttaaaagatgttgaaggtaatgataattgattccccatgttcttatagccgctcgctgatatgaatctattgatgaagatcgcaaaatcaagtcccaggcacagtttgatgtcttagttgacaagatcaataggcttgaaggggccagggataaagtcgctaatgccgctaccccactcatccaagccatgttcttcaataacaccggtccaagtgcacttgacacttccgagatctttgacaagctaagagtcgctccagatacttacttcaagaatatcagggaggctgggagtatgggagcaagcctggtgttggcgatgaccaagtccttgtacccgaagattgatattgacgccattgacggctttgcagacgggacaagtgaagaaacagccctcgacctcatcaatgatgcgcaaaaagccgctgacaagattgctgctgacgtagttgagagattccaagatgtcgaccttcggccgactgggtctgataattccgatgatgaaagaactgacactgattagtaacagtgattctgattatgatggaagatcaatttgtacaatactgatgaatttatgctgtgctagacatttctaacttagcctctaatttcttaaaagtttttgtcaaaccttattgagcctaaaactcacaaaagttattaaaaaactttcagtcctgattgactaagccaaaaaatcaagcagggcaatgataaatcaagtaagcaaattgaattgataaaaatcatgttccattattattatagtagcccccgactgataactcaagaaaaggcttgatgttagcagtcaaagagaaaaatacagaagtaatgtctaagcataaaaatgatgaagatgttcaatattccaagaattgttgataagagtaccatcttcgcgcttgagtcgataagaacctggccgagtgacttcagcaattatgaacggtccttcccacaagggagataatttatgccgatcctgtgtggtttgaattttcctcagaaccagatcgccgactaaaaaggctcgtgatcgaacattgcgattatgataacggcacaacccttgtaagtaccgagctgactggattagggcggcttcgcgggcttcttccagtcggttgatatcgtccgcttgatcttcctcatagcgctcctcccggaagttgcgaaatcgaagggattcaaactctaccttacttggcaacattgcttctgcgccataaaccaagaagaacggcgactggccggtagcccaactgggagtagtgcgcaaagaccaaagtatggacggcagctgttctacccacatgccagcatagggacgcagtcggtcgaaaactcgtgctttgatcccttgaagtaccacgccattagcgcgctcaacttgtccgttactcatggggtgtgccacggaggcgtaacaaattttaatgccaaaatcttcacaaaagtctttaaatactccgccagtgaattgagtgtcattatcagtgatgatacgatttggtactccaaaccgatgtacaatattgatgaagaaatctttagctttttctgcggtgattgtaatgaccagtttagcttcaatccacttggaaaatttatccacagctacaaagagatgagtataaccaccgaccgcctttttgaatgggccgaccatatcaagcccccaaactgcgaacggccaagacaacgggatggtttgcagctcctgagctggtaaatgagtttgtcgggcaaagaattgacaaccctcacatgttcgcacaattttgtcggcgtcggagacagctgtgggccagaaaaaaccctaccgataagccttgccgacaatggttcgtgcggcagcgtgattaccacagatgcctgaatgaatatcttttagcaattgtcttccctcttccaaagatacgcagcgctgcagaattcctgatggacttttcttgtacaactcggtctcgtgaatgacatagagtctgctgcgcctggaaatctgctcggcttcatttttgtcttgagggagttcttgtttggtcaaaaatcttatgagaggttctctccagtcggcttcaatcatgcttacgccttgagtatccatggtttcaattgtttcttttctgggcacggttggttcgtaaagatgttcgacgaacacatctgaaggagctgcttcccgttttgaaccaaaattggccagtctgtctgctgcctcattattatgtcagaggacattggtgagctcgagtccatcgaatttatcttccaacttgcgtacctcttgtcgataagcggtcatattatcatctagacaagaccactctttcatgacttgattaacaaccaactgagagtctccacggacgattaatcggcgaatgcctagagagatggcaatccttaatccatggagcagcgcctcgtattccgccatgttatgggacgcagaaaaatgtatccacaatacgtagctcaatctttctccagtcggggaaattaaaacaaccccagctccagtgcctgtaagcctcctcgacccatcaaaatgcatagtccaatattccatctttttctctggcatgtcttcttggcactcgttccactcggcgaggaaatcagctaaagcttgtgacttgatcgaagttcgtggcttgaaagatatgtccaaagacatcaattctaaggcccactttgcaatccgtccgtttgcttcgcggttatgaagtatatccccgagtagaaacgatgtgaccaccatgaccgagtgactttgaaagtagtgagataatttcctgacggtaattaagacaccatatagtaacttttgaacctgaggatatattgtcttggagtcggccaaaacctcgctaacgaaataaattggtcgttaaactttttgaatatggccttcctcttcacgctcgacaaccaggaccgtgctcacaacctgggaggtcgctgacacatataacagtagcggctcttgcggatgtggcgaggccaaaactggtggagtagtgagaagtttcttaaagtcttctaaggctttttgtgcttcgggtccccactggaaattgtcggttttcttcagcagcttgaaaaagggcatcccccgctcgccgagtcgtgagacgaaccggctgagcgccgccatgcaaccaatcagcttttggacgtctttctgggagcttggcggtttcatgttgaggatggcgttgattttctccgggttggcctgtatgcctctacgagacaccataaatccaagcagcttccctgacggtactccgaagatgcacttttcagggtttagtttcatcctgaaagcgcggatgctcgcaaaaatttcttctaagtccgcaatcagatcatccttctgcttggtcttgacgactacatcatcaacataagcttcaacattgcggccgatctgagttgaaaaacacctctgaatcatgcattggtaggttgctcctgcgttctttagtccaaagggcatggtgatgtagcagtaggccccaaaaggcgtaataaatgaggtcttcatgcagtcggattcttttagtcggatctgatgatatcccgagtagcagtccaaaaaactgagtagctcgcagccggccgttgagtcaactacctgctcaatgcgaggtaacccaaaaggatctttgggacaagacttgttgaggtcggtataatcgacacacatgcgccattgccccgtctttttccgaaccaggactgggttagccagccagtcgggatgaagaacttctttaatgaagcccgctgctaacagcttggttaattcctccttgatcgcatccttcctgtcctgtgcaaaatggcggagtcgttgcttgatgggtttggcgtcttccttaacatgtaaagagtgctcaatcacctctctaggaataccaggcatatcggatggtttccatgcaaagatatccttcctgtcctgggagatttgcgtccgaacttgtcgactaggtcctcgtggcgaatgcctttagtaaaggcggcgatgatgacatcgtcggttatgtcggagatcttgttgcgttgctcggagaagcatcggatgtaatctcgaagggattctccagacttctgaatgacgttgtagagatcaaactgtgtgtcggggcgttcaaaggtgccctggaagttggcgatgaagtgatcacgaagttctgcccatgatcatatcgtgccacggggtagtccatggagccaggatcgggcggaatctgctagggccacaggtagatagtttgccatggccttgctatctcctcctgctacacggattgcgagtccgtagacggtgagccaagactctggattagtggtgccgtcatacttcttgattccactcgacgcaggtcattagtgaaggcaactactccatccacgtcgtcgtcgtagcgatctggtgaatggcggtgacctcgtgctgcacggcgctggttgatcatgtcgcgaagatcgacgggacgctggcgaggtggagagcgaggctgttcaactcggcgttccctgtgacattcgggaggcgagtgaacagatcgttcgtcgtggcccctgctcctgcgactggatcctgtgccgatgatgctgaggcttggctgatgataatcatgagatcggagatggggaacccggctaccagtcggcatgcgaacgctgccggagttaaccagaactgaagcggcgatcatggtcttggtctggttcaagatgttgacgacgtgatcggcttgattgagtgcgtcttccttgaggagggtgtcgagaagggtgatcgcagcgacagcgttctgttggggggtgcggaagaccgctgtcccctcaacctctttttgcccgatgagttctctcgctcatcgcccggattccaaggcgcgttgccgtcgatcttcagcctcctttgcaatccgttcgcgatcttgttgctcacgctgtagtcgttctcgctcctgtcgttgtcgttcttcttccaatcggcgacgttcagtttcttgccgtgtgcgctcttcctccacttctcgggctcggcgctgttcctccgtttcgttgtcagccatgaatatgccgaaaaagagaggcgtgtagttatcttcgtagctgtcgtcgaagtcgtcgaagttgccgtggtcgtagtggtagccgaagtcgtcgtagtcgaggatctcggttggtcgtgaactgacgccaggggagctgaggtagccatccaattcttccgtcgagactgtcccaagaggttggagtataacgccaacctccctagagctagattggatcggggccgaagccggatctcgcctagatcgtcgggtggggagatgccttggtggtgaagacagcggccagatcatcaggaagtctcatcaggattaagggataggacccgtcttcttgatctggtcgcggaggagtagattggatctcgtccgagtggtttgaagccgacttgggagagatgatcttggagtaggcctcggcagagttcggaataccgaacagcgcggggacctggtctctccccgactggttcgaatccgagtcaaggagagagatcctgccgaggtcgttggtcatgaagttgaggctgccgaaccggaacgcctgcccgggagggaaggcgaaatcgtcgatgccggagacggaacccatcgcacttagtcggcaaaaacttgacgctgcccctacctggcgcgccaactgtcgaaacaagatttcggcaataataaaagggggtggctatcaagctaggaaagtggatgggtttggagacaaggaattttatacaggttcaggccttcttattcaagaagtaataccctactcctattcggggatgatcccgccgagtgtgttatttatcgtatgatctgggaaaaaagaaattgtcccgagaggaacccggacccctccttatataggggaagagatccgtattacaaaatacggtctatatccctaacggaatatgtgattacagataaaatacaatcgtaaccgactaagatctcaggtatttccttgacatacaagttagaaactaacccgagtcctcataaagatattctatctatatttggtaccgtatatccgactaaattataactgtcatgtagatatggggtatccataatctccacagttcgtgtgatatggcgtgttatgacgagcagaagggttttgtttgtatacccgaatccatagtggattacccttgtcgcgcgcggaaaagctagttaactttttgggagttaacgtagttagttacttagttaaggataatgacaaaattaagagaatacttccttttttttgagtttttttactaacaaattgaaaactttcaagttagatttgaaaatttttgacttaaaatttaaactttaaagtcaaattttgaaaactttcaactcaaactttgaaaatattcaactcaaaatttaaatttgtaagacattttgaaaattttcaactcaagatttgaaaactttcaacttgagatttgaaaacttttacctcagatttgaaaattttcaactcaagatttgaaaacttttgactccagatttaaaaactttcaacccaaagatttgaaaatacgtgggttgaagattaaaaaaaataaaaaaacgaaaaaagaaaaaatgacaaaaaaagaaaatcgcaaaaagaaaaaaaaacagcgctggaggtgctagctggcgtgcgcgacagcaacggaggtcacacgcaccaattagcaatccccgataacaatacgtatgttcggccgtttgttcagccttgccccgtccgggtaggaatatggctctgcttaatgctcatggctacttgat

SEQ ID NO: 30238 - DNA, 2682 bp, Oryza sativa
atcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgacgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttcccttattgacaggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtttttcagagggcatggctagcaattcctgaggctagccaatatttagcatttattttttttctggaattaactcatcagtgacggttcggaagaaacatccgtcacaggtaacttcacctgtgacggactcgcaaacgtcggaccgtcacaggtgacccacctggtaccggcttttactttcgggccggtcacagttgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgggaggcggcggcggcggccacgacgagcagccgcctcctcggcgcggagtcggacagaggcagcggcggcgggggacgcgtaagcggcggcgcgacgggcgggacggacgaacggcggcggtagcggcgaactacgcgagcccgcccccgctgctggcctcctccaggagctcaccgccgcgcgacgccttcacggcgagcgcctagacgaaccccaccatcgccagccgcctgttgatcggctccggcgccggcccgctgaacgccagcacgtcccacagccccgtgcttgccgccgacttcgccttgggcaccgccgccgcggggctcggagtcggggtcggggtcgacgatgtggtcgtctcctccttcgtcggctccacctccggctgtagatcgatcgaacgacgacgacgaagtcgccccaagttagcacacgaaacaaatcaccagaacacgcacagtgaaaccaatcaagaacgctcagctcacctcggcttgggccctagcgacgaacgcgacagcacgccggcgaggcgggaagccaaccgcggcgcggccggcgccgacgacaccacgccatggcgcgccaccagcggcggcagcggcgaaggaggagctcagcgccatggtagcagccgccattgttgctaataactcaaattacacagctgatgaactcaggcgagctagctagatcactcttttttctttttcttcttttgctgctgctgctgttgatgatgaggcgggtgacgagacgagtataaataggcgggggatcaaggaggaggtcacgagggcacgcggcgaggtggggagtggtggtggtggtgg

SEQ ID NO: 30239 - DNA, 16964 bp, Oryza sativa
ctccgtctccgtgtcccgcgccgccgcccacaccagcctccatccatcttcgcgccgaggggcggctgctcgtcatggcagtggccgccgccgcctcctcgtcccccgccgtcgtcgctgcgtcccccgcctgccgccgagtcgcgccgaccggcgagaaagcgagaggaagagtgtgagaggagagagaggagagagaggggagtatgacaggtgggtactatatttttttaataaataaaatgattactggactgccacgtgtacgccgcgtaggacaaaaccggtctgtattaggtcgaggggggtaatttgtccggtattaaaagttgagggtgaagaatgtctggttttccggatcagggggtaattcggacgaccgcgatagtttgggggtaattcgtactttttcctatatagaaatattttgctatttatcggtcatcagattttgatccaattcttttaaaaaataaaacggatagaaactatgcaaatatatcaccagtggatatatacagctaaatatcacaagtgcttagaccttggtttcacagaacatcaacaaaagaaaacgacaagaagaataaacattgattttttttctcgccgtgctatgctgccatataggtaatgatatttgctcccttgctatgcagcaacaaacagtttttttttttcagccggctaaaagttccactgcaattaaacgcatgtgaaaattatttttttcaggcagacacactaagcaaccctgatgtgtgaaaacctcttggatggaaaagcattggggttcggtgcttgctcatccgaacatactccaaactggtggtaagtcatgttgacaaatcttttgaggcaaaagaagaaggcatgaagaggaatctggaggctgttcgatctatggaaaagtgtttcgccggcataacggtcgaacatttacctagagaccggaatgaggaagcaggcgccctggcgaaatccgctgccagtggaggcccacattcgccaggcatattttttgaagttttgtacgcactaagtgtgcccacagagagcctggacatcatggcatttgaccaggcagaactgggcgaagacccagaggactggcgaacaccgttcgtgaagtacctcaagaatggtaagcagaagcaaagcgcctacagctcagagccacaagatcaagctgacttcggggcagttgtatcgctccggggtgctccaacccttgcttcgctgcatctcctttaccgaaggcgaggaaatagcgaaagaaatacaccaggggttgtgcggtgcgcatcaagccgcaagaacggttgcctccaaagtgtttcgctagggcgtatattggcccactgtgctgaaagtttgtgtggagcaagccaaggaatgcgaaagctgccagtggcatggccgaaaccagaaagcaccccagtacgagctgtaacctatcgcaccagtcaggcctttcgctagatgggggctggacatcattggccctttcccggtggcacgaaatgggtacaagtttgcaattgtagcaattgaatacttctcccattggatcgaagccgaatagctcggtacgatcactttggtagcagtacagaaatttgtatggaagaacattgtttgccgtttcggagtactgaaagaattcatcactgacaatggcaagcagttcgattctgacaagttcagagagatgtgcgaaggcctagacctgcaaatcaagtttgcttcggtcgcacacccacaatcgaacggggcggccgaatgagcaaattgcaagatccttgaggcgctcaagaagaggcttgaaggggcggcgaagggcaaatggctagacgaaatgttatctgttctctgggcctttcggacgacccccacaaggccaaccaagtttagctcgttcatgcttctttatagtgacgaagcaatgaccccaacagagctaggggctaactcatcaagggtaatgttctctggaggcgaagatgggcgcgaggtgtcgctcgaactcctcgaaggggtgagagtcgaagcactagaacacatgcacgaatacgccaagagcacttcggcaacttacaacaaaaaggttcgatcgacagagctgttgcctggccatctagtcctaaggaagaaggccaacctagtggcggttggaaagcttgaatcgaagtgggaagggccatacctcatcaagcataggtccaggactggctcttttcgcttggcgacgctggaaggcgaagagttcaaccactcctggaatgctgcttctcttaaccgtttctatgtctagaaggggtggcaccccattcgccatcttgtaaaaatgtacatactatcatataggcctttcggcatctcttattatgtaagcccttcggcacaaaaatacaaaaaaaaagaggaaaatgaaaaaaaaaactggatgtagggctattatccatcctggaggcccgaaccaatataaaatccttatgtctttcgccttttttacttgtgtgtgataattcgtggaaaaaccccaaggcaaacgtctgatcagcgaaagcgctagggggcaaaacgaatcggccgaaacatcgctcgccgaacgttgaaaccgcgacaacttgattcaggaaatgaataaccgagcaccgtcgtattcgatctatgtaaaaaacacgagcgtttctttaacgcggaatactacaggtcgaaaacggaagtcgaaagctgaaaagtcagcagacctatttcgctaatatacgcaagggggccgacatgtttcaacctaacaaaagcacgaaaggtggctatgcgtataatagcgaaaaggaaatataacacatctgtattaacttcaaaaaatatatgccatacaacatggtacaggtgaaagaaggtaactggctttatagcctaacttacaaaaaaaattacatcttcgcctccaaagcaccctccactccctaaggtgtgatttggcgaacttggttcgtcatcactactaatattatacactaccctaagaggagaaggaggcgaaacacaaactagaccataacggcgttgggcgatcgcttcctgacgatcagtcctccgatgatttcgccaaaagcgggccatgtcctcccgatgttccacatggatacggtcatagtcgtctagggttcgcccggggtgcgctcgcatccagccggcaactttcaaaaccttgtaactattaccatttattatcatctcgcgacatgaatacttaatttttggcaggcctttaaccgcgacgaatttctcatttttgttccaccgatcccaaaaaagaggccgatcacacaacttcggcgaaaaccctgctgagacagcataaaaatgacaaatggcaaagtgcaaggttaagagagggcggagcacataaagtgggcaaaaagcgtcgcccccttttcgtgtacaaaatgatgcaagcatacacatcaaagccatcaaaacgggacatttagctaaacccggttcatctatttcatatatcaaaagggccattttcggctacaatgcgaaagggggagggccatcggccaaatttacatcgttcgccttccgcagccaacgccaaaagaaatctaaaatctgaaaaacaggcggaggtcctcacacctctagatgatattggtcgacgtccgcccctgcacccgtatccgctccaccttcttcggtcgctggctccttgccctgctctgctgcctctaccttcgccaagtgctcgagcaggcgcgccttaacggtagatcggccctccttttgccagaactgcttgcgccaggcgcgtaaggcgggcgaaacgtcctgagagctgacttcccaatcccccttcgtaagcttggggaactcggcgatgtgctcgcactcattttgttgcagcaggcccatggtgaaggccactgacacacacgcgcaacaattggcgtacgcggtggcggaatcggagaccgcaccgccggcctgttgggtccactccgagaagtcgaaggcagaagcaccttcgccagggattactcgcaccttctcccccatttcagtaagggcgaggcaaagcgtgtggcacgtggtctttacggactcagtcgccttcgccatctcccgcgtgaacctttgtgcgtctttctcagcagttgcttttgccttgcgggcctccagacgaagagcctccatcttcggctcggtaaggttgtattattcagggtgcgctcattagtgtaggtttggctgtgctgcgcgtatagacatgcatcaggcgtggaggagggggcgctagtcagtaacatggacacagatgtaatggtgacggtggtgacgagagttaggtggccgtctgcctttccgtctggtccagacaccttattacccatcagttttcgcagtgagctaaactttccccaaaagcttgcgtgttgtgttttgccattcatcgttccttccagagcaccgcaccaccattgttgcatgtccaagctcaagctcacctattgcccaaaatatactgctgtgccctccccattgttcttcgcacagaggacatctcgaggtcgcctgcaggagtatgaagaccggcggtcgtcgaatctcgaatcgtggcagcaagcatagagggcagtcgtcgtctgcatcatcttcatcgtcgccagtccgggcaagcctggcagaccacgcgcatggcataggctgcttggcctaaaaaggaagcatccacaagcccactttggtgtggtgcatcggaggaggagaaaggtgccgttcgcaggggcatcggcgcttcgtgcagagggaaggcatcagctgcccgattccggaatcgctgtggccattgcagagaccggtcatctccgatctcgtgctgcacagttgaaggggatttggcgcccttgcatcgccattgcggaaaggggatccagctctatataagggcatggctgcggtaggcgtgaagcgcaaactcatcgtcgacaaatcccctacccatcacctcctccatttgcctccgtcgcccatcgctttgcttagaaggagggggctaccttcagatctggaatcctctgagggtttcttcacatctctccgttcggacgctgcttacaccgccaccaccgaagaagatgtgcaagctgtagctcgcgccgtcatctgcatcgccttgaacttccctgaagccatctgccagttggtgcgccagctcaccccggggaacgttgctgtggcgctcgattgggacctcctcgactccgatcaccttcggaaggtacagcccaacattttgtgatttattccccatttttttgcttgcatgactttggttcatagatggctgctgggcacaccacttggaacgaggcggagctgcaagctttcctcgaggcttacatggaagagatcgaggcacgaaccatcacgagcacctgcccaaaccgccaaggctacgccaaccttgaggtcaagatgtaccagaaggcccagaaggttgtgaaccacactcagttcagaaggcccagaaggttgtgaaccgcactcagttgaagaactttggggacacttatcgccgacgcttccaaacatggtgctggctggagtcgatggcaactggccttgggcgctgcccattcacgggaaacatccttgcaagccctgagtggtggacaaggatggaccaggtatgtgttcatttcattcctgttcttgtcatcaatataggttcatatacattttagtaattagcaaatcaaaatgtatgctgaacaggtgtagcattagagactactgttaatgtaagtactgcacaccgtttgattacatgtaatactagtatgctgagtttaacgaagctatttaattagttggaagtaattagatagaaatactttttgctctagtacttatctctgttgtcatgttcatgtaggctcatactcttcagttagtgttgtacagaggtagcgctattgttttatgactgagcatgcttctgtttaggagtactttcagaatcactattactagctttatgtgactttaaccaaggtatttaattagttaggactattggtagttatggttgtagctgtagtagtttactgtaatgtaaaggccatttactgtacaatgaatgagtagtaatggtagtattacaaattatttgtttgcaagtacataaggtagcattttcgaatttagttggaaccaaccatgcgatcggctaattagctatttaagtagttctagctgtagaagtgaactgaaatgtagagttcatttaggctgcatttatgtgtactaaaggtacatttatgaataatatgtttagaattacataacgtcgtttcctcttattatgttctaaccaaccatggcatcagtcagtaaggactgatcttataaaaacttgcaccactattatttgacataaaccaacctacttaattagttacgactaaattaagataaggttgtagctgtactagtttattgtaatgtatagctcatttagtctacttttaagagtactaaaggtagtattacatatcatttgattacaagtacatatgccttgcatactgtttagtatgatttttatgaataccgtactcattaatccttttgtgcttattcctgtgcagatgaggagaggtgcccgtgccttccgcaacggtccccttctcttcactccagagaaccacacggtgtttaggggtagggtatgtaccctaaaccgctctggggtccctgtgagcccatgcgccatctctgcagctcctcaacaggctgaaatcctcgacattgaggatttgactgagcaagcgcagcaagaacccgaggatcaaactccacggcgtggcaagagaacactcactggtggaacatcctctggcagcagctcgaagtggtcaaggggatcttatgccagtggcgcactgaaccgtttggcgaacctccgcattcagtcaaacgagagcagggccaggcgcgaagagctcaagcaagcaaagagtgctagggcctgcatggagctgttgaaggcagacggagtcagctccagggacccaatataccacatggccctccgggtatttcgtgatggcttcttgcgcgagtttttccttgatgactgccccacaccggaggggaggctctacttcatccagtcccagtatcaggacatggcccagtaccagccactacccccgcctggttttggaggatacctccagtcagctcctcccggtatgtatgttgcatgcagcttgtttaggttcatcatacaatttattttcattcatacttgctcttgttcatacctagactgttggtaccaaagtcattcctgctgttgttaagcattatgcaaagacataatttgcaatgatggcaacctactatttaaggtttattaccattactggaagtcacctctaggttctagttacataaagtgctacacaataacaaaacccctagttacataaagtgttgatcaatattgcgcaagttgttgtcacataaagttgttgttacatttacaatacataaccagttgttattacagttattgattgtcacctctaggtattgtggttggagagggttctggttatgctgccgaagctgaaagagttggagctggagatgatgaggacggtgctgatgatgacggcgagagagttggggacaacaagggaggacaaggtggtcatggtaaaggtggtgatgacgacggcgatgatggaaatggtggtgctgccggctatgggggatctggttatgggggtgctctctacgggggcgtccctggaagctatgatctttccggatatgcaatgttttaacattgcatgacactatctgataatcgatccgtctgggagttcctgtcgaacgatgagtgtgccagaccatgagcacttcttttttcgaacgtgttgtctgtctcgaataatttttgctcgacttcatctcgagcaacgtaactgtggtattatgttgagtgtgtaggtgaaaacaatatcggcacatttcgtttgatgtagcttttcaataagtttgcttagtccctagttatcttgttattctgcctattattgtgtgttgcattctatattgacatgcaggttggcgacatgcaggttgactgacatgcaggttgtactgcctggtgaaaagcgactgagcacttcattcaagtgctaattgatgatgctttctttgcaggaaccgaattaaatgaagtatttaatgaactacagtacatcagtgactacttgcagcatgcacttcccgtatttatgtttgacgtgcatatagggccattaattattgctcatgcgtatcactgtcgaatgttaggttgttaacttttgggttcacaattttcttcgctaatttaacttttagtatttttgtagcactaacagttctaacatggttgtgtcttcgctgtgcaggtgttagcttaatgcactaacaaaacttattgttaacttactgcactaatatgtacattgcatggagcattcatgtttactatatatgttgtccacttcgaaagtgcagtaaccactaagttatttgtatacgtattatgttcaagaccatgagcacttcttcagatatcacgagtgggtcatcggctggaaactacacagatgaggaagacaacataatcgatatgttggtagctgatttggaagcccaagtgcaaggtagagctgcaaggcgggcgccacaacaggcagggatgcagtggatgatggagacaatggccaatgctactcagtgccataatgtctttcgcatgagggctgaccaaattcatgctttgttcgcaattttaactaatcgttaccatcttaatggaagtaacgaggtttgccctatggaagcactagggctttttctatacatcatggcagctgggcagtcgcaaagggcaacaaataataggatggcccggtcgggatcaaccatatgcaagtacttccataaagtgcttgatgcagtttactccatggcagctgatatcaacaagcctgtggatccaagttttcgaagagtgcataaccgggtcgcacgagatgaaaatttcctgccttttgctagctgtagacgggacccacatcccagttcgtgttgcagttgaagaagctaatttgcaccgcaatcgtcatcatatcacatcaaggaatgtattagttgtaattggatgggatgatcatgttatatttgcacatgccggatggcctggagctgtgcacgaccagagggtgctaacagaagctgtccggaactatccccataattttccaaggctgccatggggtaagtacataatgttgaaggtttttttaatccagttagtacacatcaccatcatattactcccccatgcaattttcatctgaaatttctcatgttcactgtccaggtaaatatctactagtggattctgggtacgcatgccggtgcggtttcttgccaccgtacccgcatgtacgctaccatttgaatgaatttgctggtcaactgcaagggagggaagaaacattcaactatacacactcctccctgcgtacttcagttgagagagcttttggagttatgaagagtcagtggaggatttttagggagatacctcttttccctaggccaaacacccaaactaagatcatacactgcgtttttgctctccaaaacttcaggcttgacagtgcagacccccatttcatgacacagaactggttgtacaacgggtaccctcccatcccacaggcaccaccgctgcgcgacttggtacgacgcacctaacagtgctgctgggatgagagctgttcgtgacgccattgcaaatgaagtttacaacaactagtcctgcatcactttccatccttaataaatttgtactccttgctcatgtctttctcaatttatcctattttatgtgtgttatcggtatgagaaactactgtcctgttgttctactcgaatttgtgtgacgctattatattgctatctatgtgaacttcggtattgtcaatcacgcatttcacattcattacaattttatcgagcaattaattgtgtacattaatatgcaactaatcatcctgctgatcacatttattcttttttttgtgcgcctttcactgtcggctccatgcgcgcaggcctagctgagcaaggaggaaaaacccccaccctctcccaagtcacgccgacaccagcagctgtggctgcagcgcctttactgctgcctgcgcactgacagccctgcccgtcccgtcgcgtcgctttcatcactgctccgtcggcaatctcatggagctgctccagccggtgtcaaactccatccaacccttgctacctactattcagccaccaaccatatttactactaacagcctatagtaataattacactcagatttaattcgatactacaatatgcacaaacgagcgcaccctcagttaaggcggcggactggtcttgttcctttttaagctcggccttgagacgctcgatctcggccttcgcctcgctccccttctccagctcagcttggagccgcctgttctcagccttcgcctccttaagggtgttggcgaggctttccatttgtaggctcttgcggcccagttcgtcgtccttagctcgaagatggttcttgaagccgtcaaagcgagccctcacggttcgctcagtcgaacaatgagccacaagaatctgggtcaaaaaaaaaggggggagagggggcgaaagcgatcgtcgttaacataagtcgtggaaaaacaacaattaaagagaaagaaaaaaatgaataacatactcggatggctaagctcttgatggcggtacagccttcatcgaactcgttcaactcggtgaacaggctcggctcccagccggagaaacgagatgacttaccccctcgacgaaggggataagacccgcctgggtctctaaatccccaggggcgaagcgaggcgccgcaagcgaatactccgaagccgacgtctcaatggctgccttcttccccttctggatggcgggcagcgaagcaactggatcacgcggagggcttccgaagagcctggcagcggcgttcacaacccggtcagcagaagctgaagtaccggccgcagcgctccctcgcgcttcgcccacgtcggccgtagcaccgagagcggtcgaaagaccatggctccgcctagcgggcgaagtaggggtctcatccgaagactcgtcatcgctgaaaacacaagcgacatcgacgagccccttcttcttggaggttttcttaaccttccctcccttcgccaccttggccgccgcaatcgaaaccagtggctttgccccttccaaatccttccggccgaggggggaactgttcgactccaccccagtttcgacatggtctggacttggggttggggtgtagccgcgcatctcgatgcggttgtcggcgagctcgttcgcggccatttcgatcgcaacatccgtctccacctcatcctccccctcctcttcactgtcctagtcgtcgacggtgtcctcatcgttagcatcagagtcggtggaggcaggggcctttcgcttccgtggggccgatttgacttgcccacgtttgcgcttcttggaggtcccttcatcgccatcgacctcggagggcttcgcccgggaggggagatcgccatcgcacatgtgattcgcccgaccagccgcctgccgcgtaagcagctggctgtattctgtgatcgacacatcgccgatcaccttccgagcttcggcttcggcctgaacaagagttaacactacaaaaacaaaacatcttatcatatcaggcgccaagcagggaaaaagagcgaaatacaaatacatgtaggaagcagaagcctacttttcgcccccccctttggcatgacaagcttcgacaggccatcggcctcctcgtcccggtccacctcgatttgcaatgactgggagaggaggaagatctgaagcacgcaaaactcctctaccaagtcacgacagctaaggcggaggcagactttgcgaagcagggagaaacgggcctccatgatgccagcaaccttcggtttcctgatcggcgcgatcgctttgcgccgtcatcggagagctttcgttgcgtctgacctggcctcgaaggggatggagtggtagaaccacttcgacatccagtggcgatcccacttggacatagaagcattaactggccagagatcggaacgctcggggcgaacattgaagttcacgctcccgaacgctgtcttcttcgtcttcaagtttacggtggcatagaaaatggcaccgaaaagctcagcactcggttcgaacctaccagtccgacatgcccagtcaaagatggcgatccggacgagagccgatgggctcagttgggggagctccacgtaaaacaggcgaaggatctccggtagcaagacgttgcatggaaaccgaaggcctgcctcgaagaacacagcgaagaccatcgtccggttgtcggcgggctttggcaccacagcctttcccagggcagagacctgcttttccgtcagcacgccggagtcaaccagcttcgcaagctcatcttcgtcgacaagcgaagtccccagataagcagctgtttcttaatttccaacactctgatttgagcagaaactctatggagtgtgttcattgatataccaatacctcttcatttcttgatttaccagattggtggtgtcatcatcaatcttgccgggattagggcctgttacggaggccgggtctggcttgcgaggggctatgtcgaaaagtgagagacctgtcgaaggaatatggctgaaaagactagcggatcgaaagcgcacaaaagagagagagaaagagagagctcgcggtgaaaatgactggggggtggtggtaaaaaccgggtggggggtatatataacccacccaggcgacgatttacctccccgcccaatcataagccgccacgtgtcccagggccaggcgaaacggtaaattcccattggctcgggccgcacagcgctaggcccacagagagaagcccatctctgttcacagcagcccaccaaaaaagaaaaaagggcttcgacacgggcaaatggcgaaagctattcgaaacaatggtaaccataaaaatataaatgaatgcgttcaaaatttcttgcaggactccactatgggtttcggcaggaacgtcggaatgggggcacctcataccatagcacataatttgcacggtctcggctgaagctccttactcaccctcgcctgtgaggggcttgttggcggtatggcatgagacccttcgaccagacctaccgaaaccatgataccaacaaggattcaagccaaagacgtcaagtgtacctgggcgaagcctccatggcgaaggctgtggaacaaagacggctaaggccaaaaagccgtgtgggtacctcgcaggaccagtcatatggggcgaagggtgtagacttcgctttagcaggttcggcaccagggaagcccaatgggccatcccggcctcttagggttattcgctaatgggctaactgtaacgaacctaaaattttaatttgcttcgccgcgctgttggcaacctagttatagtatgctcagtgtgttgagctgaacgactagttgtgtcacacgattggcttggatttttttttttttttgcgttagaggatcgattcatatgcatatatcacagatgaaaacacaaattagacacataagtaaattctttatttcttcacatatacattatacagtgttgttgcatacatcaaataatgcatctcatacattattcatctaaaatagaaatagtgaaaattaaataaaaatattggtgtgatctgtgaccacacctaattgctttaggagatttcaaatataagatttaggcaaaagagaaaatttagagttgcttgatgtcacatattttgcaaccaaaccatttcggggcacaaaattagtaacattagccatctcttagtagcttccaaaactatttatttcttaggtaaactctgagtttttgggcaattgaaaatcagtccctaaactcaaagtaatctccatatttttaaagtctatggtactataatgcaaaagttacaaatattatatttttcactaggtttttatttaattgcaaatctgtgaaaaattatgctgagcctccaccgaataaaccatgcttaggtgtcaaacagggagaccaccagtaaaaccttagtaggtgagtcacctagtagtcaaccatgtccctgtcacaaaaaccatatcagtgtgaactccatcctgaccgagcctcattttcctcgtagagaccaaaaccagttagcaagaagaaccaccataaccagagagttagagaagaaaagaaaaatacaagagggcaaaatcacccaacatcaggtggagcaggggctccagctccatttggagcaggtaccccagctcaaggaggagacgctgattcagtagaatcaaccaaccaatagaagctgcagtagaagcaaaagaggagttcaactatatattttcacaaccactgaataatcaacaaagaggtaaactagattaagagcatcatccatggcatataatcatgattagaagtcagattatttacaaatcaagaatctagagaccatattatttgcattacaaggttacagtggcacacatctaacaaatacttctattgtgagacattatgagaaatagaacagagaaatagaagggggaaaagggatatggagttactggtgagggttgtggccggcagagttgccatttgaggcattggccgtctccacagcgaccatcacaggagttgggtaccaatagccatggaggacagcaatgctcaaattacttgagagaggagtggtggtagtagaggatggaggtgaagcaggacatgagtttgtgggaactagggggatcaaatcactgcaggggtagctgctagggagatcaccggagtggggcatggcagccggcctgagggagagcgtcggtgttggcggcgctgtttggggatggcggcacaggagagaaggcgtgagggagagaaggagatagggacagaagaagatgagaagaaagaaagtgggctggttgggctttggttttgtgggctggactaaattgatcatatatagtctccaggaaattagatttagatttagaacagaatgtgagcaagtttttatgtcatataaattgatgattctaaattcttgatatgagtgttaaaataaaatctgaacagagcaaaataaatttataaagcagcacctgatcattatatttgccattcataatacatcattcatatgcattgcatgcggtaaattatgcgttcggaatatgtccttattcggactttcgtattttttttttcagaagttcgagttcctgaggaatcattcatttcgattgaatttgagggtattcgtggtgttttttatccaggcaagtccatctcttgatcatattgcttagttatttcaaatatttgcaacctatataactctcaccattgcatagaaaaccagaaatttatttttgaatgttaatattgtgcatgtggatctgtggatcagttctttggtgatcttaataattgccagtctgaacttggttattgtgtagtcagctgtatatgcttaacatcataaggttaattaacaactgctgtaaggtatgcaagcgtcgtagcgatcgtgtcgaccatatgacttggaatgggacatgctagcttagtagttctttcttaatggctttatccaacgggcttaaggacttccgcgaatcctgtgagcgtggcctagcgatgagggttgctgttgttgcagaattcgattagatgatgtggatcgccattgttgcaggatccaatgattcgctgttgttgcgggaatcacccgcagagataattaatagatgggattgataaaaagcttgtgaccttagccttgccggcatacaccatgaagtgtgcttcaagcgccgacgggcgtgggcattaaaaggtttaaggcgtcagtgggtacagcgacacacctctgcagagtgtatgaattgtgatatgtcactccctgtttcgggtagaaactgcgaacgcggcaggaaagggatcaatcggagattctatcctgtggtacttgatatgcagtagtgttttataattaaaatttgaatttttgcaacaaatatttgtcaaaaacattatgaattctttgaagaatcttggattctagagatagttgcattcacacattttcttgctattgatgggcttgttgagtaccatttgtactcatcccctatgttaattccttgtatatagatgttgaatcattagaatctgttgaacaagaatatatggctggaagtgaaggaactcatgttatggatgacaaccaggaaggactctacgatgatgctgagattgactatgataattagtgtataatatgcatggttcatatagttgctgtagtggtgatggtagtagcagtggcagcggtagtatttgtactagtagcagtaacgttaatatgaatagaagcaatatctgtagcggtacttgtgaattttctagtgtgttgtatatttgctgagcttttggggtttgtatattattttgctgttatcgctcgaggcttgtcttgagctgtatctatggtactataataactggaaccaatgcgatgtttctgctatgcaactctgatgtgcatatctctgagtaaacgatgtttatgaagatatatgctatagacttatattctactcttgttgtggaaatatgtgggtcgtttcactaacgttcgccagtcggcccatagaaggcctatgtatccaaattacactg

SEQ ID NO: 30240 - DNA, 629 bp, Oryza sativa
  unsure (1)..(629): unsure at all n locations
nnnnnnnnnnnnnnnnnnnnnnnnnnnnnnnnnnnnnnnnnnnnnnnnnnnnnnnnnactattcttgcaagaatgccacttgtggtgagtctctagaagtctttactttcccgtatcattgatacaagagtgggatttcatggaccaaatgcacggagaagtctcttgaccacaaagtgatttgtcatgtcctcactcccaagtcctttaatcttgttgacaagaatcatcatactatcatacatctcttgcgctgtctccttgtcatgcattacaaatcttgcaagccttcctttcaataattgaatcttggactcacgaacggagggacatccctcatgagccaattgcaaagtatgccatatctacttggccttctgtagtccatcaaccttgttgaactgcttcggattcaaggcggagagaattgcattggaagcttgagcattgcggctgatgaggtgatcttgctccgaagggagctccatgtcatcatggggtatacaatacctgttcatacaatgttgcaaatacttggatgcaaagagattagatgcaacttcattttgtgctactcgagcggcataatatgtcccatcaaatcgaagagcacgcctagaaagcatgga

SEQ ID NO: 30241 - DNA, 23512 bp, Oryza sativa
  unsure (1)..(23512): unsure at all n locations
cttactgcttttaacagaacctacttttggtttggccatgttgggaagggaaatagagaaacagctgttgaactagacaagaacatgcctctacagactggcaaatccaaaaaatgtttttttcttctatttattaaaaactattaactcgaacagatagcatgacaaaaggaaaaaagttagcttcatatatagagtaacaagtcaagaataactaccttcgagtggttcaccacccttgaagacgtagagtctccatctaatatctgacttgcgagcctctggaggttctgaatgcaacagatttacacctgaaatggaagtaaattgcaaactctgaggacaatgcaatacagcaaagaacaaggaattacaaattctcattggtggttaaacaaacattaatgtaaagtgtaacatttaggttcatgaccaaaaagaaagatatagggcttcaaaacagcacctgcaactctgttagtctcctcagcaagctttccagacaattcaaatgatggtttttgctgcaaaacaccaatgaaattattaaaatactagtgtatgacaaatgaagagaaaggttaaataaaaagaaagctgacatggcaagtattttgtatctgcgaaaacagcaagcatcatataaataaactgtacacaacaaaaggaagattgttattattttaaatttcatcatggagtatgccctaccttttcttttgcttccagagcttctgcagtagcattcatcttcaccaaagaatcaggatcaacactcctggccaaaatagtatcaaatataatattttcagttctaaaatttcaggtacaaaaacattgcgctcatgtagctggtcaaatatacatttgtttgttttaggtactactgctacagttgcttaacggatatgctgatatgcatcaaaagttcaaaaccattccagcaagagggtatgacacccataacacgcgtagccccattgatacaacaagaaaacaattgcaagcaatgcttctactaaaaatttacaattcgtattgaatatagagttttgcatgcttaccgtgacgctgcatctgttacagagcttgtatcctgaaataaatcaaaacaaagtttaggttgcaactaacgggccatatatgatagcaaacatgaaaagaaaccaaattggtatgaaatgaaaaggatagcgggcaactaattatatcctctagaatctgaactctgaagcaagaagggtttacatggaatacagacccacaagtttagtgtcaacaatgctgataacaaggcgtactccctctgtactcgtaaaggaagtcgttttggacagcgacacggtctccaaaacataactttgacttcttgtttctataaaaatatttaatgaaaagtgatatatgtatacttttataaaagtatttttcaagacaaatctattcgtataatttttacattttcaaactcaacttgagagttattcatgatttatattcccaaggtttgacttaaacattgtcctaaactacttcctttacaagtacggaggtagtaattttttttcacttctattcatttgggtgcaggttatcagacaaagaacagaaacaagggacaatcatgaaacaaaagaacacactacgccaactaacaggtggatatgtataagaaaagggtcagatatcattacacacctcaccatgtgctgcacttctagatgacctcggtgactggcgggattcacgtctacccctatgcctatgctcttctggagacactgatcgcccacgcctagatgatctccctgattcaccattgctctcatcccggtctgcccttctctctcttgcagaatcccttctatcatcatgatctgccctttgctccctggaattgacttttcgatcatccccatcagaccttctaccccttgaatcacgcctttcatcatctcggcttgaccatgtctcccttgaagcacccgaccgatcagaccttctatctcttgagtgatccctatcatcatcatgatccagtttcctgtccttaaaagagcccctactatcctccctctcagtctttctatcccttgacacatcctttccctcatcacgctccctgtacctccccgagtcccgctcttccctgctggtggtcttccgacggtcaccctcagtagcatctgcaccttcccgctcactctgagcccttctcaatcgtttgctccgtggtgagggcgaccgagactcccgtttcctggcaggtgacggagaccgtgaccgtgactgagcttgtttcggcgacctgacctgctccttcaccctatctctctgtggcgacctcccaatactcctaacaggagacctcctaggtgagccattcctccgaacaggcgacctctccctatgtgagctagtagtcttaacaggagacctcctcctaggcgagcgactcctcggagccggtgacctctccctccgagcaggcgggctccgcctgcgcggcggcgagccacggtccctcgccggcgagcgcgacctcgagcgccccgacctccgcgaatgctccctccgctccaccgccgaagccattccccacctggagcagcatcacccccaaaccaaaccgattcagaacagcactacgaagaaaaatcgcggaatcgctagggttttgtgcggcctcagtccgaggagccgccaaaaaaaaaaagagggagggagggagggaggaaggggagcgtaccgggtgcggcggaagcggatgcggagtcgtcggcggcgaggttatcgccggtggcgaccggccagcggcgaccgcgaaccgagggtttcttctctgtgagggctcggcttcagagaacaatccggaaccggaggcggagtccgggaaggctgtacaatatcaagacgaccgcgaaagcccaatagagagcccaagttgctaagcgacggcggcccagttagatgagggcccatatggaagactctgtggtggcccatagggaataagttcatctagggtcccttaacttgtcaaggaatccgattttcgtccttcaaccgtaaaaccagatactatgggtccctgaactatcaaaaccgatgcatattaggtccctcggcggtttcgatggtggttttggctgacgtggcacctacgtggctaatttgactcgatcacgatctgacgtggcactgatgtggcaatttgatccggaaaaataataaattccgtgggacctaaatatcagtttcacacacaaattaataaaagaatggcggggtccacgtgaccccacatgtcagtcaaaatcacccctcctcttctgcttccggcttgccgctcgccgcgacgacgacgacgaccgtggatgcggcgccggcgctggcctcgacgtccttgctggccggcgtcgtcgtcgtcgacgacgactcgtcggaggacgaggtgccgtcgacgtacatcccgatggcggccttcctgacctcgagcacgaacagcagcagtgtgagccagacgatggcctagaagacggagagctggacaacgagctgctgcgccccctcaccgtacatggaaggccgtgaagatcgagagggcaacggccatgaaccaccagctccaccgctgctttgtatccacgagcaccggcaccaattgcgggtcccacgccagccgccgggtctgctcctccgcctgccggcacgcgtcgttgtcgggcatcaggaactggatcagcaggaggtccagcgactgcgccgtccctccctgttgccagcggcagcttcctcctccctttaccttgctgcaatcgcccggcaccggcggcgggggtgagcaggcagcaaccacccgccggcgctacccgcctccgcgccgtctcgccgtcaccgacaccgcccgcgccggcggaggcgttcgggtccgatgccctcaaggagactttctccgttgacgtggtggcggccgaggcgcggccgctgaacgtgcccctggccgcgcccttcaccatcgcgtcgtcgcggctggagaccgtgtcctacgtcgccgttcgggtggagctccgcagcggcgcggtcgagtggggggaggcgcctgtgctgccctccgtcaccgccgaggaccagcccggccgcctttggtgcccatcccatccgcatctggcgcaagagagatgaagagaggggagctggggagaggaggaagatgggaaggggtgagttagcctgacatgtggggcccacatgggtcccattgttttttattcttttgtgtgaaactgacacgtgggtcccataggttttattttttttctggatcaaattgccacgtaagcgccacgtcaatgccacatcagatgaagaccgagttaaactagccacgtagacgccacgtcagccaaaaccgccatcgaaaccgccgagggacctaatccgcaccggttttgatagttcagggacccattgtacctggttttatggttgaaggatgaaaatcggattcgttgacaagttaagggacctaagatgaacttattcccacccccataattttgaagaggaaaaagttcactttgggtccctctatttgtcgccccgtccgattttcgtcccttgaccgcaaaaccgggtactacccatcccccaacttacgaaaccgggcaaacaaggtccctcggtgattttggatgacgtggtgcctacgtggcttgtttgactaggtctccgtcccacgtgacattgacgtggcaattaaacctgaaaaataaataaaccttgtgggacccacatgtcagttttacacagaaattataaaaaaggtggggcccacgtgggcccacatgtcattctctcccccttttcctccaccccatgttccaccgcattctcgccgcccgcgcccaccgacgacacgaccccagccgccaccgcagcccggcgaccggtggcgccgcccacctccctgactcgccgtggccgctcggggtaaggcggttcccctgttgccgctcccgctcccgctcccgccgtgccgacgcaagagaggaccgcgcccgcccggctgtcgacaccccatcggtggaggaagtcggccaactgcagcagccacggcacccggcagctccgcccgcctcggcggcgctaccgcggacagcgacgcacctgacgacgacgccgcggccgctccccccaccgccgagtcaacgctcctctgcacacgctcgcctgcagagcgcgacgcccgtgggctcaacgactgcggcagccagggccacctcccaccaccccttcctctcctgccggccgccgcgcgccgagcaccactgcctctccaccgcgagagagaggggagaaagagagctgaagagagggagatgtggatagaggagaaagaaggtggggctgaggatgacatttggggcccatgtgggccccacctttttattatctcacttgtgggccccgctattttaaaattatttttatagtgtgtacctgataggtgggcccatggtttttattattttttcaagatataattgccacgtaagcgccacgtcaaatgccacgtgggacagagaactagtcaaacaagtcatgtaggtgccacatcagccaaaaccgcctttaaaaccgcagagggacctcgtttgcccagttttcgtaagttgggggacgggtcgtatccggttttgcggtcaagggacgaaaatcggaccgggcgacaaatagagggacccaaagtgaacttattccttttgaagagaaaatccaagaaatgacaagcaccaaatttcaaaaaaaataccatcaataaatacgagttctatgaaatatcatcgtacaagtgaattcgtcctagaaatgtcatcaccgttaaggttccgttagcagtccatcctgcagcattagatgtgttgtttatcctatagcatttaacgggaggctactaacagaatcttaatggctatagcatttctaggataatcctcttgtacgatgatattttatggaacatacactcatatatcgtatttcttggatttggttgattgtcggtggtatttcttggattttctcaaccacaaactagtccagcccaacacttttggcagtgcctctccttttttttttcttttccttttttgcgggtaatgcaacttttcattttatttcactagggaaaggaagaatttgagacacttaacccgtcagatacactgttctttttggactatggaacgtggggacttcataagaaatgtttttttcaaaacagtcaaaattcattatggattattgagtctacatcttatgttaaatatatataatgaaatcagtttatactgtaattgtcaatcactaccagaactcaccatcaccatgtcccctactgttttttctgctagggaacagcctgaaactagtagggaaacagtttccctacactttttcgtagggaaaccttccatgggaacatattcgtggggaaataaaagtgccctacgatttcagctataaaagctagattcctaggatatgaaatggtagggaacattgcttacatggcatttgtgatccacattacatggcatttgtgatccacatgtaaagtgacttcccctatgtttctaaaactgtagggactttttatttaatatatttctcctagctgtgccatcacacaattatttccttttaaaatgttcaaatagtagggatatttttatatgcaatatatatctgaatattgcaccaaataggcgattcactcaaattaaaaataattaaataggtaatatatatcactaatcttacaaaccaaatcaacacgagctctcacaaatcttccatgaataatcattacttagataagcataaagatcactgagacactaatagaatcagttacatagttacataggccgtgtttagttcgcgccaaatttagaagtttagttgaaattgaaacgatgtgatggaaaagttagaagtttgtctgtatagaaaagttttgatgtgatgaaaaagttggaagttcgaagaaaaactttgaaactaaacacggcctatagtgaatcacaaggtttggcaaaaggtttgcaagcagtaaacacaagattccagatttgcccatatttaatgctgccttaatgccaatcacacagacaaccatcacatgtattcaggtcacaaaacatgatggtcaatcccacagctgctgttgcttcacaaaatacaatcatccagatgcagagggagggctggcagtgaacctagtgcttcggcttctgctgttgctgttggtgctcccatacaacaacaagaacatggcatacataatcacagcaaaaaagtgaaaccacaattattcatgcaataggaaccgaaaaaatgttctcaaacatacacagcagtcgcaagcattacagtacataaccatgtttgtgctttacaaacaactttcaagaacggttaaccaaacaaagtgcaatggaatcatgaaatgcattcatcggatcgcaatcatcaaacacttcttctgtctcaggctgatcggcagtagcttgtgagggcacatagttctcatcacggtcacaacgatcaaagtgcttatcccgtatgccactaaccctaatgaagttatggagagcacagcatgcaactatgattttggcctgtttattaggagcataactagagacctttttccaacatgcgccacttcattttcaaaactccaaatgatctttcaatgacattcctaagagatgagtgtgcatagttgaatttttcttccttaccttgaggttcagggctgtctcgatactcctgtagatgatatttggttcccttgtaaggtgcaaggtaacctggccggttagggtagccggagtccacaaggtaatactttcctacagcaagaaacatcagttagtgccacattctacaactaacaaatcaaaatgaagtacaatgcaacactatacctgtaggaggatgtggaaacacatggttgtatgttgagtgtgcatcatcaaatactctcatgtcatgtaccgaaccaggcccatccagatagtacaaatgtaaacctcatgtcgaagtcacatgcagccatgacattttgtgtggtcatgcccttgcggcacaagtactgcatgaacttgttgtttggcaccacgcaagggacatgagtcccatctatagcccctatgcaatccttgaagtagggatagaacctacggttcctcagtcttgggtgcattgttctgaattgcgggtccacaggctttatgacatcaacagcaagcttgaccacagactgcaacactttgttaaacaagctacttacagtccccatggacctctcaaatctgtcctcagcttgcctaactgattgtggggtgccaaccatccaaagaaacatcgcaagagcttctaccgaggtggatttgctactagattttaggccataggactgaaccaataggtcatgcaggaggaggaacatagttggactcattctaaacatgttataacatgcctttctatccccaagcttattatgtacccattacaacccagtcaaggcaggttgcctatactcactctagtcaaatgcttgtcaatgtggatggcatactgaaacataacgtggaagaaaccttcgtcatcatcgtccaacaagtccaacatcatcttgtttaagtcttcatccatgcgctgtcttcgagcacgacgattgtgggatgctgacaacgaccacgacgagaatgacgagaataacgacgaccgcgacgagaatgatgacgacaacgactgccctgcatcctgtcaaagcaaacaatgagttatgttagtaaagaataacaaaacatttgcaaataaatctcagccatgcagcacatagttcaaatcagcaatgtattaaaagtgcatcacacttagtaccataacaatgttcatataacagacatcacaaccatagtacacacatacataatcatacacaggattgaacaaacagacaataatacatgaacttaaaattaatgacacaacagaacatgagatggactagttgtcgacctcaacatatttcttgatgatgagcatccttcctgctggacaggtgtgaatgaatgcatccatcgcgctaccattctgggtaatgttgaccacgcccatgaacagctttgggcttccttctggagtgaccccacactccggccatctcgagtacctttttaatcttcatctcatgagcgttggcttgagcttcggcggctatcatatgggcttccgcggctctcctttcggcttcggcggctttccgtttggcttcggcgacatcctgcataacttgcaacatggattgcattaggctgattttgctcctttgaaggtcattgtactccctcatgttgctaaccattgccctcactgctggactcttggactttttacttggactcgtccttttgttgccaacactaagaggggtcagctcgtcctcttgctcatcaccatccgcttcgtcagagctatcacactctataggctcctcggcagtggccacaaacgatgcggaaccatccacagcaacaccctcaaacattcggtccatttcaggcaaatattccggcaagcctggcctaaacttcttccaatcagaatgtccctgcacaaagaagtcatatggcatgaagtcctgaaacaaatcaaatacaaagtttaggttgcaacttacgggccacatatgatagcaaacatgaaaagaaaccacattagtatgaaatgaaaaggatagcgggtaactaattatatcctctagaatctgaactctgaagcaagaagggtttacatggaatacagacccacaagtttagtgtcaacaatgctgataacaaggcataatttttttcactttctattcatttgggtgcaggttatcagacaaagaacagcaacaagggacaaacatgaaacaaaagaacatagtatgccaactaacaggtggatatgtataagaaaagggtcagatatcattacacacctcaccacgtgctgcacttctagatgacctcggtgactggtgggattgggattcatgtctacccctatgcctatgctcttctggagacactgatcgcccacgcctagatgatctccctgattcaccattgctctcatcccggtctgcccttctctctcttgcagaatcctttctatcatcatgatctgccctttgctccctgcaaatgcctttttgatcatccccatcagaccttctaccccttgaatcacgcccttcataatctcggcttgaccatgtctcccttgaagcacccgaccgatcagaccttctatctcttgagtgatccctatcatcatcgcaatccagtttcctgtccttaaaagagccctcctccctctcagcctttctatcccttgacacatcctttccctcatcacgctccctggtggtcttccggcggtcaccctcagtagcatctgcaccttcccgctcactctgagcccttctcagccgtttgctctgcggcgatggcgaccaagactcccgtttcctggcaggtgacggagaccgtgaccatgactgtttcggtgacctgacctgctccttcaccctatctctttgtggcgacctcccaatactcctaacaggagacctcctaggtgagccattcctccgaacaggcgacctctccctatgtgagctagtagacttaacaggagacctcctcctaggcgaccgactcctcgcagccggcgacctctccctcctgcgcggcggcgagccccggtccctcgccggcgagcgcgacctcgagcgccccgacctccgggaatgctccctccgctccaccgccgaagccattccccacctggagcagcatcacccccaaaccaaaccgattcagaacagcactacgaagaaaaatcgcggaatcgctagggttttgtgcggcctcagtccgaggagccgccaaaaaaaagagagagggagggaggaaggggagcgtaccgggtgcggcggactgcggcggaagcggatgcggagtcgtcggcggcgaggttatcgccggtggcggccggccagccgcgccggcgaagcggcgaagcgagggtttcttctctatctgtgagggctcggcttcgcagagcaatccggaaccggagtccgcgaaggctctacaatatcaaggcgacgcgaaagcccaatagagagcccaagttgctaagagacggtggcccagttagatgagagcccatatgggagattctgtggtggcacattttactagcgtcaccacataattttgtagagaaaaatccaagaaaaaccattgacaaacacccaaatctaaagaaatgtcatcgacgagtgcaagtttaataaaatatcatcgtacaaatgattttgtcccaaaaatactatcgtcgttagggttccgtccatcctgtgacgttaaatgtattgtttatcctatatcactaaaggaaagctgctaacagatccctagcggcgataccatttttgtgacaaatacgcttatacaatgatattttatgtaactcgtacttgttgatagcatttcttggaattatgtgattgttaatggcatttcttaaatttttctcaacctcaaactagtccggcacagtacttttggcagcgcctccccttttctctttttttttccttttttgcggttaatgcaactttttatttcattaacccgtcagatacgctgttctttttggactttggaacgtggggacttcataagaatttttttttcaaaacagtcaaaattcaatatggattattgagtctacatcttgtgttaaatataatgaaatcagtttatactgtaattgtcaaattatggactactaagagacaatgttccacttgtttaagcacggactgttcttgtgaaatatccttggtaaaaaagggaaaaagatcatgatatctccagcattccacagtcaaaagttcatcctactatcctatataggggtggacaaaaaagcttgggctcgtgagcaggctcgggcttggctcgagctcgcaaaagctcggctcggcttgaaacctaaacaagccgagctcaagccgcctgcgcagctcgtttctaaatcaagccgcgcccaagctagcttgcaagccgctcgttcagctcgtcaagcttttgcataaaaatggcctagcccattattgtcgctggtgtggcccaaggcccatcaaaaatcctaagtccctaacctattcccccaatctcccacccaccccacgcataggcagccgttcttctccccttcccaccacgcgagacagcgagtccgccactgaagcctttcaacgagtccgcccgcctccttcaacacgaagtcgcgccgcgactgcatgaggaactgagggagtgaggacatcgaggcactgcgctgtgtcgtctcctgcctcccctgcggcgcctcttccctccgctacaccgccggtctgctgcctccctcccctatggcgccgcctccatcccagcgccgacagcccaccatctccctcccctgtgtggctgcgccgcggccttgctccccaacggcgtcgcctccatccccagcggccaacaccgccggtctaccgcctccatccccagcgccaccggtccaccgcctccctcccctacggtgtcgatgccatccatcgcctcgctgcctgtatctgaaccaagctagctcgagctttgaaacgagccgagccgagccgctattttagctcgtttcattaatcaagccgagcctattctttgtcaagctttcacgagccgagccaagtctggctcggctcggtttggctcggctcggctcgatttcacccctaatcctatacgcccacttgttatgcgaactttctatcgactattgaccttcagtgtaaggcaataactgcttccaccgaacaagatacagtgcttagcaccaccaatctgacaaaatcagttacttgattactcatctcaagaagagaaaaacacttgatcttcagaggtagagacgctgagtgtgagtggttagccaactgccttatccaacatcccaatgtgacaacggtttaatgccagtgcgactggccggaatcaattcagaattacgattggatgaaagattttggtggagttggccaaaagcccatgtatacgcttctctactgcattcctgtttcgtcaatcaaatgatcacccacaatcacattgatgctgatacaattattcccctaaagaacgtagatatacaatatcaaatggcatcttttcactttggtcaacttcttcatcgaataaactatatctgcagcctcatcaaaagtcaacatccattgcctaaagactgaagttcgaggtgcccttttccctgtacctcctctttttgggacggctgttgaccccctttatttcagaataagaataactcggacgttgactctgccagtatctgaaacaccaagtaaagcacgcagacatttttcgtcgactgcgcatcgttgtcaagcaacagatgttgacaaatccctcaaaagcataatctttcagctcaccttcgtcagagatcagagtgaggcataacacaagtacacagcatatgtaccttctgctcttgcgagccacaagaaataaaccaagaattcacggtcgaaaatccgagctgaaaacgaagctgaaaccacagcacaattcagagagtgatcaccaatgatcggtgaaatgcagtgctaaacggcaaaaaggatggaacagatcgtccaaagtggcactctgctggcattggtgtcacttgtccgtacacacggttcatactactttcagagctcgtgtccatcactttcttatctgctcatccctaccgatctcgcagatcaaaccggacgcacaatggccgatctctcgtatccctgtccgatccatcactcgtcaactgcaaagttttcgcgttcatgcctgcacatctgcttttggtcaaatggcaaactgagttcttgtgcacttggataagaccagttgaaacgagttcttctttcagagcggttgacctgctacagagctggagccggtgtaacgaaaaggggcccttcaacttttggcatgattgtaacaggcgcaatagtggattaaacaagtggaatgcccaatggaattgcactgggactggaaggaatttttctacaagaaaatacttcgatgcaatcattggttgatgagccttgatgtcctgtaccgtaagagcaggtacaatagcaaggctattagccagctataaacatattttaataagataaaagatgagatattttaatgagataaagatgagagagaagagtagcgggctacagatctgtagccagctgtaggaaggactccaagacgcaatgtgtatatgacatgtaagatcatatgttaataagtgtagtaagcactattgtatgaattggctattagaccggctatatataatttgaagctagtagtgggcaaacatatatagcttgctctaagaagcaagaacttgtaatgaaaggttgacctgtagtggtgagagtaatgatgaatttttcacatattggtgctttcaaaaaacttatttcgcaaatagacccctgaaaaaacttatcccagaaatggtcctttccgaggcgccagatcggggcggcgccagcttatctggtgttgtcctcccgccaccgtggcgcacgcgaaccaacgtggcaggacgagggcgccagccatgctggcgccgccccagggaggagggcgccagcatggctggcgccgccgcctccattcctgtttctctgtatggagttgcaacggtgtcatttttattttattttttcggatgttttttcacactcaggatcacgatacaacaaaccacaaaaaaaatttaaactcgaactaccacttagtctgaaaatatctagcataccacttaatctactttgcaccttcactaaaattagaccataactcttttaataaaaccctttgatcagcatgttaaacataatgcactctaccactatatgaaattacttaatctaattcaaaatataaccacatgaaatgacatatataagttaaacagtacatagagatgcaattttttatttttattttatttttttgatattttttttatacttaggagaacataggaaccaaccgtataaaaaataaactcaaacggacaaaatatgtgacatgtagaattttccaaaactctaccgaaacggacaaaatatgtcatctattaaaataggcgtaactttctcatacggactcggaatcaggcaagtaatatatgcacggacatctacagaaaaagttacatccgattctccctgcttcgccgggttcggcgatattaaaacctccaaattccgcttgcaagattgtattttcgaggagagaagtttttcggtagagctttggaaaattccacatgttatatatttcgtccgtttgagtttattttttatatggttggttcctgtgagttcctaagtgtgaaaaaaatatcaaaaaataaaataaaaataaaaaagttgcacatctctctcctctgcactagttcggagagagaggagaggagaggagaggaaaaattctacatgtcacatattacgttcatttgagttcaatttttctatggttggtttttgtgtgtccctaagcgtgaaaaaaatatcaaacaaataaaacaagaataaaaaatttcggggggtggcgccagccactctgacgcactccccctagccacctcagcatcgccccgccacgtcggcagggggacggcgtcaaagaggctggcaccatcctgttgaacgacggcgccagccactctggcgcccaaaaaggaccatttttagaagaagtttttcttggggtctatttacgaaataatttttttaaaaggaccaaaatgtgaaaaatccaggagagtattgccatccttgctgtttgacttcggcgaagcaaaggcaggtttttttggatcccaaaatgttcagttttcatgggcacgagccgtctgaacaacgccgctagcttttttcacaccgtgagatctgacgcgcttgcagctctgcaaaggcttcgagcagctgccgctgccagcaccggcgctagctgcatcctactcatcgtataatctgtgtgctatatactcactgatcatgcaagcctgaatcagaatcaggatatcccgatcagcgtctttgtcttgtaaaagagaaaaaaaaacatatatagattttcagttcccggcacgacatgatccgtgaacagtagctacatagccgcggctgtatttttttttcctctcttgggaacaaacggtgtgccatggcatggtggtttgtagaatccaccgaaaacggtagaattttcggcaatctgtatcgtgaacgacggcaaaattaaaggggttggattcttgcttttgcttggctcggcggtgaagtggagtggagtgagagggaatcaaccgaccgcggcgaaaaggggagggaccgggccaccgatcgacgcaaggcaggcggcggcaagggaggacaagcacgcgcgctggtgatctcacgctggacaagcaagcaaacgcatctgactcctcacacgcgacgacgagccgtccaccccatccatccgcttggccgccccgcgccgcaaagcgccgcgctctcgctcgcaccactttcggtcggcgcgcaggcgcagggcatgggccacgccacggtgcccccccccccnnncccccccacacacacacacacacgctcgctcgctcgctcgaagcgccacttgtcccggccctgcgctcgacgtggccagcgacaccgagccagcgcgagtacacgtcgacgacgtcgtcgtctgtccctgtccggccccgcctcggcgtcgtcggctcgtcgcagcggaattcctgcctgcgtgcgcgcgccgtggcgtgttagtgcactaccaaggctgtgtttaattcacgccgaagttggaagtttggttgaaagttggaacgatatgattgaaagtttacgtgtgtaggacaggttaatatgatggaaaaagttagcgcatgtctagattcgtagtactagtaaatgtctcatccaatcctagattattatattatgggacggagggagtaggcaaagactgtatttagattcaaaattttttcttcaaacttctaacttttccgtcacatcaaatgtttgcacaatgcatagagcattaaatgtggaaaaaaaccaattacactgtttgcatgtaaatcggagacgaatcttttaagcctaattacgtcataatttgacaatgtgatgctacaataaacatttgctaatgacgaattaattatgcttaataaattcgtctcgcagtttacatgcagaatctgtaatttattttgttattagtttacgtttaatacatcaaatgtgtgtccgtatactttaaaaaaaatttggcacacgaactaaacacagccaaaaattgatcacaatccaaataatatcaaagtgactatttgaaactaccatattttgacatggcacaaattggcactaaggttatgtacaatggtttttgttagcggtctctctttattgtcatgcaagaatatttggtgacgtgaaaaagagaggaagaaggaaagagaaagatggttgctacgcatgacaacggcgtagagtcgagtcttaatatttattaggaaatttttttgttgcgttgagtctaataaaggaaagatgactagtaagaaagtattttggtatattaatggttagagaccgtattgtcctaactattgtaacgtgatagcctctaattaacgtagtccatatcgatctctatttttgtacttgccctaatccaaacatgctctgcgttacgttggtgcagtgaacatgcatgccgcggctggtggatggatagcttgtgcatcgtgcataaactgcatatgcagcgaacgggtgcgggaatatgcatgtgtgcgcgcggcgcacatgccgccgaggagaagcaggggaatttattactcatccgatgatcaggagttaaaaatatgaatattatactactactccggtcgaggagccgccgacgtgagaagctttttacgggtgaatttaatgaacgtactgtagtattgaatactggtaactgtcacagtactccttcacaaccgtgtccttgattctggaacaagacacggagtacgtatatctagctgatgtatctcggtgcgtttacctttttttgtggaaacgaatttcatcttccaagtctttgcaaaaaaacggtttctagatacgaacaagctgttggaatttggatggaggttggaagaaacctggtgttggtggcgctagaccataaaaaaaacaatcctgtggtggactcgcaacaggccacagtgtcaagccacccaccgtggcccccccgaagagcatcctgcatccaacacccacagcgccgcgcctttcaggtgcacccgctgacttcgaccatcaaaattcgtttatacccgtaggtctccgcttcccatcccaaatcaccaattgcatttcaccaaaaaaaaaacctgtattcgaacgaacgacccaggactttgacaagtaaattcccagtgacctaaaaaaacgccaaagaaaatttcagaacacttgaaccagtagcgagacggaggaggaggtgagattgacgcggagggagacggacggaagaagccgcgcgttcccacggcacaacggagtcgacgctcgtccatccatccatccacaccgcgagcaaccgcgtgcgcgaaaaaatcccccttgcttcccacgctttcttttccttcttccgtattttcccataatccccctcactttttacacacgccaaaacgaatttcccccatgttccaaacttccaaagcttcccaaataaatccacaagcacaagtctcccctgccctatatttctccccctctccctatatataactctcacccgccacaaaacaggtaaacaactcgccacaagttagctcaagctcgagacaaagagggaaccaacagaaaccaccacggcggcggcggcgcgacacatcaccggagagatggcggtggcggtggcggcggcggcggcggtgagcaggcaatggacgagggtgcggacgctggggcgcggggcgtccggggcggaggtgttcctggcggcggacgacgcgtcgggggagctgttcgccgtcaagtccgtgggcgcggcgggcgcggcggcgctgaggcgggagcagggggtgatggccgggctgagctcgccgcacgtcgtcccctgcatcggcggacgcgtggggcgcgacgggtcgtaccagatgttcctcgagttcgcccccggcgggtcgctcgccgacgtggcggcgaggtgcggcgggcggatggaggagtgcgccgtcggggagtacgcggtggacgtggccagggggctcgcgtacctccacgggatggggctggtgcacggggacgtcaaggcgaggaatgtcgtgatcggcggcgacggccgggcgaagctcgcggacttcgggtgcgcgaggtgggcggattcgggccggccgatcggcggcacgccggcgttcatggcgcccgaggtcgcgcgcggggaggagcagagcccagccgccgacgtctgggcgctcggctgcacggtcatcgagatggccaccggccgcgcgccgtggagcgacatggacgacgtgctcgcggcggtgcaccggattggctacacggaggccgtccccgaggtccccggttggctgtccgccgacgcgaaggacttcttggccaggtgcttgcaacggcgccccattgaccggagcacggcggcgcagctgctagaacacccgttcgtcgcctccgccgccggcgacggcaagccggaggccgcgaagtccaaatgggtgtcccccaagagcaccctggacgccgcattgtgggagtccgacaccgacgaggaggaagacgacgagctgtcgcagagcacggccgagaggatcggttcactggcctgcgccgcctcgtcgctgccggattgggactccgacgacggctggatcgatgtgatctccacccctaccgaagaatcctgcgagaccaccacctcgccggccgacgaggagacgacgactgacctcaacggcgacatcagaaccgcagaattcgagcttccccacattgacgtggacagcggcaatggcaacaccacccacaatgtgggagaagccaatgctcagcacattatttccccttcgaatttagttttcgatcaagtactatgtaaaacaccattttgtaacaaacacattgcaattgaattcataccatgttttctcctcacaaatgtttttctccccctttcgctgctctgttcatacgctcctcacccttagtctctgccctcctcctatcgcgccacgtgtccgcgaatttaccggccaaaattaactgcggtgaccaatacgtgcgggagtgaaactgcgcggcagcttgcttgctctgcaagtgcaacactgcgcccgcgtagtaggaatgagaaatcgatcagcttcagcagttcagcttccccaccacggcacatacacacgcccgaagcttcgcttccgacgcgaaagggatcgagtcgagtcgacacggaaagcgcatcgcagcagcgcagcgtcagggcggacgcagaaagggggccgcgcgcgcgcgcggtcaatagccttcggcctctcgtggcgccgcggcagcacagacagcagcatatgggcccgtgtccattcagcaaaggcgagagagagcgagccgacggtgaaaggcgcacaaggggaagaaccgaagaaaaggagttaacaaaaggtgcccattttacaagtaagcgtcgcgtcctactactgcgagcgagcgtgcgtgcgtgcgtcgttgcggttgcttccaccggtggggatccggcatgggaacgggatatgctactactgccaacttcggtgtgacggtgtcacggtccgattcgtgattcgtccccccgttgtttttttcctctctctctctacgtgcaattcaccgcggcgcggactcctcctcgatcccgtcgtgcgcttctggatggcgtacgtgtcgggtgcgggatgaggcggagtcggtgttccggtgggtttaacggttgacgcccatatgcttttagcttttccgatgtttgcaagactgcgaaaaggctccgtgtagattttattattagtcgacgcgatgacacgacgcgtacgggacgccgccgcccgttttatcacaaaagcgagcgatttgagcggaagtcctatgcccgtcatttttggcgggtagaagtagaacagtgatcgattggattagcatgagagcatggatgaacattacacatgctcatcgtgcctggaccgccgtcagcaattgaaatcaacgatgcaacactctccctctggttttttaatttgtagtgatgttgacttttgcatttatatttaaccaaacattttattaaaaaaattatatgtaaaataaaaaaataatgcttaaaatttttttagtgataaaataaatcacaacaaaacaaatatatgataattatgtaatttttgatatgatgaatggttaaacatatttctaaagtaaatgttaccgtgcattaaaaatcaaggagagtacttcttacgacttacaagtaattacagataagattgttaaatcgcagattctaaatcaaattaacataaggtgtcatggtgcttaccagctgatgattatatagtactcccaggcgatacatttaactacagagaggtagttgcatatcagacgtttgatagattgcccctctcgttaattaaccacccgcaatgcaaacgtaagagccagcgtcatccacgcataacgcatacgtcgatcgaaatcgcccggtttggatttggtcggcgtctccgcaagcgcgtcaacacaatcccggtcgccaccgcgagccgtacaaccctgaaagctgtggacgccatcacgccatcgagctgggcgcctgggccacagtgccacttcccccgcaccggcaccgcggcgccacgacggagtacgtacgtgcgtgtggagtccacgcgcagccgagcgcgcggcgcggcgtggcgttgcgcatctcaccgccaccaccaccgcgcctcctcgccgtgcgtgctcatcatctcgttctcatccggttgccgagacggacgagatgccgagccgccaacccgagcagcgcagtgcgatgcgaggcgcggcccgggctttcggttgctgatttatttattatttttttcgtttttcttttcctccgggagggtgtgcgggtgccgctttctggacgctttgtgcttttctgttgctttcgccgccattctcctccctttcaagcaacggggccgcccgatcgatcgatcgatcgagtgaaggaatcttaaaggtccggagagatcttccggaccatcggatgtgcatatcgatcgctgtcctggctgcgcaattaaaaccagctcatggaattggcgtaataatgactgattagagagagagagagagctcttttacgcggaggggttatctcacatgacatgacaggatcatcaccacagatattttattgttccaggctgtagccaaaatcttcttgggagccaagcaaaaccaagtactactactagtactagacctgtagtggtagtgcatctgatagaatattcccttagcttaaacatgattggggcaaatgacagttgtgatttatactatctcttgtgcaagatgagttaggtatgcggcaaaacggtggtgacaattgttgggcacgcacagtcggactgggatgggtttggttggcagccggttggcactagttagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30242 - DNA, 10714 bp, Oryza sativa
tccggggtcatccaaggccttaggagccatctaagggctctggggccgatcaaggcctccggagctgtccgtgggctccggagccatccaaggactccaaagccttctagaccctccggagctgttcaagggctctgaaggaagccagggcttcaagagccttggacgtaagatgggtgatcggatcgtagtgggacgccataaatacgcactacacatctgccaaccacctctgacgctgttgatgagggcataccgcgcacgctattacccagatacccgggtaatagccggcgccctcgggaatcggcgccactcccttaatgggcgcagccctcctatcaccgaggagctgaccgaagagccctaaagctggcccaccagccaaccggctagataaattagctattagggtagcgatgtaatttccccttgtacatccttgtataaatatgtaaacattgctcacatttgggcataatgaatacagaagtgatacacatacgcttgttggattttgtcccaacatttggcgccgtccgtggggacgaaagaagcaagcaggcaaagaattttcattaagaaaaaaaatcaaactacttatgatatgaaacaatggtagtaaaaagaaggggtttaattaacacacggtgtatcggacaggacgcggggtcgggagatttgtttgatgttgttcttctcgatgtcgatcatcctccgatagaacctggccatatgcgccttgcactcgcggaaagcgggcttatcctcctcactaaagcagtgagcctcatcgctcatgtccaagctgtccgcgagaagctcctcccatgtcatgagcctctttctcaggcaaggatgaggtagcgtgcgagggatccttctccatctcccaggcgtcctcttcctcctcgctggggcctcgcctgaccctgccgtgggcagggagtccagccactcccgcgcggtgatcaggacggtggatccctaacgaacctggaacatcgagtaggtcgccaatttctcttctatggtgggccttctcatctccgcttgccgaatcacaatctagggttaggattcttcctcctcgcgaactcgatgggtgaaagaaagtggtcaggactgaggagaggcgacgtggcgcgtccctgatatatatatgttgggggaatggctccgggtagcggagccagcctccgtcatgtgatgcaacacctaccggagccattcaccccaggagaatgaccggaggcatctactgatttaggctccggagctaaccagaggctccggagccaacctaggccttcggagccacctaggggctccggggtcatccaaggccttcgaggtcatctaagtgctctggggccgatcaaggcctccgaagctgtccgtgggctccgaagccatccatagcaacccgtttgcggtgcgtgcaggagaatcgtcgaatgctcgtatggtttgatggattcgtactctcatttcacgcctaactgttagccaaaatatcagctattcacggccagatcgatcgagtgagcgcagaaggctgtgtttagttgctgaaaaaagttggaagtttggggaaagttaaaagtttgaaaaaaaagttaaaagtttatgtgtgtaggaaagttttggatatgatataatgtgatgaaaagttggaagtttagggtagctgaggtgaactaaacacggccgaagtttgacactccggccatgcacgcagcctgatgcacgcgctggtttaattacctggttttcgctgttgcttcctggagtagctgttgaacaggtgctagcgaaaaattgcgtcgggtagctttcgctgtttaattacctggttttcgctgtttgcgtcgtgttcctttccagtttaaacattaattaggctgcgttcgatatcaggagttcctaactccccctgtttttcgcgtgtacgcttttgaaactaataaacggtgtgtttttaaaaggtttatatatgaaagttgcttaaaaaaattatattatctttttttaaaaaaatagctaataattaattaatcacgcgttaatagaccattgtgttttccgtgcgtgaatgatgggttcccaacccccaccacccaacacagccaagtcattagccgtcctatttttaatactccatgatttaggaagaaataaaccgttgactgccactcgatcgccatacacacgtacaagagcagatgcaataatcctagtcagcaggctccaaaagctattatattgtttttttttattagatggagggaagagaatcgatgagagagaacggagcgggagctaatctggcgcccggcgatagcacgcgttttcacgcgcactcacgattaaaaacatattttgtgggtcccacggtcacttatccgatcccgtgcgcatcctccttcgttccaccctccggtgcttcgtcgaccgacggacggcgtcttccactagcgtaatctgagtatttctcgtcggcgagcgagaaaactccatcgcccccacagatcacgtaggcccatcctccatcctgaaccacgcacgctcatcctcgattcctcatcctcgtccaggaagtcttggcggcggaattgcagccgaccagaagcatctcatacgggcgtcggatcctgtacgcggcgaggtacgtagcgatgactgtgctcgtcttgtgcttttgcataggctgatcaatcatcattgatgaagacccgggaggatcgatgtacagatggagctaatccatcgcgagcttgctccgctatgatcaaccaccggctagctgcaaaaccgttttcctttgctgttttttcccttccttgcattttcatgcttccatgtgaatggagatggataacaggataaacaatctatcattatcttttagttgctatttctgttgtcgattttaggcagggtgactgttgcgatttcgcctaggaagaagaagagaggggaaactcgaagaagaaagatgagccagcatgcacaaaaccaaacgttttctttttctttgatgtgttcaccttcatagttcatatcacagcaatggccacaaaaataggatccacttatgatcatacatgtcaacacgtgcatacataattaattgtttgatataaaattatactgtagtcagctccctccgtctcacaatataagtattttgagtttttccttgtaacatttgaccactcgtcttattcaatttttttttgcaaatataaaaaatgaaaagttgtgcttaaaatactgtagataataaagtaagtcacaaataaaataaataataattttaaaatttttttaataagacgagtggtcaaacgttgcaaacagaaactcaaaatcccttatattatgggagggagtacaaaatatggttagagccggcagtcggcggcactattgaccttgctcacgtaatcctgcccatataaagagctcacgtggccacacatagttcgtcgatcgatcggctcccttcccgccatggagggttcgtctcgatctccttgcgtttgcatgctgctgctgctgcttcacgtcgtcctgctcgctccggtgctccaagcacggctgctcggactcggacatggacgtcgtctgctggtggcgccgccgctaataatgctgccggtctcgattctattgccgaagcggagacggcaggcgtaacaaaaaaaaaaaaaaacgcaatgcacttgtcgtgtccgaccttttttttttcggaaaaagtatacttcgactccttcaactatgacccgagtatgattcatgacctccaatcacaaaaccttgactcctccaactatcaaaaccaatacaaactatatccctcggtggttttggaagcggttttcgctgacgtggcacttacgtggcagtgttgacccggtcttcgtcccacgtgtcgcttatgtggcattagagtaaaaaaatattgtgggaccaacatgtcattcaaaaaaaaaagtaggacccaccgacatatgggccccacataattatcctcagctctccccctctttctttcatcttttctactcccctcaccttcctccatcactagagacggggcggcggcgacggtgacagtgacggcgcacgggggaggagctcgccggccgtccacgcgagggggaggagcccgctagccatcccgcgagctcgccgcccatccgcgcacagagggaggaggtcgccggccgtccgcgcgctgggaaggaggtcgccggcgtccgcgcgggagaaggtctccggccgtccgcgcacagagggaggaggtcgccggccgtccgtgcgcgggcgaggaggtcgccggcgtccgcgcgccgggaagaaggtcgccggcgtccgcgcgccggggagaaggtccccagccgtccacgcgcgggggaggaggtcgccgtctgtccgcgcgcgggggacgaggtcgccggcgtccgcgcacggggtagaagctcgccgccggccgtccgcgcgctggggacgaggtcgccggaatccgcgcacgggggaggagctcgcggaccatccgtgtgccaccgcgacgccatcgtcacctctccccggccggccattgtcacctctcctcttcgtgcttcgttgcttcggccagccgcctctagtgatggaaggtgagaggcgtggaaaagatgaaagagagagggggagagatgacgatgacatgtggggcccacgtgtcggtgggtcccacatttttttttgaatgacatgtcggtcccacaatttttttaactctaatgccacgtaagggacacgtcgacgacacgtgggacgaagagcgggtcaacactgccacgtaggcgccacatcagccaaaaccgcttccaaaaccaccaaaggatatagtttgcatcggttttgatagttggaggagtctatatacctggttttgtggttcgaggatatgaatcatactagttgagggagtcaaagtataatttttcctttttttttcccaccgggccacggcgcccatgggccaggcccaggcgaggcatcctattccgtgacgtggataaatttctttttcgtctcccctgatcgcttctttccccatcgagagttcgccagaaggaagaaacctaaccctaagattgcgattcggcggcagcgacgaggcgcgggcggagatgaggaggcccaccatagaagagaaactggcgacctactccatgttccaggttcgtcagggatccaccgtcccgatcaccgcgcgggagtggctggactctgtgatggctggagttggctcgatctctctggcggtgcggggtgctggctcgatctcggcggcggcaggagcgggagatggggcttgctcgagctcagtggcggtggcggggactggctcgatctcggcggcgggagcggcagatgggccttcctcaagctcagtggcggtggcggggactggcttgatctcggcggcgggagcggcagatggggcttgctcgagctcagtggcggtggcggggactggctcgatctcggcggcgcgagcgggagatgggcctttctcgagctcagtggcgggggcgggggctggctccatctcggcgacggcgggagcgggacatggagctgggtcgagctcagttgcggcggcggggtcaggcgaagccccggcgaggaggaagaggacgcctgggagatggaggaggatccctcgcacgctacctcatccttgcctgagaaagaggcccatgacatgggaggagcttctcgcggacagcttggacatgagcgatgaggttcactgcttcagagaggaggataagcccgctttccgcaagtccaaggcgcatatggccaggttctatcagaggatgatcgacatcgagaagaacaacatcaaacaaatctcctgaccccgcgtcctgtctgatacaccttctttttgctacctttgtttcatatcataagccgtttgattttttttttcttaatgaaaattccttgcctgcttgcttctttcgtccccacggatgacgccaaatgttgggacaaaattcaacaagcgtatgtgtatcacttctgtattcaatatgcccagctgtgagcaatgtttacatatttatacaaggatgtacaaggggaaattacatcgctaccctaatcgctgatttatctaggcggctggctagcgggccagctttagggctctttggtcagctcctcggtgacaggagggctgcgcccattaagggagcggcgccgattcccgaaggcgcctgctattactcgggtaaaggcgtgctctgggtaatagcgtgcgctgtctgccctcgtcagcggcgtcagaggtggttggcagatgcgtagtgcgtatttatggcgtgccactacgcatccgatcacccatcttatgcccagggctcttcaagccctagcttcctctggagcccttgaacagcttcggagggcctggaaggctttggagtccttggatggctccggagcccacgaacagctctggtggccttgatcggccccggagccattagatggctccgaaggccttggatgaccccggagcccctaggtggctccgaggacccgtgttggctcccgagctagctccggagcctaaatcagtagatgcctccggtcattctcctagggtggatggctccggtaggtgctgcatcatatatatatcagggacgcgtcgtgtcacctctcctcagccctaaccactttctttctcccatcgtgttcacgaggaggaagaatcctaaccctagattgcgattcggcagacggagatgagaaggcccaccatagaagagaaatttgcgacctactcgatgttccagtttcatcagggatccaccgtcccgatcacagcgcaggagtggctggactctctgtcgccgctgctgtcgcaatcgggggctaattcctccacctccgtgccggcggcggggtcaggcgaggccccgacgaggaggaagaggacgcctaggagttggaggaggatccctcatccctcgcacactacctcatccttgcctaataaaggggcccatgacatgggaggagcttctcgcggacagcttggacatgagcgatgaggctcactgcttcagagaggaggataagcccgctttccgcgagtccaatgcgcatatggctacgttctatcataggatgatcgacatcgagaagaacaacatcaaacaaatctcccgaccccgcgtcctgtccgaaaaaccttctttttactacctttgtttcatatcataagtcgtttgatttttttcttatgaatattctttgcctgcttgcttctttcgtccccacggattgcgccaaatgttgggacaaaatccaacaagcgtatgtgtatcacttctgtattcaatatgcctagctgtgagcaatgtttacatatttatacaaggatgtacaaggggaatttacatcgctaccttaatcgctgaattatctaggcggctggctgctgggccatctttagggctctttggtcagctcctcggtgacaggagggttgcgcccattaagggagcgacgtcgattcccaaaggcgcctgctattacccgagtaaaggcgtgctctgggtaatagcgtgcgttgtctgccctcgtcagcggcgtcagaggtggttggcagatgcgtagtgcgtatttatggcgtcccactacacatccgatcacccatcttacgcccagggcttgggctcttgaagccctggcttcctccggagcccttgaacagctccggagggactggaaggctttggagtccttggaacttgctacaaccagtcactagcaggtcttggaagcctgatggtgaggagctgaagttttgatgggctggtttggtctgtggtctatattgatattaccaatatttgataattttaatactgcattcgtcccaaaatataacaacttttagcctctagaatttatcccaaaatataacaatttctacaccaacattctcttctcaatcaatcacaatcctccaccatttaaatttttcacctacatccacttcttgtccaatcacaaccttcctctattaaattctatctactttcttaataaccgtgtccaactctaaaaatacttatattctggaacggagggagtagtacttagtgtctatttggtttgaagccaaattttagcaaacctaagaaaaataggtcacttcaatagttaatttaggctattttagctttaattcaaacacaactttaccttactaagatcagccatgctaaaacttgctaaaattagacatggacgaaaattggtaaaatcaatttatgacacaaaccaaaccagcctgataattgacaacataatcaaatcatgtttaagggagcttattgtaactacagttttttcctagaatcttcgggtcttcaaatagtctaaccttttacttagattttaagaaacgtaggatttagtttttccatattctcaccggatggctctcaaattccccaaacaaacgggcttccaatcacacgaatggcagagttggctaccttgtaacatcaaggttacgaataactaagccgtgtacactgccgggcttggttggccggccattgtgtcctgccaacggcggagcaacagcaaccggccaccacatcggcgggcggcgcaccacctccgccgtgctggtgaggcggccccgggtgcttcggcgacggcggggtgtacgaggacggcctcaccagcgcaccaccgtcatccgtgctgacgctgctccgccacgccgacgcacgaagatgtggatggattgagatcgggtgcagtcttagggactgcatgcattttcagccattcatttttgtgatcaacagtccagatcaactgctacagtactcgtgctacagtaccctgaacaatattttacgccgtggtacttttgctacagtaaccggcctaatccttaccgttggatttagatccaacgtagcagctacaactgcttaagttgcagtccatactactactgcatttaatccggatccgatgtggataggagtagtaggcttctcctgaagcgagaaaacagcaggagaaatttcgtcagtgtaggacagacaaattagctatcaaaccattgttataatattttcacatggtcaatgcgtgatgcgtttcgtcagtgaatgacaaattagctaccaaatgaaatgcactcttctctgtttctctctattttcacgtgatccatgcgagtgaaagcgtctatgttgcctacctagcatccgtgcttgcaacagctgagcgaagaggaggaagaagcagaggagaaggagaagactatgagacggtgatctatccatgatcgatagatgcaggagcaagctgaagcttgctgtagatcaatcggtacacggatgaagaaaggttttgggaacactggcagtatatatagcggctagagaccaccgaccttgtgtagttgacgagctgtcgaggtttcaactttcaagcattactagtctattaagtcgcgttttcaggcgactgtaaccaccatctttattaaatacttttacacgttatattgtactccctccatctatttttgataggcatattttctaaatctgaaaaatttatttttgataagcatatttcaatccaacaacctatcctcttaatgattttctagaatttaatgcatgactctctattcttccacataagattagctacatggacatcgagaaatgtaaatattcataaatcgcttctttacgagaaataactagtagtatatttaaatggatgataggtacaattacttattcttggtctgtgtgtcaagatgaaatatgactatcaaaagtagatggagagagtagtaattagtttaaatttgtatcaactactcacttaaaactatgtaatagactgacatggtaatataaagtttgcgataaattatgctaagttacttacatggccatgagtagccacccttggtcgaatttcctcataggtgtaaacatgttctgtttaggtttaggcgtgttattttataaggctgaatcagatggaatatggaaggttgaaagtttaatgattcgaggaacccatggatgaaaaatacataaatggtatttaaagaaaagaaagtcagatgtagcatttttcttaaaaaaaatgcatatatatgttctattccattatggtaaaagagtacaccctatacctcttgttgacacaaactctttagcccctctttgtagcccatgcattagtgataaagagcctctaaagaaaatgcatgatttttgtaggattactggattaatatatttattctccattaaattattgcaaggattatacattcaaaatgacctttaatttaacatgtagatcgtattccattgaaatttgtcagttttccatcatgtcttatactccctccatattttaacgtgtgacgtcgttgactttttatcaacgtttaactattcgtcttatttaaattttttgtgcaaatataaaaatatttatatcatgcttaaataatatttgatgacaaatcaagttataataaaataaatgataattacataaatattttgaataaaataaatggttaaacgttagtcaaaaagtcaacgacgtcgtacattcaaatacggaggga

SEQ ID NO: 30243 - DNA, 31859 bp, Oryza sativa
  unsure (1)..(31859): unsure at all n locations
aagtacgctatcgtcatagtattttaactcatcagatgcatcatgttcctgtgcaaacataggtggccatcttttatacagtctagcaactctttggtacttggccaaccttcacaaaaggtgcttgcatttataaattgaacaatcaaaggtcagatatgcgacagcaacagtgaatctgaaagaatgtcaggtactaacttctagagttagtttgaccatctcagcatcccaggatcaaataaaaattttcaggatggtttaagaatgtgcagtccaacttaggagttgccattagtcaattctctgagtttgaaaacaacactaaaatctgagctaattttaaaggaatgatccatcctgtgtgctgcactaatattcaataattatgttccaatctggatggcagacacaatctggatgggcttgaccaaggtttcatgcatgttgggtaatgaatattcccggggacaaaattaagcttgggtatgggtattcactattgatgcccgccatgcccaattgtcatccctatctatattcctgacaaaattaagtgaatacctaaaattggttttgtccaacacactgttgaatctattactcttttgaatatattgcagcgagcaacatttgaccgcagaagagatggaggcagagttcgctggcaagaaagtttcttcccaagcttgtcactttgccaatttagcaattaaccactacaacaatattgaggagaacattgtaatagcccttttccttgtttgctttccatgacatcatgagtctcaatgttgtaaactaataaacctttctatttttgtctgttcaggttaagattgagctttgtactgttcttttatcaaattgttttcatgagatctgtgggtccacatacgcccatgtcaactttactgccagggctgaggatgatgatcaggctaagaagagactatactttgcagagctcaagttgaatccggatcttctggcaaagaggagggaacgctttgtagagttgagccttgatccaaatattgttggatgtgctgatgatatcgagcccatgtgtgtcgtctctatacacaatcttcagggttcttgttttggtatgtttattactatcgacttatttactgtattctcaatttactgtgttctgattaatatgcttgcttatttgtaattactgtaaggtctctatttatgtttgtaagtgtgatagtaggacctcagcgatttattcgatatgttgatgttgcttttgtaggtggatgccatgagatcaacaggagaattgattatgtaatgatcaggaatcaggactacgagcgttgtcacgcatgtagcgatcgtatcaagcatccatacgggacagaatttattgcagggcatgatagttccaagattccgtattacactgcaggctgatgtaataataatatgattagagctatgacttggagtattgttagaatttagactctttatttatgctttgacatctatgtgcgcgagtgatctcttctaatgcgcaaatattacctgatgaagtagccaggatctttaatgaagcctctatggtatgtctactgtaaccaggatcattaatgctctattcagttgctccctctgggctagtattattagtggatgaagaaaattgtcgtttgaacgttctttttagttatgggacgagatataaatcataactacatgctttaaatcatctataaatcatctatagtgaattcaatactctctccatcccaaaaatataagggcatgtacaaaggtaaagtctaatatggtctcttagttagtacataatattatttagagactatactactgccatagttgagacaccaatcactctttaataattaatgcaccaaaatattattttactactacctttcattccttttctccactctcataacaaaatttcttttaataaatgtttagagtcaactctgagctgttatatgcatagcaatcatacttttcttttctctcctctctcttccacatttttcttctctcctctctctttcacatcatcaaatttacttgtatggcaataaagagagactgctattatacacggttgtacatgctctaaggcacaaccactcctgacacaaagagcaagaaagaatttaatcacctccttaattgaatcacatccgtacatgcaagtaatgtgattgggagacttaatggtacatgaattaaaataaaccaaatttaaagaaccaagagatgataattaatgtatgcatgcacgccttatattatgagacataataaaaaagtggttgtgtcttatattttaggatggagggagtagctaatacatacaatagttacctataaacatatactacactattgatacatggtcccacttgccctacacatattgcatcttgcagtccgtgctacggctggctataaatctgtagcccgctgcttgtttctctccccgatatgtgtttatagctgacttatagtctggtatcactggtggagaagtagtttttactcccggttcgtaaccccctttagtctcggttttccaaccgggactacgaatccgggactaaagatcgctatctttagtcccgggtgaaataaccgggagtaaaaatctatctttagtcctggttggtgttaccaatcgggactaaagatggagcatgccaaccgggactaaagatagagccaggctgatccctggctgctcctttattatattcttttcttcattggttttaatatattgatttcactccatccccatccccaaaatcccaaatcaattatcacctccaaatccttaaatcgatcatctccaaatacatcacaaaatctttaaaaaaaaattacatcacaacttctacaaaattcatcacaaatacatcacatattcatatcacacacaaatcaaatacatctcaaatccggatcataaattctcaaaaaaaaaaaacaaaacaagccgccatcttccacctgccgcccagccgccaccttccgccttctgccagccagtgccgcgcgccggccgctgcttgttaatggctgcaataatggctgcaatctaggaaactaaataatggctgcaatgcagcatgcaagacactcatctatagatagccaaaaggcctgaggcccgacgcttggcccacggcacagcattttggcccggcccaagcacggcacgacccaaacggggtcgggcccgtgccggtccggcccaatcaccgggcgtgcctggcccctccaccggcacgttgggccggggcggcacggcacgatgggccgcaggccaggcccgacacataaacaacagggagtaaaaatagacattatatgccacggtcgaagaatagggacgtcaaatagacttatttaactatatatatgtcagcccaacgaggagggagggacaatagatttattttagctatatatatgtcacaacccaaagagaagggagggaaaatagacttattttaaaaaaggcacggtgggccacccgtgccttcgggctagcccggcatggcccgactactagtgggccgtgcctgggccagaggtgcagcccataggccggcacagcccgactactagcaagtgccgaccaggtcgtgcctgtgccgaaccgtgccgggcaggccttttggccatctatacagtcatgccgtgcagggcttgcgagcgtgacatcatgtatgacgaggagtctttgaccagcgactccctggatgaggccaacgagagagtgcatgtggtcctggactccatggacgctgccggcgatgaagtgctcgtggtcgtcgactccatggacgatagagccggcgaggaagtgtttgtgaacaacgagggtgatggttgaccaccgactccatggacaacacggccggcgaggaattgcacgtacgtgatcgccgactccatggacgatggctggctagtgactccatcaaaagtgcaatctccatttgcatcaaattttgaacaagtaagcacttaagaacattttagggatgctatcactggtggagaagtgctttttactcccggttcgtaaccccctgtagtcacggttttccaaccggaaaaccgggactacgaatccgggactaaagatcgctatctttagtcccggttcaaataaccgggattaaagatgaatccgggattaaatatccctatttttagtcctagttagtgttaccaaccgggagtaaagagagaatagtggtagtcccagttagtccccttttcttttttttttattttctcccaaatcaagtgggaagcatatccccaaatcaaagtaacatcctaaatccacatcataaataaagtaacatcacaaatcttaaagttacatatacacacaaatcaaatacatcacaaatcctaaaaagttacacacaaatcaaatatatcacaggtcatctcagatccatccaataaatcacaaaattatacatgtgaatcacaaattaaaaaaacagaaaacaacgccgttgccgctgtccgccacggccgccggcccgccgccgcctgccacggtcgccggcccgccaccgggcacggtcccgccggccgccgcctgccggatgggaaggggaggatgggcaggaaaggggagaggagaaggtaaagaaaaggggagggtatgagaaagggaaagaggtgaagggaaagggaggatgggcagaaaggtaagggaagaggggaggggatcgnataagnaaggggagnaggtgaaggggatgaggttgtaggaancggaggaagaagggaaagaaggggagagattcgatctgtgaaggagaggataagggatagggattatattgggaacaccaaccggatccggttggtgacaccaaccgggactaaagatcctcggccccctgacatcaatctgacaggggatgaaccgggactaaagatgatttttagttcggttggtaagaatgcctctgtggttttcaaccgggactaaagattatttttagtcccggttctttttggaaccaggattattgtggttttgggtcgatccagcaaagattatttctccaccagtgtattcttgcttctaacacgtacgtgtaggttctccttcatttgcacgcaaagaatatttctcagatttcctagtaaatagaaccaattttcatcaacaaaaacaacatcaaacatgcaggcccttaaaccctggatcaagcatggatacgcaccattgcaaccttgctttcttgtttgcatctatcaagtgtgactttatagcattcgaatgacatctactgagaccttctcgtattattctttgcaccttgtacttactcaaatgtaatgtaatggagcacaaagatctcaaagcgttgtttgttccttgaaaggaatgccatccagggttttatattttggaaagcaagaaaatttcggtgggcaccgaaatttcgaaaaaaaaatttgggatatttgcgaacgaatgttttgaaatttaaatatatttttactgaatttgaacaaattataaccaaattcataaatatttgaaaaaattcaaaaatttcactcgaaatatttgcttgccggtgggaaggcgaaattcccgaaatttccatccctgatgccatctagcacaaataaatctacttgaactcgcttgcggccaaagttgcatattctattattaacattaacatcaaccgtaatgcattgatcaaaataacttttaccttgcttctaaatacgttgaactgatcgaatgcgaacgttgaataactctgcaacttccctcgtcacatggcgctccagttttccatttgtgcttcttaatgcattagatatttgttttcgtgttgtacttggcacatctttcgtgcctgcgagaaaaaaaggctttttgacatttcgtttatgagtgcattattccttattccaggagtcaagatacaaggtggccaaacgggccgggccaaacaggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcggcacggcacggcacggcccgtttcgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggcgacagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgtatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttatatgcttttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaatccaaggtggtggcagttcgtcggctacaagtggagacgcctcttcgcatgttgtggccgaagagttgtccggttatttggacaacgacgccatccaccacgaagcacaagatttcaacgtcctcgggtggtggaatgaccacaagataacatatcatgtgctttcaaaactagcacgggatgtgttgacggtgcccgtgtcgacggtgtcctccgaatcggccttcagtctatgcggccgaatcatcgaagaccggaggatgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaaatagttctgacctttgagctgtactcttttctttgtcatggttttctcattttccactatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaataccattttttcttttttttaacattagcaaatcattacttttttaaaaaacttttatttccattttttaaataccattttttcattttttaacattagtaaatcattactttttttaaacattttggatccatttttaattttttttttccttatacatttcctttgcttttttttttaaaaaaaaacactgtgcactggcggcctggcggcctggcggccagtgcagctcagctgccggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctatacagatacacttaacatagtggataattaaataacatagtttagtaatatgcccatgctaaacgctacggtgaaattctatgtctttaattaaactttaaaatggattcggatgccgtgaatagaaaagttatatagagtacaagaaaatatattttccgcatgtcacgaatacagatgttccattccattttttgttatgtgtgctttttgaacaaaattaatacaccctgttcaattcacaaatggtaatcatcatcgatcaataacacccctaaccgtacgaattttctcgttttttttggaattttttcggctcctcaaaaaggttaagcgtggttggctatttttgcaaaaagctcctcgtgtttgtagaaaatatcgcacagatgcttaaatcgactaacaacccaccatattttatccggaaaaccccttatcttctagtgaaatacaatgtgaagaagagaaaattccgctgtaaacatggtaaggggtatttatgcaaaacatccatcccctacggcctacccccaatccccaaaccatcccccgatccggaaccagatccctctacgttagagggacgtcctcgcacgatcgccgttcatcccgcatccaacgctggcatcggctctgcggccgtccgtcgtcctcccgctgccgccgccgcgcgcgtcggagccgacgccatcgccggcgctacccgccacccccccggccccgccggccgtgagcgacgcgggcgtcgtagccggtgcctgcgctggcgctccctccccccttgttctcctcccactccgcccgccggcaacggggcttgaggtgccggcgaatccgaccgcgcacgggcaccccgccaccgccgcccgtcagatccagcggggagaggctggccgtgccccccgcgcctccacgaggggatctgcgttgagggggaggacgaggaggctgcggagaaggaagacgaggacgaggaaggccccagcgctcgtcgtcgtgcctgccttcttcgctcgttgtcgctcttctgccccatctccggctaccgccgtcgccgtcgccccccgggtccccggcatcgtcgccgctgtcgtggcctccttgagcccttgacgaggaggggcccttcacctgaggccgcgacgagaacaaggacgaggacgatacgccgcttcggctgatgggtcgtggcggagccagatccaaacgccttcgactcctccacccttgccgtcggcttccaggcggcgggcagcagcaggcatcggaggtgacccgggcaccgagcaggagttgttcttagcgtgcctcctacaacgcgccgtcgcccgcgacgtgctggtcccgtcatcagcgcggcggcgacgccgaggtatgggagccgcgcgctggtggtggccagatccgtgcgtcacctgcgcgcacaggcgcacaggcggcgcaacagctgacgcagcacgggaacatcgggtatgtgcttcgcacactcatctccatggataagaagcctgcgaggaatctcaccgcctgccttgccgccattgctggcgctgtcgtgaataacagcaatggcggaaagttgcctggtctgtcacggaagctgttccagaaggcgccgtcggaacacaagaagaacgcactgacggaggtcaagagcggtggcaacacgcgggcgctcgccatggtgctgcgcggcgagtgggtggacgagatcgctgcactccgcctccagttcgagcagaaggacattgaggtacacacacagacatatccacctcttccccactcctctgtgccctctgtggatgccaacgtgaccttactgcgattgcggcgttcaggttgagcgcctcaaggacctgtgcctgtggcagcgggaggagatctggacgctcaagggcgccgtgttcttcccggctacacaaccggaccacaacctcacgggacagatccaataccttgctgaaaagatcgcggtggcacgttttcttttcttttcttttcttttctttaacgtttttcaatgcagacacttcactaactctattgattacccacctaatcacctaatcttccgtctgcaatcgtttcactatgtacaggttaaaaccaagaaacatatgccaagatcatgcatgttttgatgacgaatactgctgttccccaagtactgtacgctggtgcttaatgagaatgctttctcactggtaattttcacatgctccaccattcgtctgctacaagtacgattttcaaaatccagatggaccatttgactgctactgtcaactgcttatatgtgctccttcataaattgccttcaaatcaatctttttaaatccaaagttcgtgctaccaagtttgcagtatgcattttcttctcaaacttgatagtctgctatgcaaaggtagttcagtggttcatttcttaataccagttttgaaagtctctttctcctgttgttgtttgtccttacagttgttctcccatggcgatgaaccacttagctatgattctcaccgtaaatttcttgcaaactattgatcaattaattagatggtttgatatttagttaaatattgatcagtcgcttaattttcttaatagttacatgatctatattccaatcagttacttagttttactataaatttcttatttcttgatcgataacttagttttggtacatgatctgcaatatgtaatcgatcttgacaccttgtaatcaacgttgctagctcccaagtctctcgatctttcgattctccccaatatctctttatcgttttgccatgcacactttgatgtggtaaagataaattacctacttaattaaccttccattaaatctttagattagtacctggtccacttttgaagtgccttctaatatttgtgttttaaatcgttagatcgaatggaatcaactgatctcgtttttccaaccataacataaaaatctccttttgtgcaatcacaaagtggaggtataagtagccattttacgtcttctgtgcacatcaaatgttagatgtgccttgtaaattctttaagttatttttcaggtagatgcttttccattttttgctgggccatcagtatcttagtctttgttcctgacaggcactatcgatcggctagatgttcttgaactcttgaatgcctgatgcttgatcagtgtgtcctaccaggcatgatatctccagagttcagatttgcttcttgtgaatactggctaagtaaaactggtaactattggcaattcggcatacatactactgaaaggacggtccttccaggcgtgacatctccatgttccagaatttttttgtgtgttttcactaacaaaggcggttattctttagacatttggtgctttcccattcaccaccgcatggatcttttgatatactatgcaggtaactaacagcacaggcaattatattctgctctttcaagattttagaatgatcatgtcctttagtttgtattttttgcatgtaccatacgattgatcaggctaaaaaagcatacccctttgtaattgagaacatattctgtaatagttcttttaggattgcgaacttcatttgtgttatattctctgttaaggaatgtgctaatcagcagaagaatgacaatagagatttttgttcccttcaatgaaccaccaccacatttgcagtccagcagaaattgaaaatagttgttctccagttgatggtgtaacaaacaagaagcttgtaaggttccccaacctatacaatatattctcaaccgcatacggcagcagtcaaattgtcctccgatatcaatatctggcgttctaatacccgaattttttttatccaagcacaagcaacacagtattttcaaatgtgagcacgccaaacccacatttttatttataggcaagatgcaacagtgattctattcaatcgaatgtcaacaagctaattggattagggatggcaattgtgcccgtttacccgtgggtaaaaaccctattaggattgggtttgttctccattttatatctatgggtatcttattgggttaaaagctacccatgcccgctttgcccgtttacccgtgaaatctaacttatatgtaggctaggagcaaaatccattagaatacataagccatgttctttgttttctacggtttctcttttatttcccttattatttctctccctttactctatcgccgccagaggagagacacgataccgaggcggagaatatttgatgttttaagttcgattcgaacttagaaacttgtagattttttgttccactgctcttgttgtggcgggaaaacaggcacgcccgcgggtataaggcgcccgcgggcaatgggcatgggcaaccatccttacccgttatgtagtaatgggtatacccacgggcacaaataatctcacgggtataggtatgggtaggtactacccgtgcccgtcgcgcccaattgccatccctaaattggatgctgaattgagttgagtacgtgcgcttatagaccaacagcccacctcctattagccagttagtgtttgatttagatattggaacaacatagtaggtgtaacatttttctactgttcaaatctaattcatccacgaggatcatcatcaaaaacgtaatttgtgctaataatcttcatttgttttgcaaagcagttttacatatcagttgttacaaataattgtagcatgcatataaattttttagtgtaatctgaataaagctaagtaaggtaccaacacgatagtcacgaagaagagagttatcgaggctgctgatttctagatgtttttgctagtaacaaggcagaaaaggcctattcatctatcgtggacatttactcaaactattctgttcatcataagattactcagattgacttgattacatgggcatgttgtttagaaatagaaattcaaatatcgtgtgctcacatttgtaattaacaggttgcatgtgcttatataccaaaaaaatggaatacccgaattttttttattcccagccgattatgataggtctgatcgttgctacgatggttaatacatgggcatgctcaagaacttattgtttttcttgcttattgaatgtatttttgtgtgctgatttttcccacaaattagttgtttcctcaagtataattctcaacgtttacaggttctctgtaaaaactaaatccttacgttgtttaaataaatgttgaaataatatttttattataaaattagcaattaagtttcaaaaattaatcatggagaatttaataaaaaataaatataaccatgttgttttatttttacacttaccttacctgtaaattaatttaattataaaaaatatccaagtatttcaagaaatttatattttaattagttacatataatgtaaatatttgttcactttttcttaattttctcatattttcttcccgttgcaacgcacgggcactttttctagttaggttctaaggaagtatagaggctggtctttggtgatgtggcgctgacgtggcacctaaagttagaaaaaagaaataaaatatggcgggaccgacaaaaaaaaacaggtctcacccaccgagtttcctaattagcgcagacgcgctagatatcaatctgacgcgtgtttccggcccatttctgttttgtccatgtattccggcccacttctgttttttcggtgtaaagaaacgtcgggaaagacggcgtgtcgtgcgccggcgttagatttggagaaaaaacaggattagttccgtaattagtttccgataattatgttttcaattaatcttgcctttttttcacaaggttgttttctttttttaactaaagattttaaaattttatacgtgaaatttaaaactttctatagaagaaaattgaaagtcacaatcataatttaaaacaactcaaaatttcaactttcaattcaaattttgaaaactttcaactcaaaatttaaactttcaagtcaattttgaaaactttcatcccaaattttaaaaactttcaactcgaattggaaaactttcaacccagatttgaaaactttcaagtcgaatttaaaaactttcaactcaaattgaaaaactttcaacttaaattttaaaaactttcaactcaaatttgaaaacttttaaggtaagatttaaaaactttcaattctacgtttgtaaagaggtataggaaaaattgaaaaaaaatcgggaaaaaaagagcgaaaaaaggaagaaaaacccgcctgtagacaccgaaatcgggaaaaaaaataataacagaaaaaaaaggtggggcaggggggctaggcttgctggtgcgtacgcgcgcattagccgcccccctcacccacgcctacgatcgcgtacctccggtcggtcacccacgccgcgtccgcgctcacccgctttgagatcggcgagccgctcccaatgttcgaccacggcccgcccgccgggattgtccaccgcccggcctgtcgtcgcaccctccatcgagcaacagcaacggcgcgcgcaggaggaggaaggcgctgttgtggatgatcatcttgttggcgacgtggctggggcgccgtcgatcggtcacgcgagaggaacgcggcggcggcggcggtgaggagatgaggatggtggtgaggaacagtagcctcgcggaggtcgcggcggggttggaggaatacttcctcaaggccagcgtcggctgcgtcgccggcgacgccatgtcgagccacctcgagtcgagcatgggttgcagaatagaagctttcatgccactgatcaccaccacatgaattgattttgttcatggtggaccgaacaacatcttggacgcgctttgctgcgtgtcagcgccatcagtggcgcacgaccacgtcgacagcatcaatggcgagcagaggcatacccccaccatgtagcagcagctagcctgggagaagaagctgtattgggaagtgaaggtgataacaacttaccaaaacaaagcctcaaactagccgtcgtaccgtattaccgtgcgtgttctatggccagtcgagtgatgcgatgttgcaatgcaggcgagagagcggctgcaggtccagaacgataagaagctggcggagctgagtgaccaggagtacagcaggaagattgacgtggatgtgttgaaggcttgaagctgaagaagaccgcgtggacctcgccaggggcagcatcgcgatgcgcgttggcgaggatccccgagctgccatcgggcgctgtgcccatcctcttgtagccggcctcgtctcccgcctcgccgaggagaggatggaactcctctgcgcacaccgcggacgctgctcctctccctgtctatagccggcccacgtgccctggaggctgggaagagaaggaagggaagagaggaatatgaagctgacacgtggggcttaggcactaaaaaacggtcgtgtttggaatcagccgttcccagattacatagctcacggaaaacgaaacggtccattaacgcgtgattaattaagtattagctaatatatttttttaaaaaagatcaatataattttttaagcaactttcgtatagaatttttttttttttgcaaaagaacacaccgtttagcggtttgaaaagcgtgtgcacggaatacgataaaatttcttgcgcggaatactgctctaggaccttatatgtactctggttttgtaagttgagggatgtgttatgtctgttattatggttgaaggatgtgatctaaactcgacgacaagatgagggacttgaagtgaacttattctggaagggagagaagagcggggacatggtgggccgaccgagcccagggagaggagggatgcaaatttgacttctgcagaaaaattgaattagagagaatttggatttgaattcaaattacatattcaaactcaagggatcaaggaggagtcaaggaaggaattcaaggtggtaattcgatgtttttggaactggaacaagtattagacaaggattaatcaaagggagagatttaacttcgaaatttgatttttgggggacttgattcagaatatggaatttcggggtgttgatttttgatgtcgaggagggggaacaagggaggatttaaattgatatccacaacatgacttggctgagtttgtttctaaaggttcccaacccatctccttagttttccacgcccacacttttcaaactgctaaacggtgcgttttttacaaaaagtttttatgcaaagttgttttaaaaaaatcatatcgatccatttcttaaaaaaatagttaatacttaattaatcacgcgctaatggattgctccgtttttcgtgcgggagggtagcgtttctaaccatgatgaacgaacacaggcttagaccctcactctataaagacagcaatgttcgatttttaaaggtgttgcatgggacagcaaagagaaatgagcgacgataggcaagcgagcttattatagatttactttatacctaatgtgtatatagggttacctccaatacaataaatgatagatatagcagcaagcgagtcaattatttacttgttttgaaaaaaaaatataaccatgtaaagaaaatgtacatagatatatcgctgctaagcgcgtaatcacgtgggccaccctagtagtacgtagttatgggaaattcgctattgaaaaagatcgttattatcggtgtcttttcctccaactagtgaattagctgctgattattgaagctgctttatgctaagagagagacgagcatgttttacttaatctgacgtgtatattgctatagcgtgtacatgtgcatcagtgcatgcctgcttagctcatgtcatattatcatcatgtcacatgtatagctcgccgccactactccagtattactggtggcaggtttggcgacaagctaactgcagcatactagtagcctaaccaatcagctctagtctctcgtccaaagtgaacaagatatacgcgcgcaaggacatgaatcgataaatcgaccgttttttatgcgagaactcagagctgtgtagcagtagtccacagtggccactggccagtgtatgcatgtgtgcatgatatatggtgatctgtgccaatctctgatgtgcagttgggcatgatactcgcaaggaaaaagaaagaagaacgcatgcatgatacatatatatcgatcagagaaattgagaagcgggtgcatgcctatatatgttaacagctagtagtagctagtggtatgtatacagtcagtacatgtgatacatcgtgtacgtggttcttcgtgtagacggccggtccggtcaatcgaggaaagatacgtcgtcatcgatctgatcagtcaagcatacgaggctggctacgactacgatacgagtggtacgcttctcttgctagccgcttgctttaatttggagcaatcgctccgcctgtctgaactaaagcaaccacattcacatacgtccaaaacttctttttttcaaaaagctatagctctttctatgctatgcaactgggacacctgtccacaccgatcgcttgatatacatatacacactgtcctgtgggtcaaaagaatctcgagcaaataaagcacacacacactgcgtcttgcgctgctctctcttctctatctacattaattggtggcttccgatcctgcgagggagagagaaggcagctgtgccctgtgatgtatatcaaggcaaaaaccctagaccaagcacacgtccgtctcatttctccccctttctgcttccaccatcaaacacaccgcagccgccgccgcctcctcctcctgctgctgctgtgagcctttgtgacacgcacacatctacattaatttacacatgtattattactacttgatcgaattcaatttgacagtaagctaggtggtggttctgcagagccaaccggatccaagatggaggcgtttgaaccagatcgatcctagctacgaccttcctgccctggaggatctgcacttcttcccagttctcacgaccaccgtagaccacagccaaggtaaaatatatagcatatctctgttattaccccccaccccacccaaacctaaaccctcttttatcgacgcttgcgagtgatcgatgttcttcactcatcttcctacttgtgcatttattttttatctgctcgatcggttgctcaaggggcacttcttgtctaccttaactaagatctcttttttttgttgccattattactcgatcggctgcctgcattggtggggaaatttaaagttcaaaaacctttcttttgattcggaccgctagttcgatcgattctttcatcctctcctgcagaggttaattggatccatgtcattgcaaaagtacatatttaaataaataccgttataattcgtctatttctaaccgtgtcattaaaattttacaaaattagaatcgtgccattgccgtcaagtttctatccatctccatcttttttttttccgtttcttctttttttttccctcccatcttctttgctttgcttggcggctgtgtatgatgtccggccgcgcgatcgcgggggttcagggcaccaacgccgccgtggccagcgcgttgatttctcctcctgccatgcgtggttggtggccagcgcacggcggcgtggcggcgggcgcagcaggcggggcaaggccgcactgcggccggcagcccggcacaaggcggcgctgcgggcgacggcgggcgcagggtggtgcggtggccggcgcaagcacggcgggcggctccctggcgaaagcgcggcggcctcgacgcggcttcggcgcaggctcggtgggcggcggccggggcacggcgcgagcaacggcgacgcacgcagtagctcgaccacactgtgctgatcgtcctgccaatctgccatccgttgtggtgttccttcaatccttctccttgccttgctcggatggtatctatggtggagcaacaagatgagccagaatggcaagaaaaagaagagcaagagctccaccatgaaagtgtacttgggccgtcagaagtcgccgtccagggacaggcggacgctgacaacgacggcggagatgacgacgacatcatcataccagcaggcatgccgacgaggtttagcttccaggagattacaacgatgacctccaatttcgcgacaaaggtgagaacaggcgggttcggcacagtgtacaaaggggagcttccaatggcgcggcgaggggctcatcgccgtgaaaaagctcgaggctatcgagctgaagggaagaagacgggagaaaacggaaaaacagagggatggatagaaacttatgatagtggcatgatcctaattttgtaaaatattaatggcatggttacgaatagataaataataatgacatttatctaaatatacacatttgcaaaggcatggatccaattattaataattgattgattgatcactcaattggtgggtttgtctctctctctctctcaacttgggcatgttaattggtggcctccgatcctgctattctttttaaaacatgggaaaattttaaaatccaccccataagtcacgtgacatactagggtgcatttgcaacaaaattacttatggttgctgttcgcaataacggaattaatggaaggcaaaattttaagttaaatatttgatatttgaatgcatgttcgttgaatttaaaaaatcttcatatatatatatagatgttcacaactccacgagattctttgtcacggcgttacgctgaagctgttagaaggatgacatggaaaaaaaaaatgggggtgaatgggatttgcaaggttgccccagttgtcaaaacacaagagggtggtaagaatttctcttgcttgtttaatctgacattaacatcaatgtgctatggtcttttggactaacaagaagtacatgcttttaatcgtatatcagggacctgtatttacaatgctatctgcagtactatggagtcccacctgaggcttaatggctactgcgtcaggctctccgtggaagacttgatcgagaaggagcaagcgctggtttgtgcagaagaagacaggacgctgcgctgcatcgaagtggctaagactctcggagtttgctcacaccgagattatcaggaggtgcgtgcgtacacatacgttatagttagacatttaggccgagttgagtttctaatttttttttcaaactttcaacttttccaccacgttaaaattttcctacagagacaaacttctaacttttctgttacatcgtttcaattttaaccaaacatccaattttaacatgaactaaacacatacttaattatctgttaatgctaattgtctgtttcttaattagagcaagcgcaagggcaccggccggaatgggagcacattcaagatcctctcgatcagggcctttctcaagctgaatgccgatgcttttgcggatgccattgaaagctgggggactaatggaccacttctagctgagatcgatgtggacgaaacattcatgcagtatataattaagttcgagcaagcgggtatcctgtcatatgaagcttacaatgagatcaacatgagagtccatgcagcgtgtgttctcgcgctgggcgtggagaatgtggtaccgttctgggagttcatcaattcgtacggcaagcttgggaagactaagggctacggcagagtggtaccccataacgtgagacgcctatttgagatcgtcgttgaggttccgaagaagagggtgaggggcatattcgagaatacgccgagcgactccatcgacacccaagacttgcggccttccaaggggagacctcctgtgactgatacgggagatgtcgttgttcctgttctcatgggcgcagccgctgccgctgggaatccattccccacacataccatggactgggctttctctgaccctccagatggttatggttcatctgccaagccggagcgcctccatatgatggatatagattaattagcggctttttctgaccctctagttctagttcctctgtaatgcgcttcttatgtgatcaacaactttatgttctgttctgagtatcagatgctgtgcaccgtgagaaacttaaaatactagtactccacaacaagcaagcgagaatctacttatccaaatccaacttgtcacggtttccatgttaatagtaattaataaagggagccacgcaacccaaccgtaccacaaaactgctccaacgacacattgcaacacttcttttaataagttttgagagtagcgggactgaccgatcatatgtgactgaccgatcggcctactaataaacaatggaataacgactgcctcataggggagtaattgcagatgcaggtgtgacaacaacaacaaaagaacaaccgtaacagcattccagaatgaacaagtagtcaacaacataaagaagacgctagctagctaatcttccaatcgtcgtggagcattccaagccatgcattcagttgacacttgatacttgatagattcttcccccacatacagcagcgtcacctctcctccagtcgtcagcaattctcgtctttcaagtctctctcttctttccggacctataaaaagcacactgcccaagtcaacgtgaaattgcacgaataattccagttggatcaccaacaaccttgtcctaaaggcaaatgatcactcccagacacacaattatacccaatttccttgggaagtgcacagaaaacaaaagggaccacagaagaaataaattttaaacacattctatagtccttattatgtaatgtggtcaacattacttgtcaatgccttcggagagactgggaactgagctatattattgtcatctttgtgtcaggtaaggttgttactctgcacagcgcatcgctagacctacttgggaaaacactgagctttgaacagaaacctaagttttggacctatgaaacagtgactatgtggttcctacatatgcaaggatagccagtgtgtcttgtcgatgcattgtgaaattcactgctgcactattagatctaatttgatttacacgaactaatggaatgatcccgtgaaatttcaaaagttctaatccagcattaaggcctattaataaattgtcaatttttttatcctaagaatgaaaaagctacaactccgtaatgatcgacgtacctcaagcatcagcatgttagcgtgattaatggtcagcccctcaggcaatgctcctacgtagccaacaaatccaccgtcctttggatgcctgattccaccccagcaatgggcacagatatcaacggaacctggaggtgacaacccttaattcattgattgtttcagagaaaaaaccatgaacttcagcacaaggttcaatatattgtttgaggcatttgtatcaggggggactgaaacgacagaaatttccgaaaattcggtccgaaattatttgattttttgaacaaaatttggtcaaatttaaacaaatattgccaaattcacagaaatatgaaataatatggtattaggggggggggtccaatagaaacaaaatttcgttccagaattttgaaccctgcttcagcacatgcatgtcaaaatgaatattcagcggcataacatttatcgattactccaatgataatttacaatgagggaagggaggaaacatggagtccaagtgcttaccattgtatttatcgacaatcttgcacattgtgacctcatttggtttttcttccccccttaattcagcaaaaaagggtgttgaacagccagcaacagtggctctaaagtacacgtgccagaaacattgtttgtcagcaagcctcaagataaacatgtggctatccttggctactcccttggttgctttattggctggctgaaaatgagaggaagggaacaatacaaggaaaaaaagaacagaaaatataatgaattaaaaaggtaactgactcaatcttaacaaactgattacaaatatatgaagtaagcagaatacttcagaatactaatcagatgatctccaaaagctaccttatatctaatacacacattaccatctgaggtaaaatataataacaaagataaatcacataaggtaaggtccaagataacatcagtacacacattttccaagttgtagtagtgcattgctagacgggtgcaaacacgtgtctggtgacattgacttgtatttttatgttcttgccaattcaatggtcccggcagcttgctgcggtcccttgaaattgcatccggctgtagcatgcggtgatgaaaaaattcttcagcagcactttcatattgccaaagaacaaaatgaagattagaaatgtgatgcacatctagcaaagcaaagtaactttatgtatgtgttccagatgttatttacgtaagtgcagatgctttggattgcttgccatgatttgctataaaatataccatttctaatgtacagatagctgtatgtagcagtcactgttgctaccagttgaaaaataatcttacatgtataaatatttaatttatatgcacatcatgtatggcctaaaagaaattagtatacataatcaagccttgtgcattaatggaagttacttcctacccatttcacccaaattattattatgttttggagaaacatataaaacacatgagaaaaagaaacatactcagggggacctttcttttcgggcttttgggacgccattcttgatagctcaaaaggagatgcccttaaagttttcctgcatatgtgaaagttaacattgaacttgatgcaggtgcttaacaaacacagattaccgaatagctaaagtaatacaaggataagcatctattgaatgagagctgcaatattcaacataaatataatggtatgttacaataacaaattatttaattcatctagcaaaaactatcatagacatcctattactatctttaatacactaaaaatacaatagaatctaattgggtgcacaactaattgggtccactcatactgaggtagtttaaccatgatgcatttcacctggtccaccactagggtgtgcactacattttcttccccataaaaggttgctttccccccttcgttttctcaaatgagctgaaggagagctatgcaattgatttttttttaaagagagcactgtgcaattgaggcttgtcaagtatcaacattttccaatctggctgattgcagttagatctagtttgcaaaatcttaagtcctaagtactaactaaatctagttaaatccaaatcaatttccacaaaatttgttaactgtaaatcaaatttacccaaaatttgttaactgaaaaacctgaagagacttcagtgactggaaaaaaaaaacctaaagagactttaggcatagataatccgaagtatgagggacaagaagatgagcatcaagcaaaactgctccttaactagtaaagacaaagaccgaacgaaaacacatgccatttaacagaaaaatatggcacgaatactttttaggtaagaaccgaaccacgaaaatatttgggaagcccgggattcagactatgagataaagaaagcggagaaacattaccagatgtatagggtggcgggcgagaatgattgagccgacggcgcgtgggaatggggtacgggacgacacgggaaagggtttagccggcggcgaagaaacgcaaaggcgtggccgcgtgagtgaggaagagagccgaggcttgagctgagagcctgagagtggtggtgccgtggtggagactggaaaaccctagtgggcgaatgctcgcgaacgcaggctttcttccgtttctggcccaggcggccgcgccttttccttttccttttcctgtgtggaataagttcactttagatccctccatttgtcattgagtcttaaattccccaacttacaaaactgtgcaaacgagatccctcggtagtattatctccggttttgactgacatagcgcctatgtggctcctttgactaggtcttcatcccacgtggcattgacatggacttacaaggcaattcgattcggaaaaataataaaacccatggacccacatgtcagtttcacacacaaaataataaaaaatagtggggctatatggtcccacatgtcatcctcactgctcccctcttctctctatcctctctctagtagtaagttgtttcatctcatagatgctctaatggcttcacttagtgacggtggagcgggatgggcgttggtcggagcggcggcgaccggagcatgccagtggtgcagagcggaccgtcattgtcaaccgctgtcacaccgccacagctgtcgtgctcaccagcaactgcttgagctcctcctccggccaccttcgccgttgttgcccccttcaccggccgaccactccataccacccgtcgcccgcttcggcagccgcctaccccgctccgctggttggagagagagggggatagagagaagaggggagagagaggggggatagagagtaggggatagtgaggatgacatgtggggccccatgggcccaccatttttttttgtgtgtaattgatatgtgggcctcacgtgttttattattttttccggatcgaattgccatgtaagtacaacgttaatgccacgtgagacgaagacctagttaaagcctcaaaggagccaagtatgcaccatgtcatccaaatccaggacagtactgctgagggatctcgtttgcactgattttgtaagttgagagatgtgttgtgcctcgacggatgaatttcgaactcagtgacaaaggagggacctaaagtgaacttattcctttctgtgtgaggccttgcggcttttcttgacgtggtgtgttatgcgcgtacactaacgtgatttggagtaatacgaagtagtgaagtagggttagaggggtgggacagtttggtctttggtgtgttattctcacgctgcacgcagtaggggacacagaggaagacgacagcgtcttttaaagtataaataagtagactttgttaaattcattttaaatttatatgtataaagtttctttactcaaagtttctattagagatagtttccatgcataaatttgtgctttaactcgtataaagtttgtacatttttaattttctttcaaattcatatgcataaaatttctgcggaatgtttctaaaaaaaaatctacgtatatagtttgcatgtagcaagtttggactttaattgtatacgttttgtatatatactgtattcgtttaaaaaatgagctttgtatattgcctcggaatactagatatcttaaacgtcctagattcgccgcgagctcagccgatccacgccattgaattttgcagaaaacccctcgttgtttcggtatttcggattaggttcagctgatcagagccgttctttctcacgcgtgtacgaaatctagccgttcattccctacgtacggccttgcctggtcgtggaatcggtggccggtcctctccccacgccgcctcctctctccccccctctctggctctctcccccgtctccccgatcccctttctctctcccttctccggcgccgctttcctcgccgccgtccctcttccccttcgggtgcgccgctccccctcccctacatcccgacctccgcctccaccgccctgccgtctctgccaccgccaccgccgtggcgactcgctcccgcccgcctaagcccactgccgccgctcccgagagtggaggcgggcggatccgcgtgctgccggcgctcccgttcctgccaggccgctcccaaggacgacggccgctggattcgtgcgtcaccgtcgctaccgaggacgggggacgacgaatccgcatcggtttcttcctgccccgcctcctcacggcgtgggtctgtcggtgggatggaggttcttgcccggcggcgcgggccggggagcgaaaggtgaggactttgtgtgtgttctcttggtgcgtttcttgctgtgatttcttgggggagctgttcgtggtttctccacctgcggccgtggacgagattctccatctctgcttcgggggatttcttgtgggtttcttcccttcctcttcctctctctcctgtggcaaggtgtgggaggacggccatggtctggaactctggatcttctctcttactgattttcctccagcacagacgagcaccacgcggaacctgcggctcgccgtcgacggcgccggcaccaacaaccaaactcgaacgtggaggggcttttggaaagttaagaatggggattttcattttttgttttgttttgaagctttcgctaatttattggtgctgaccatctagagtgagttgatgccttgcaattggctactgagctcagcatttgctttacttgatagtgctcagtttggcaattggaatatacccatcacatgatgcaaataattctagattactagcactgctttgttctatttgattatttttttactcatcagattatgtcagtgcatgtcaaaaagaccagtcagatgatgccaagtgatcaaaagatataaatactgtcgaatgatactaacctttgtactcattttattacaacatgaacaaacccttctttcttcaaccaaattctaccatcaaagcatgggatagctagggccatctcagtgccggtgagctggggacgtggtaatttcccggagttttcaatttattactattcagtttcttgatgtatgagtgcaacaagttagtaaaacaagctacaatttataatcgggtagtcctgtccatgtataacatggttatctttgtttatttcttatcttatatgctaagatatttcttctcatttttgcagggtggaagatctttcgatttgtgaagttacaccaatttactaactttgtgatattgcactaaatttaggctgtatgtatcagttatttcttccagattgttttactcacagaatagatatgtttttcatgttatcaatgcacatccttttagctagaaatatagccttggtgtttgcatgtcaactggagaagcatgtcgactgaaattggttctatttgttccaggacaatcatgtgttcttcagttcctgggttagcattgcttaacaccagcataagcaaatcttggagcgatgaggaacttgtgcgattcttggcagagaggaaagcagcagactctttgccggagaatgtagtggtggggatgaacttttctctcattgatccatggaattcaggttagtgtccaatctatacagaaatttattatgacgtattcctggtggtataaccagtcttgcattctgaattaatggtattctccaacaagactatgtcatgtaatatctgtggtctgcttttcataattcagtcgttatagaccatgaaggcttctttgttttgtcctttttgagttgttatatatatttactttactacagtttattatacgattcggtagtatagcagcattttaattcttaaatgataactaaagaaagggaatcctacatagaattgataactatttagggttaaaaggcatggaccattatgcaaaaccagaaagaaatatcttgggctctgatgaaagtccagagttaagtgcacgaacgcatacttcagccccattgattatggcaaaaattgcctgcatgaagtgctcataaactaaagtgggatgttatatgagaaatactttggcacttcacattaccctgagcatttctttttcatttttctttgtagcctgtgcaccaattgcttgcatgttttcactagaaaattctgaattacgctatttgacgattaaattatgttcaatgtgttgctcggctaggatcctttaacttttacatactcaccagagtttgctattatgagaggtcattgtttgccagttaaactttaagttttggagatgtcataatgcactatatgccattggttattatcaacttttgtttttagatactgtacaagcagatcatgtgctaagattttggggcttcagttcacttttagcattaaaatgtgcacataagaggagcggtagcagcagcaggaggataggagatgtaatgaggcaagagtgaacttgtgagctttcttaaaaactgtttattgcccagcaacggcgatgcgatgtacacagtcatgacagagcagatgaggtgggacttaaattttattaatcagagtatatgataatgttgtcatctgaatgtttgtaatattcaagaccttaattgctttgttttgatctaatttttttaatctttgaaagaattaacgtcgctataaatagaatgattctgaattttacatggagaaaatggtattcgtacccataactgctgcgatataacattatcttctgttaaaatgagttatcgcattaatagttttcttccattagggctgccaatgttctgaacttttgattaaatttgggtccagttgtttaaatgatgacaaaagtaacagttgctcacgagctctcattctctcctacaagtgtgttctattcatctatctatttttactgttttctagcatgccactgctttgtcgtccataactccaagcaaaaagcaaaatgttcggcttaagattgaaacaaaagcaaaatgttcggcttaagattgaaacaagctttgcagaacaagctttgcagaattgtcggacacaagttacttgggagggttctcaccatacaggtgcagacttgcgcccttttctggagtttgtaggttattagctttacaagagatttgtgctgcttttaatgaaattattatatagtccaacttacgaaaccatttgtaccgtggtgcttgcattgtgttgtggcttaaaacaaaattaataaggcatggatttgcaacaatgaattagtttttgtgtgtccacgggctctgtatgtcaaaaaaaaaaaaacttgtttgcccttgccttcttgctatgaaatattgtactgtcatgtaactaatgaatcgtcatttacatgtaaaagaattgcttctctaatcttacattcttctgtttcccgtaatttagtggccgcgccgcatagcgcgcgaaacctttctagtaaattcaatgtgggctgcctgataagctaggccatacgagaattcatgtctacatttgagtcgacacatacgttggccgcattcacgtggccccgtccgagcaagccttcgcgcaacaaca

SEQ ID NO: 30244 - DNA, 28397 bp, Oryza sativa
caaatgaagagttaggattaaatggaagagggaaaataaacggttaggatttaaaaatatcttttggtgggtggaaaatcatttccttttctcgttagccaaacactgccttcacttacagagatacattagcaatctaccatgtgcacagccgagtggacacaactaaagatgctctcattttttttggggggcccaaagtggctacctgctttgtttctcgatgcctgtttaactgtagaatagtaatgaagctagaatatccctaccagctggctacctctaaatgataaaattggaaccaacagaactgcttcagtgcttcgctatatctagattattgctcatctcgtgtcaagattcgcagatttcaaatagattagagtgccaacatttcaatagtcacaaattgcagattataattatgatatggcagtgacaatatgacatggtatttgacaaaaccatgaagtatgtagcggtactagatcaaccactggtaataaaacatgtctaggctctagaatcctataaatgtaacggaagattaccggcctctgccatgttccttcaggcattcttgaaaaatattcaggcgactgaaaccatagtacaaacaacaagcagcagagggacgtcaaaatctcaggtaacaatgtagcaaagtttccagcaatttcaatcctcaatctttcgagttttcatgaagcaaaacatactcccggctgcaaaaaaacaataaaacatttgtcagattttagatgaacggggttagtaaggaggcatatagaagcagaggctgatcatcattatattatatttacttttgggcaactagactcaaaagggccctaaatatggattagaaatagtaccatccatctaagaacaaaaagatgaggcttctgaaggatgaaaaccgtatgaactaggaaggggcactgtgtgcaaacttcaaaatctccacagctccgaacatatgttatacatttatacatgattgagcttgcaagtcaaggctccataaaggaaaattatgtttccataatgtagacattttgagattccttgatatttataaacattaatataccacctaaagattcatttggaaattgtattgagaaaaacaattaggcgtagtttacaaagatattacttagattattggagaaaaaatgtttatcccaagagtaccacaaatcaaaataaaagctctaattaaagagaatgccaaaagccagactgtcactttcataataagttgttaatttaagtcatcacataccaaagatacatatacattgagcaatatacaaataaacaaaaaagtgatgctttctttaattgatcatacctactattgccaaacttaatggtatccttttcaaagagttcataataacggctgggctcaatacgattctcctgaaaaaaaaatcaaaacataaatattgactgggtagaaaatattattagaaatgcgactagtgtatctgattagtagtaaaagtatcactggaggacttacattaatgaaagttccattggtactaccaagatccatcagataaggcctatcaaacaaagcagcaaaaaacatcataatctagactagcatacagaactaagataatcatgaattattagtacttgttattaaaaaaaatatatgcgttactagcaaggagtacctcacttgctttgacatcatgccatctggctgctccttctctacaagtctgaaaaggcaaagagatgggtgaatcacaatattatttctcaatatatactccttttaaaagggagcagtggtgatggtgagtggtgaatctgccaccaccccaccaccagctccctagtttttttggaatagaaaaggggggcctacatgtcaaccacccctaccaccaacttcctactttttgtgagaagaaaataggacagtgcacatgtcagtaacaaatatatacataaattaaggggcgatatacacagaaaatgatgataataatgagttaatgataattttctttatttaaaatcctgttgccacgcacaggcaatatgctagtaaaggcaaaaaacaataagattgctatgcttacctatattgaagaactgcatgttgcttactgcaggagggatgatctatggggatgtctgcaactttccgttcccttccaaaaaggtagctgctcatccggtgaacatataatggttctgatcaatcaagatagcatcataagacacagtcaaacaagaagagcaaaactgaagtatttaatcactaacgtaagcatgtgaatttttttaccaccctacacatttaatttataccactataatgcccaacctttaacttgctgttcatcacaataaacttcatcacttcagttatttcacttccgttcaaaactaaaactaatgagctatccatacgataccaatgctcaaacagtatcattggatatattcacaagccagtgtatactgtatcgtaaggaactgaacaatagcaaagcactaggcaggcttcattattacaaaccaatggaacaaaaagatgaggcttctgaaggatgaaaaccgtatgaactaggaaggggcactgtgtgcacacttcaaaatctccacagctccgaacatatgttatgcagtaggctggaccaaactggcaaacaattgcatggatacataatgcatagtttgcttatcagaatcaaatgctctgaataaggatgattctatgaaaaagtcataccgttaatctcacttgaggttaaggtgatgaaaaggttctataatgatgtaattttttactctctggagttttcagtctctcgcatagctttggtcaaacctgataaagcaagaggggtagaggatgttcttctgagagctgctcagtccggtggaatatctgaaaaggtaatagaggcgggtagcataatctttactgtgtcaagagactcagaagaaaggtttatctgaaagctgactttctttggggggaattttctggctttcaggtgtctgaagaaaggcttatctcacttctggagcaaatcaatacccacactagcaaacagacgaaagttacggtatgataaacgtggaaacttctatcagtttttgacataccatgtgcacttaactaaacaaacctaccatgcttccaatagtggttttgggtagcttcactacaactaatttagtttggtttgtaaagattctcgtttgttgtgattctttccaagtcactgattgtacatcatcaaaaaaaggaagagaaaatgatgctaatataggctagtctgtgaagggaaagcatccaatacacaactgattctttttactatgttttatttcgcagattcagaggcgccggagcgtccttgacgacgatgactagctgcatgtgtgttgtgtgtacgatgagctggtggaggagtctgccgtagcgcaaaactgcttgctaaaaatgatgattatcaaacgctatatcaacaaccatcaaaacttgagcgactatttgatggatatttggccgtatatgaattaattcgagtttggtttggcttgttccactgatgacattcaaactttcgacttctccgaagtgtgtatccatcatatcatgagtatgttagttgctcctgtctgatgttttgtcggtagatgaattccggtagcgggggcaaatccaggccccgagcaaagctaggccaggtctggggcctgggataaaattaaaggtccattgaaaaccttgatttttcaccaagtaaacttatcttaattaggccgaaacttttatggggcggttctaactcatatatcagcaccaagcgtgtcagtagtaatcaaatctatcttctcgaaggtcttctttttctgaccaatatttaacatggacagacgttaactatatcaaatgatggacaaatattgatagattacagttaatgggcgctctcagcttatctaagatgcgtttgtctgtactcattatcatatattatgaactcggatgttcgattggtaggcctaacttttggctgcaagctataattaattagtggactctaaacaaagacacgtcgtcaattaaaagtcaaggatcgtcgtatgacatggagtactaggacagtttttcaaaactcgtcttgagttgaatttgttgattaattattactagtatatacttataatttatatataaccggtaatatgctaatggcaagcacggataattagttaaaaataattagtagtgctagagctataccataccggcagatttttgtgaaccactcccttctgaattcttatggttgttagcctttcgttgttacagggtttggttaatttatgtgctttgttcattatataagtacactacagcgcatgattgctgtttatgattttatttttcccccctggatcctgttttgtatcggttagagctttttccggctagaaactgtccggtcttgttatcttgaatggcctgggcagatagatcagaaacagttttttgcaaagattatgatgctgtgtaattataatttaaatactactccattacaagtgtcctgttgttcatgaatattacgtatatactggtggagtttcaatagaaaatcaatgagatcggtgatatatcattaatttccgtttattagagcatatgttagctgacacattcacggagtgtgagtagttgcgtgtgcgcatgtttctaccatgtaattgaaaaaaaaactcactgttaattaattagggtccaaatatacacgtcagaggcccagtttagtttcaaagtttttttttctaaacttcaaacttttcatcacatcaaacctttcatacacacgtaacttttctatcacatcgtatcaattttaaccaaactttcaaacttcagtgtgaaccacaaccagaccgacgaattcaacagcttgagtagctaccaacatgcatgcaactgtctgatctcgtttactcagctagcctcttagctaggcttacaactgtacactgtatactaatacaaatacaataatacatacatacgagtatacgactatacagttggtatacgttaattaatacgtaagtacttgcctttcttcagcatgcgtacaaatcaaatatacgtataattctcggatctctcgtatcttcttctcggtctcgatggatatcaggctccgagttcgccgaccatgtattcgacggcgtcgcggatcacgcggagtagcaaaccggccatgtcgtcgtccgccggcagccggcggggaggacgatcggtgcgtcgacggtgggtgttgggcggcgggtttcccatcggcggcggcggcgcgagctgccgcggccgcccgtcgccgccggagagcggctgcaccggggtgttcgggtcaggcggcggcgggggagcaggccactgcctccccgacacgccgccgtcgtcgtcggagatcatcagcggcctcgtcgacgatctcccggccgacgacgacacgccgccggagagcggccccacatggccacctggaccaggtggcggcggaccgcgtcctggcggcctcctcagcacgccgccgccgccgccgtcggcgagcggcgtcacccggccatgcggacgaggcgatggcggggcgttacccgacctgccgccctcgacctcgacggcgcctccgacgaccacgccgtcgctcggcaacatcagcggcggcagcacgtgcagacgccgtgcttcgagcagcggagcgaggaggacgacgggaagaagaagcagcagcagcagctttggagaagacgaagacgaacccgccatggcgggaaggaaaaacaatgaatcgatcgatcgagaattcgagatgttgcaagcggcagcgcgcgcgaagaacgacatggccgcgtgagctcttatatatataggcaaagattagaattgcttatgacggctagaaagttgacaagtcaactgtttcttcttaatccataaaatgctacatgacaatatcccattcgaacgatatgatatttctaagctattatctgatatgatacgtgttagatatcggtttataactatttaaactggataatatctctaagtgatacatatctattgatttttatatatcaggtgatacccctgagatattatcccgttcgaataggatagtagcattttcaaaaagaatcttcgatatactagttaatgggtctgtttggtggagttttatattctgagaagcagttgtttggtagccagcttctgagaatctggaaaagctctgaaacccagcttctggcttcttagttcatttttcagaacctgtacctacagattctcagaagctgtatactgtttggggcagcttctagcagaagcagcttttaggaaaagctgcagctggaacaagttccccaaacagagccaatatttaacttgaaaagaacacgaatagcagtgtataaatgtgcgtaaatcgtcagttagttgctgcaaatagctagctgttggaaccgctaccgggcgaagattttcgctacgagctaaggttgcggtcaaagttgaccattcaacagacaagaaacaaccgcgacagacaacagccaccgcgtgagtcaaaacaacttttgttcacggagagaaaccgtgatggcaacatggagcccggccaagctagtgtgtttggctgcctgggcctttcatacttgtgctgtttttcttttcttttttttcttttccttgttaattagcttagataaattgtaggactaatagatttggatgtctcttattttagtggcctgatcaagtgcacaccttgcacctgccaggggatatgatcctgatgtgcggcacacctttcttcgttttatactgtaaatatgtaaatcgttttagttttattctaaatcaaatatatatattctgtatctatttaatatttttattttcgatgtatcgatgatgtcaaaccatccaacgctcatttgtcagtgtctctggtaccgtggaacatcatatatatatctataaagtttatctagtgtagttaagggaaactatatattctagaaaaaaatgataagatggattactactccctatttagtgtagtacgtgatagattacttcacaagcatgtaaggtctgtaactttaaaaaaaaattggctgtgaatatatgttaactagttgtagtttaatttttttttaacttgtattagttggatttttaacttgtattagttggatttttaaattgcatgtttgtgggggtgatatatcacatattagtacatcttctcaatttttttaatttttttcataactatttgaatggcataaaaacaacaaaggaatgtttgccgaagactttaaaatccactgtcacatgttatttctactaatatcatataaaattctagcagcaacacgtgggatttcatctatttttttcttgatgctttatggatccgtggtgcaaaaagtatccggtgttgtcccctgtaactaatgtttgaaatttcaattgcaaaccaaatatggtgggttgatacagaggatgtatttttatctttttttttaacaaaaaagatttagactttaaatctatcctctgatttcagccggattcaccaccgtgtatatatatatgcatatactgcgccaattggccacagagagattataattactgcatctccatttttcgtagttgagcgacgcaacaacgtgcagctactagccagctagtctttttgctcagctggtgtctacttacctagactctgctacgacacttataattaaataaaaaacgactatacaatatatacgattatacagtcgttataccgtatacatacttgcctatagctttgcttctgtatgcgtacaaatatacacgtacaagtacaactctctcgtatatatctcttcttctcggtgtcgagctctcgatcgtttcaggctccgagtccgccgccgaccatgtactgcacggcgtcgcggatcacccggagaaaagcggcgcaggggatcggcggcgcgagcgcgacggcgacgttggtttcacccggcgggtttccggccggcgtcggcggagcgggtcctggccggccgcaacaccgcgacacgccgtagttggagagcggctgcaccggcggcgtgttcgggtcaggcggcgggggagccttaggccacggcctcccaagcaatccgccgacgccgccgtcgtcgccgccggcgagctgcgtctgcgtcggcacaccggggtgccaaggagacggcggagtggggccgcccggcctcctcagcaatccgccgtcatcgtcggcggcgagctgcgtcggagtcggcacaacggggtgcgaaggaggcggcggagtggggccgaccggcctccccaccagccatccgccggcgagcgtgatcggcccgccaggcgcaaaaggtgacggtgggatgtgatcctccggccgcccgacacctccgacgacctcgccgccgtcgctcggcaacattagcggcgccaccaccacctgatgaccgagtggccgtgcttggagcagcggcgcgaacgcgagcaggacgacgtgaagaagaagaagaagaagaagcttgcaaggagacgacgaggcctccatggcgggaaggaaagggatcacaagctaattaagctagaaattagccgatcgatagatgagatgaaactctgatgcaagctactaggctgcagctagccacacccacatgagctctgttatataggcaggatttggtacggcgctcgtgtggtcgtcgtggactcgcgtggtgtgcatgtgtgatgactgagtcaacggttttttgcctaattaatccatcaaaagaaagaaaatgctcggattgatttgttaatggtttgacacggaaggaaaaacaagttaatggtttgacacggaaggaacaggaactgtataaaaaaacacctaaaatgggatgaatttctatctaaatgttttttaaatttattgtattatattatatcatatttcgtttataggttatgtttttttagaacggcgaaagtagtccggggtgtgaagcctccgccctaaaccgcaccaagtggagcaccatcctacctagctggctaaatgggtgccacgtacgcgtacacgtacatgtatcctcaccaatcttaaagcatgatagatctgtaaagtatttttgatttttttccacgtcgtattcctgtggtatatgtaggacgacgtgcattgtattcgaaataaatttcaaaatatactgttaatttgttttttcttaaaaatattcaggatgcaagcttattggtagaaatatacatcgacctcacataatcgttgcgcgagacataacgaaacagcaataccgaacagtatcgcataagaaacagcataccgaatctctggtccaaaattagtgattaattaccataattagttattatttaatgataactaagattaattagttgctaatcaatgtgattaaaacattaatcattcagccatgccgtgcggtctcgcgtattggttgtgcgagaccgtacgctttcgtggaattcccttgcaaaaccttggcgcgtcgttactccacgtcattctcgtgcggtggttatgtgatagcgaggtatatttctaaccaaaaaaaattgaagaaagaaataatatattttcaaaattaattacatcgtattctacccgcaccaccatcgctccgctgccagtgcacgtaggacacaaacaccaagacatacggagttacggacgacgaggaatcgacggcaaccatgggatatatcgacgaccacacatgcatcgagacattgagatgaactggaagtttcataattcatatatcgttttagattttctgagaacatacttgctccttttctaaatatttgacgtcattaacttttttaaacatatttgaccgtttgttttattcaaaacttttgtgaaatatgtaaaactatatgtatacattaaggtatatttaacaataaatcaaatgataggaaaagaattaataattacttattttttttaataagatgaacggtcaaacatttaaaaaaaaatcagcggcatcaaatattttgagatggaggaagtatattgttttagattgaattcggaattttgtctatgtatgtccgccgcgtgtttcggtcatatcatcgtcaattattaacgcgtacatggccggactgtcaaaccaacgctttcacgctggtgtgaaagggtgttttattttttcttttaggaaattaaggagtgcaaaactgtaagtatatgtttgtcgtgacgttacacacacgttcgttttgaagtactggccttgtttagtttccaatttttttccccaaaacatcacataaactgtgtttgtgtttagttccatgttaaaattagaagtttgaaaaaattgaaacgatatgacggaaatgttgaaaatttgtgtgtagaaaagtttgatgtgacggaaaagttggaagtttgaagaaaaaaatagagccatagaatctctggacacatgcatgaagcattaaatataaataaaatgaaaaactaatcgcacagtttacatggaaatcgcgagacgaatcttttgagactaattagtccatgattagtcataagtgctacactaaccacaagtgctaatgatagattaattaagcttaataaattcgtttcgcggtttccaggcgagttatgaaattagtttttttattcgtgtccgaaaatcttttccgacatctggtcaaacgttcgatgtgacatctaaaatctgttcgtgaactaaacaagcctgatggacaatggattgatagttaaaaattgagtttatggtaacagttttgatagttaacacgagcacacacacaaaagaacggtcgatagttcacacatgagtacacaacataagaaaacgggcttgtgatcaggaaatgaaacagtgactctgtgactcgtaaacatcaaggttggactcagtgcagtggagtactaatcattgacattaataacatatgatctcgtgctcatatgtcagcgagcagtacaacacctcgaattgatcaaagattacgacctcgtaactaagccgtgtacactgccgggcggcttggggagagcacaggttggccaacgacatctcctgcaaacggaggaggaggagcagccgccgccggccacctcgccggcgcgccatctccgtcatgccagcgcggcgttggcgaatgtgatgacctcggcggcggcggagcgcgcggcgacgacttcgccagcgcgccaccgtcggcatccgcgctgctccacagccgcaacgccgccgccgacgacgacgacgcatgtacgtgtggttggtatgcgtctcctggatggacagaaacagcacaagaaattttctcggtgaatgacaaattactagctatcaaacccagtaacccactattctaggccagattagcaatcaaaaccattctttttcacatgatcaatgcgactgaaaggaaccaatgcaattctgcgtgctgttgtgttgcctacctagtgttcgtgcatccaaaagatgagcaaagatgatgatgaaatgggcgaggacaagaagcagtgaagtagacagtgatctgtccatggccgatcgagaatactatgcaaggagagcaaaatgaaagctaatagctgaatgtgctcttagcttgttgtagatcgattggtacatggatgaagaaattaaaggtttgggaacattagcatttatagtggctgaaactgcacttctgttgtcgaaatggtttttctttaagaccagaggacgacctctggtctatggtgtagttcaaggattccaggcttccagcattggcatgtgtacagcccagtagacaatacctaaagatgctcatacttccatgtgattagctcttctgtcacctctctactcattttcctgcacccaaattgggttacctgctttgtctctaacttatttgtttgcacccaaaatgcataattgtagtatagtactgaacctacagcttagaaccttatctctacctctgtatgataaaattcgagctaactgcttggcactagattatttcttatctcataacaagattctcgggacttcaacaatttaaaatgttgacatatatatcattagtcacaaattgtccatttataatcatgcatgttatgataataacaagacatggggccggcgaaaaacccaatacaacctggtattttggacaaaccatgaattcaatagtgatagtagatcaaccaccgaagaaaacagccccatcgtttggctgttgagaggaataagcaaaacaacatatttacaaataaaaaataatttatgaaaaaacttttatacacgtgtttttaacgatataaaagcaaaagcagaaaagtaaactacaatgattaaaccccaaaatcaactccaaatttaaagttgaaaatttaaattttggctaataagtataagtataagcgaaaaaatggggccgcaagcctatcatcctacggatgtaatggaagattgctctttgtcatattttggtcgcttgcccatagtcccgtcaactttggtggcttgaactctcggccattgggcaaggcagatgcctatgatgaatgaaaactctttctatctatgtgtcacgccccgaattagtcccgaccggaactaacccgtgacgctccaaattaacctgttaatcgataccagtcccaggaaacagtgctggtatcacagggagacagaatatcacagcaacagaagcctctttattatagagtagaagtacagtcatgttgggctgtggacagatcccgagctcacaactgcattacaaaaggaaagcggaagccaggacttggaccaaacaatcacaggcgcgacttgggaactaggccgaaaccctaaaactcatcgtagccgacttgctcctggaagaactcctcatcagcaggatccgcttcatcttcttcagcaactggggggggagatatttatatagagcaagggtgagtacgggagtactcagcaagccaggggaaataagtgtttaatgcaggcttcaaggaaaggctgttgtttttgcaattgattttatttgaactcttttctaaaagcaactgtattctttttattaattcttttaccccttcgtcgtctttctgggcctcccggatttgcgactctagggtaggctgtactgtcaagctggctgggactcctgactgtaccacggtcagccttaacttctccaattctctgcacagatgatcttggtcaggccgtatttgagctacattgcaataggccttgcgacttagcgcatcagcgaccacgttggctttaccaggatgatagtggattccaagatcgtaatccttgattagttccaaccatcttctctgcctcatatttaactcggtctgtgtgaagatatatttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcgtaggccacaaccttacgttcttgcattaggacacatcctaagccttgtcttgatgcgtcacagaagatctcgaaatcttttcggatatctggcaaggtaagaactggggcagtggtcagccttttcttcatttcttgaaagctgtcttcacaggctacagaccattgaaatttcttttccttctttaacagctcggtcataggtctggctagcttagagaatccttcaatgaatcttcgataatatcccgctaagccaaggaagctgcgaatctctgacacattcttgggcgggttccaagcaagtacagcttcaaccttgctgggatctacttcgacaccgttggaggagatcacgtgtccaagaaatgctactcggtccaaccagaattcacacttcgagaatttagcgaatagttgatgatctctgagcttttccattatcagcctcaggtgttcagcatgttcttcctcgttcttagagtatatcaggatgtcatcgatgaataccacgacaaactggtccaggtattccataaagattttgttcattaagttcatgaagaatgctggagcattggtgagtccgaaggacattactgtgaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgtggcaacgggtacttgttctttatagttacttcattcagggctctatagtcgattaccattctctcagagccatcctttttcttaaccaggagcactggggctccccaaagggatgagctaggtcgcacataacctttactccctaactcttcgatttgtcttttgacttctgctaactcattagctgccattcggtagggtctttttgcaattggagctgtgcttggagccagttctatggtgaactcgatctctcggtctggtggcattcttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttatgcttagccaaccaatccatccctaggatgatgtccaagctttgcgagtctaggactatcggtttggctaggaagtcaacttcctcaggggcgtaccgagccaacttgttgaactgacttaggtactcattgacactgttgttgccttgtttaagtctgttgaattcttctttcttcatgtcaatagtgctttcgggcacatgagctgcacggaaagccgtagcgaactcatcccaagcaatgttagtgggttcagggtgtgcattgcggtaattctcccaccaatctgcggcaggtcctcttagctggtgagaggcgtagagcgtcttctcaaccggagtacactgcactaagttgagttttctatcaacatctttcaaccaatcgtcagcctcgacgggctcgacggtctgagagaactctggcggacgtgacctcagaaagtctgtcagcttggatctattgttgcccacgtgagggtggccatttccatgcgcattatgctgaaagctggctatggctgtggttagtccttgcaagatttgtgtctgaactgccattatgtgttgcatgttgttttccacatgaggtggggaagggaggcgttcttctccagaattgtgactggcagtgcggtgagagcggtgagactgctccagctctgcatcacgggaaactgtgcgatgcgagcggctactgcggcgaggttgctcaacctctgcgttgcggggaacagtacggtgcgaacggttgctgtggtgagaatgctcattagctggttcgtgatttgcttctgcttcaactctaccatcttcaaaaccaaagcgggctggtgcacgagctgtacgacgggggcggctagccatctaaactcccagaaaaggggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcacacaccacctaggagaaccagactaccaaacaacacccacaacaaacacacgcacgcactacctcgccacgactccaaaagagttggcggcggaacaaaaggggcctatcacacggacggctgctgaagactgcctcctctactcctcgtcggcctggctgcctcctgtagtcggctcctcagttgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgagcagagccgcgggagctgtgggaggacaggtggctagcgtggcagagacggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaagacgtggaagctgccggaaggcggagcctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgagggtaaaggtacacagagagcttacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtaaccattttagaaacaaactattgaaaataaagaaaacaaaagaaaccttagcttttcgcaagtagttttgaacttagtatccttagggtcatcctaagcgtcgggtttcgccctagggccaagcctgtgctctgataccatctcttgtcacgccccgaattagtcccgaccggaactaacccgtgacgctccaaattaacctgttaatcgataccagtcccaggaaacagtgctggtatcacagggagacagaatatcacagcaacagaagcctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcatagccgacttgctcctggaagaacttctcatcagcaggatccgcttcatcttcttcagcaactgggggggagatatttatatagagcaagggtgagtacgggagtactcagcaagccaggggaaataagtgtttaatgcaggcttcaaggaaaggctgttgtttttgcaattgattttatttgaactcttttctaaaagcaactaagtgagtgcttctcaaacgacacggttgagacagtgcgtctcgtccggtcggagtatgtgcaatgtatcagtctttagatcctgaaacaaggttggcacccggccaaaagctttttgaacgaccacccgggccaactcttttcaaacggccacccgggcccacaacttttaaactgccacccgggcctagctgatcccgtcagctgcaggttttccaaacatcgaacccagtttcacaacagcaatttcacaagcagtagtcaaacaaaactacgctaggaatcacctcacatccgcccatgaccgtgggcacggctgttcgaacagtttaatgacctctgcagagggggtacactttacccacacgacattactaacccgggtcacccagcccgtggggatcagccacgtcgggagacctccaagctttcatgacaaggcatttcgaaagccgatgcaggtttaccatatgccgacgagaggggtcctagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaaattcatttagttcgcagacatcgacccaagtgtcgggtttttccaagtcttttgtaaagctccagttttacccaagttgttactcagattttaactttgaaggcgaccgtcgatactcgcacagagtgcacgagtatcgaggcgcaactggatggttacaaggggacatggcatagcaattaacaatggaaggatcaaatgcgacaagttaggtaagtccgccaatctgcttcgcagacgggacaacagattaagtgtgatcctatcaatgcataatactttgcaagcaacataattaaatttcaaatataggctcaaggtgttcaaaggtggcttgccttgctcgagatctggagcttgatcctcgaaatcctcgcactgcgggtcttcgggctccggaactacacgcgaaacggaacaactcaacaaacggcgaaaataaagccctattaatgacctctaagcatgccattagatagatctcgagatttgaggaattttggaagttgaacggagtcaatcggatttacggttgggaagatattgaatttctaagattattggatttctggtctaacggaaaaaggattaaattaaatcctttttggaaaagaaaaagaaaagaaaagagggagggattatagacttttcctcgggcggctaaggcgcggcccaagggaattggaacggaccggccgaactaaatgggccggccgtcccaagcgcgcgcgtgcgcgggggaggggagagagagtccggtggaccgggctcaccacacgcggtcccgggtgggacccgcttgtcagcggctcggctcaccgtgcggagggcgcacgcgcgcgggcggggaggaacgcggtgcacgcacgcggtccgcggcggacgcagatgcgacgggcccacgcgcagcctcacggcttgcggtggaacgcgcgcacggggagggaccgaccggggtcggctcgacccggtctaagctgagctggcgccgacgtggcgcctacgtggctgccacgcaggacggcgggaggtagacgacgacccggccgcgaatggacggcgggcggcggcggcgagcggcggagcgaaccacggtgatacgggcaaaagcgagcacaccgggcggttgttcgtgacagggggaggcgagccaacggctcggattcgccggaggtcgctcgatggcggcggattgcggcggcggcaaccggcggcggaagaagagggaaacggcgacgaggccacgaggggtcgattcccgtcggtgagagcacctacgcggcttcgggaactcgacgctagcgtcggattgggcggaactacgccgagcgaggccggcgacgagcgggtgctacggagctcgggcggcgacggcggcgagcacacggcgagcgaaggcgacggttggggcggcgccggctagctacggggggtctactcgagctactaccgaaagctagggggaggagttggagcgaggaggaagaacggagagagacatcaccgagaagaggaggggcgctgtgacgagaggccgacggcgcgggagtaatctctccggcctcgggccggggaaggggaaggagagggcgcggccgaagtccccttccgcgtcctcgaatgcaccggctctcccggcgctcggcgaaggacggcggaggtgagacagagcacggggcggcggctatggcgcggagacgaatggaagaggagggggggtaaggggaggccgggggtttaaaggggacggcaatgtcggtttgagaaccgacttgcgcggtcaaggcgcgagctggcgctccggctagcgaccaaattggcgacagggaggatgacgccggcgggaggaaaagggaaaaaggagggggagaaagggggcttgcccctttgccggatcgggaaaaggaggagggagcggggggggcgatgacgacggcgatgacggcggcggtttggagcggagcggcgacactggcggcaggcgcgggcaggcgctgacgacggcggcgaccgggcggtcggccattcggcacgcgcgcgcgggaaaacaacaggaggcgcggcggcacacgcgctcacgcgcgcgcggcgtgcgggcggggcggagcggagggaggagaggcgctcggggcgactctcgcacgcgcgagcagcgcgcgggcgaggctgagcggggggggaggagcgcgccggggggggagagagagagagaaagagagctcgggagagagagagagagatgggccgagcggaattcggcccatcgaaccccgggggaggcaaactaaactttgcggagggaatcgatttgaaaggatttggattcggatttgaactcgacgatagatcggggattgagatcttgagatggcacggacactagacaacaagcaaggaaacaaatttcgcaattagggtttttaagaattaattttcctgctaggcgccacgacggaacgggcactacactatggctctgcgatagccgcaagaaggtcgacaaggctcataggcgaggctctgacaccgttgcaactcttgtgacgtgtacaatctagaaagaaagaaacaatagagtgtgcaacaaacaacagcgaacatagcccaaggtggccaaggcgatggcagccgatgcgacgctttggcgtctgcccaatgcgttggtgccggtgttaagtccttagccactagagcggctggtcgccaaatgttgagtcaggaataggcttcggtttcttagtctttaatgtttcccgcttcccttctccttttattttttttgggtttgtttgtaaaattttatttcttttaattaaaaaatacgctccctgcatattccaaaaaaaaaaaaaagctctttgcaatgttcagagttcagacattcttgtggtgctccaaggagaaatatattcaggcgactgcaaccatagtacagacaacaggcagcatgctgagggatgtcaaaatctgaggtaacaatgtaccacagtaccagcaatttcaatcctcattcttaatttccagttctcatatgaagcgaaacatactcccgccagcagcaaaaacaatagaacatttgccaccatttagttgaacggagttagtaagttgttttaaaggacaaatatagaagcagagacatccatcacatcattatttctaccctataatcattaatttgttgggtaactgggcgcaaaagggaacataggattaatgacatataatgccatttaggagtacctaagaataaaattatcagggtactcaaggatgaaaactctatgaactagaaattgcattgcgagacttcaaaatttccgctgcactgtacttccaatctatctgttgacagctaaatttgacactaaggaagaaatataataaagtttgaccaaatttgaaaagaagctcgagccttctatacaaagccgttctattctgtaaaaaaaaaaaagaattcctagccacaagtcttctataggattggtcttttttttttggacggaggggcaccgaccagtgaccgttgtaaatcgttgtggtgacaaaagcatcaacactatattttatacttatactaattgaatactcaaaacttctaatgttaacctgaaaatggaaaatttagtcgtggattagatagatagcactatcctatttcaaaaagtttaattacatggtctttagatgagaccttctgctagaaaaatagccacaatgtataccgttagcactatgacttctctctcctctaggatcccctctaaaaaccaacaatgaatatgctcttattacatcagcctgcagtgtaatacggaatcttggaactatcatgccctgcaacaaattctgtcccatatggatgcttgatacggtcactacatgagtgacaacgctcatagtcctgattcctcgtcattacataatcaattctcctgttgatctcatggcatccacctacaattaaagcaacatcaacatatcaaataaatcgctgagaaggtcctacaatcacacgtacaaacatcaataaccttacagtaattacaaataagcaagcatattaatcagaatacagtcaattggtcgacaataataaacataccaaaacaagaaccctggaggttgtggatagagacgacacacatgggctcgatatcatcagcacatccaacaatattaggatcaaggctcaactctgcaaagcgttccatcctctttgccagaagatccggattcaatttgagctctgcaaagtacaggctcttcttagcctgatcatcattctgagccctggcagtaaagttgacatgggcgtatgtggacccacagacctcatgaaaacagtttgataaaagaacagtacaaagctcaatcttaacctgaacaaacaaaaaatagaaaggttagtagtttacaacattaagacttatcatgtcatggaaagcaaaaaaaggaaaagggctattacaatgttcttctcaatattgttgtaatggttaattgctaaattggcgaagcgatgagcttggggacaaactttcttgccagcgagctctgcctccatctcttctgcggtcaaatgttgctcactgcaatatattcaaaagagtaatagattcaacagtgtgttggacaaaaccaattttaggtattcacttaaaagtttaatttcacttcaactattgcattctgtatttctgttgcatatacaggacttcaattgttaatgcgttctatctctgaccaccagctaaatgaatcaactgaagttattttataatttaactgttttagtaaccaagaatggaaatgcagcttaaaaaaaatccacatttcttattaattaaaatggttgcaggttctaatatcagtttacccatttacaggatcgtgcaggattcatctccaaagtaactttggcttttctgtctccacctcttccttgtgtccttaggagatctattctaagctgaattatcgatgtcttgtttgctgtgatcactactgttttataagtgataaaaaaacaatgatagtttttcacatgaattttgtactgaggaatataatgggtgcgcaatttcacgtgtgttaggatctacgaaaggaaagttctatttgtatgatgttttcttagtgatgtagttgacatacccatgagcaaaaaaaaaaaacaagaagaagaagaagaagaagaagaagaagaagaaagaagaaggggtttaacatacggtgtatcggagaggacgcggggtcggaagatttgttcgattttgttcttctcgatgtcgatcatcctctgatagaacctggccatctgcgccttggactcgcggaaagcgggcttatcctcctccctgaagcagtgagccttatcgctcatgtccaagctgtccgcgagaagctcctcccatgtcatgggcctctttctcaggcaaggatggggtagcgtgcgagggatcctcctccacctccctggcgtcctcttcttcctcgccggggcctcgcatgcagaccccgccgccgccggcaggaaggtggaggaattggcccccgattgcgacggcgacggcggcggcggcggcggcagagagtccagccattcccgcgcggtgatcgggacggtggatccctgacgaacctggaacatggagtaggtcgccagtttctcttctatggtgggccttctcatctccgcccgccgaatcgcagtctagggttagggttcttcctcctcgcgaactcgatgggagaaagaaagtggtcctgatatatatatatcgatgcgaaaagaaatttatgcatatgtcacggaaatcaacacacgtacatttggctcctgctcagctgatcctataccatataacgatacaaataaacatattgaaattaaaacaaggaaattatacttctgacagatcaggctccgagtccgccgaccatatgtattgcacggcgtcgcggatcacccggagaaaagcggcggccggcagccggcgcagacgacggcgacgttgtgtccacgcggcgggtttcccggccgctggcgtcggcggagcgtgctgccggccgtcccaccgcgacacgcgcgccatcggagggcggttgcaccggggtgtcgggggccatgccactgcctcctcggcaagccgccaccgtcgtcggcgagctgcatgtgcgtcgcggcacaccggggtaccaaggttgacggcggcggaggagagcggcgcggcctccccagcacgccgtcgtcgtcggccagactgatcggcacggcggaggagagcggctcttcttcgtcctcagcaagccgtcgtcgtcggtcggcagcattataaccggcggcgactcctgcagacgtagtccgccgtgtccgagcggccgtgcttggagcagcggaggggcgagccggacgacgtgaagcatcagcagcagcaacagtgcaaggagatcgagacgaactctccatggcgggaagccgggaaggagaaggaagccaatcgagagatgtgatgtgtacgtgtgttgcaagctgcagcgcttcgttttgggtatatcaccgggaaagtattttctacacatggtacctaggtgtatacatgtaatttaaacagtcatataaaagttttataaaatttaataagataggctatgttaatataaaacactatacaaacatacaagtctaaatttaatcgacatacaaagaaaaaaaataacaaattttatctgcactgtacagggactagtcactgtctgattttattatttttgtttctttagttatagatcaaatttagtcatgcatgtttgtgtatagacttatatcatcacaattgatgttactattttttttttaattttttctataactatttgagtatactctacaaatctcgtcaacgagtatagcccgtcgacaataagcattaatcccaaattctataaagttatcaaaactgaaaatattataattgtgagacccaaactaagtacaaccggatattattaattacaaattttgaaatttattaaatcatggcaaacttataattaagacaccaatctgaatacaacttagtttttattgattcagaatttcagacttattgaaacatcgaaaagatacatgttaattaaggtcgaaatactaccatgaggatcgatagatatatatgctagcctacttagctagtgacgaaattaacatgcatgcaaaataaatatacacatgtgctcgtctacttaagctagacatatattcatacagttggtaattaatggtacagtttatataacttcatcttcttcctcggtctcgatcgatcaggcttcgagttcgccgatcacgtattcgacggcgtcgcggatcaggcggagcaaaccggcggcatcatccgccggcgccggcggccggagcgggggatccgtgcttgttcggagacgtggagacgtgataggcggcttgtttccctgcggcgacggcggagcgatccccagcggcggcttcccgtcgtcgtcggagagcggcttcgtcgacccacccggctgaggcgacggcggagtattggtcggcgccctcccccccgacacgccgccgtcgaccccggccagcggcgtcaccggccgatttgactgaggcggcggcggcgccccgccggatcgtcccagctgtcccggcacatccagtcccggcgaggcggcggccacggcctcgccgtcgtcggtcggcagcattataaccggcggcgacgactccagcagacgatgtccatgtccgagcgcgagcggccgagcttggagcagcggaggagcgagcaggacgacgtgaagcatcagcatcggcagcagcttgcaaatgcagggagatcgagacgaactctccatggcgggaatgaaggagatcagaaggaagctgatcgattcgatcgatggatcgagagatgtatgcatgtgtgtttgcaagatgcagcgctcgcggcgagctctttacataggtagggtttaattgcgtacggcgcttgtacttgtcgacaatgtgtgtggcgattggtgagtcaacggttttgttagttaggctgtgtttagatcgttgtaaagtttggaaaaggactgaaattggagatgatgtgactgaaaagttgtgtgtgtatgacaggttgatgtgatggaaaatgactgaagtttggatccaaactttggatctaaacacagccttagtattgctgaaccatcaaaaaatatatatttaatttggatcaactagtcgtcgttaatgtttagtactccctgtaccataatatatataccataatatgagagattttgagtttttacttgcaacgtttgaccacttgtcttatttaaaaaaatttaaaattattatttattttattcgtgacttactttattatctacagtactttaagcacaacttttcgttttttatatttgcaaaataaaattgaataagacgagtggtgaaacgtagtatggaaaaactcaaaatccgggacggagggagtagtaacaggaaaggagcacgaatgacagtatgttgtcagttagttgctaccgtacgcattttttctctgcgagctaaggttgctagcaacataactgttcaacagctattagttacaaaagagaaaaaaaaatgttcaacagcaaggaagcaaccgcgaaaacccacgtgcgtgaatgaccggagctagtgtcaaacttctgcgctcactcgatcgcgatcgatctggccgtgaattggtgagatttttggcttgcagtcacatgaatcttaatgcgagcattcaaaccatcaaaccatgcgagcattcaacgattttttatgcacttaccacaaaccggttgctagttgctacaggctacagccagtcactagcaggttttggaagcctgatggcgaggagctgacagttttgataattgacaacataatcagccaatcaggccatgtttaagggagcttcttgtaactgcaatttcatcttcggctcttcaaacaatctagcttttcatctagattctaagggtctgtttggaggagcttctagtagctgcaacttctcctagaatctccagttgccaaaaactccctcaaacagtccagttttttacccagattctgaaaatctgtagttgtagaatctgaaaaatgaactaggggtctgtttgagggagcttaagattctgagaaacagctggctggttgccagcttctaagaatctgaaaaaactgggtttcccagcttctagctttttattttctggattctacaactacagcttcttataatttagaccaaaagctagactgtttaggggagcttctgattctgggagaagctgcagtagctaaaaactcccccaaacaggccctaagaataagtagaatttagcttgtttttcgtattctcacccgatggctctcaaatttcccaaacaaaacggcattccaatcacacgaatggcagtgactaccttgtaacatcaaggttacaacaaataactaaacgtctaaaccgtgtatactgccgggcttgggggacgctgtcgcggtgcaggttggccatcatcgtgtcctgccaacggcggagcaacagcaaccggccgccacatcggcggcggcgcgccacctccgccgtgttgatgcggcgctgggtgcttcggcgacggcgggatgtacggcgacggcctcaccagcgcaccaccgtcatccgtgctgacgctgctccgccacgccgacgcacgaagatgtggatgggaggagtaggcttctcctgaagcgacaaaaacagcaggagaaatttcgtcagtgaagaacagacagacaaattagctatcaaaccatttgttatacgtagtatttttcacatggtcaatgcgtgatgcgtttggtcagtgaatgacaaattactagctaccaaatgcactcctctctctctcttttttcacatgatgcatgcgagtgaaagcgt

SEQ ID NO: 30245 - DNA, 251 bp, Oryza sativa
ttatcgcccagcatcatcttattctctatttgtattccctccatctttcagataccgatgtagccttggatgtgcccgtgcccaatgaagagaaaaagcgcaacatgaaacgtaagtacaaaagtaccggacacccacccagatcccaatagaattccgccaaatcctgcgggaaattgtaatcccattcaccagctcctacatttaattaacaagagaactattgtatttatctaacacctggattatct

SEQ ID NO: 30246 - DNA, 19724 bp, Oryza sativa
gcggtacagctgtaatcaaatatgtggagctctgggtaggcttaaatatgtagcaaaggaatagcaaatgctcaaatcagataatgcaaagttgaataattgttcaaagtcaagtatcgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttggtgcggctttttttttctttttttttttgcacctttctaccttttttttcacttttttcttgatttttttttaacaaaaactgactcaaggaccttaatgtaagattacagggactcaaacataaatataaaatttacagggactcaaatgtaaaagtctaaacctaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaataatcttgactacttccaaaatcagatatggtaattcaccttcctcctctcgtgcacgacagaggcacggccaaaacaaacacacacaaggatcggcaaactctagatgcaactcaagaactctaaaactaaccgacagaaacttctgaaaactacaaaaatagaactgtggcagcgagtcgattccgttttcgtaggtcccgacaacaatagagacacggtggcagcgacgactgtggtacaaaacatgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgattttttttgtatggctattttctggttataggaagataaaaactcaccgagcaacgaaagctctgataccacctgatgaaccctgagttcctctcaacactcaaggctgatgttggcccgatctttcggtgagttgtgataactacgatttgggagaaacgttgacgatccgactacaaccgtacgagacgttgtgttgcgccttagcgatcgatacacctctccgtgggttggtgatcttgccggtgcagatcaaccctattcctgcaagcaaatcgaagaaacaagcaagaacaagaataaagcaatctgatattgctaataggaatttaatacaaatgataagttggggtttcgaatacaagcagacggacggtctggccgacacgcgcgctgcaagcgaagtagcaatggctaaactttcatctaaacaaaacccgagaaaccctgaaggggtaactagctatatataggggtgggaggacgacctaggggtgcctagggtcgtgctccaccagcttggggcgcaccccacatgggccccacctgagccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaccttcccctccgtcgtcgactcgtcgtcaccggctggaaggagagggaggggcataccagatctagaagataacgtcgccgtggtatccatgctcccttccgcccctccatgcccgtcgcctacctccacccctcggctatcgcctgtctccaccacgcccaccggccgccgccgccgcctccgcgcccatctgccgccaccgctgcctccgcacccgctgcctttcacgcgcgccatccaccgccgctccacctccacaccatgccgcttcgctccgcccgctcgggcgtatcggttctgttcggctggagaaaatggatgctggggttggggtttggtcctgggaacgttgatgtttatatttttttttctttgctctcacagtaaacttggtagactgttgttaatcaacctcaatatacgtgagagattaattagtaactatgtgaagcatgtttagcaaataacattattttttaactaattcaggcttaaaaaacatatacataacaaagttggttagaagatattattaaaatatatgaaaggtgatatggaggatgtaatatggatgatttgttggagtaggaataaatatagagagagaatctttttagatggccatccaaactgagatatggagtaccgaaaactgagatatggagtaccgaatttagatgagttgctgggcatgctctaagccagatgctaatactacatatgcatggccatctatttcacatactctcatgatgcaactataaaacaacaacatacgtgttcttacttcgtttttgtggttaatttcgccgcatgttcttaatgcgtttttttgtggttcatggtatccatatatgctacaagactacactagcatgactgtgccgtatatctcgtatatgtaccatatgtgttttgattgacagtggcgtacaccatgtagctgcactaaatttagtaaaaagaaagaaaacatgcatctgaattattcatataaaagaaacacgtattcatagacagatctgaactagtaacggacaggctgaatctgtagtgaatctagtaggcagcgggtggtttgggcttgttgttcggtttgaggatgagatcggctagaggataccagattattggtcgcttatgggcttggacgccggcagcgaagaagaggatcagggcccagtccgacatcacggcctggtacaccctcggcaaggggaggacgaggctcatcaccacgagcagcacgccgcacgagagcgcgaagccgatccccaccgccgccgtctggaagtccgacgatctcatcgccgcgcgtgaggccgctgacgccatcgatccccggccccctcccgccgccgccgccgccgagagaattcccttttttttttcttttgctgatcctatcaatgtttctcttggcccttgccccccttctctttcaatctgttgctgtttaggttatctgatgttggttggggtatatatgaactggaaaaatataaatcatgtactaatccgtgtcctaaaacatctcggtccccgatctgtttggttatctgatgcgtattggctcgcgcgcgcgggtcacgaggctggtcgctcaccactcttcacgcctcccgccattgccgtccagttcctctcacacggagcttggccagctcggcctcatataatagcatatatgttttctcattatattattcaaatatattaaaatgacaatataattttaaattttgtaataactttacaaaactactaatgtgcaatattcatatggtattttatatacgtgtttgttattaattattttttaattccaaattttctgtaaataatatttttatatagactataggctcttcttccaatattatttatttttatttttgaatttttattatttctaattgtatttctatgtgtactctaaactcatttttcaattttctttagtttttaatttcgaatttcaattacttctaaattgtattcctatattgactttaaactcttcttcccatgtttttcttaattttgaatgttagttatttctaaattatatttttatacggactctgaactctacttttaatttaattatgtttattccgaattttagttagttttaatttctatatgaactctatactctacttctaatatttcttatttttttaattccgaatttctatttttttaattgtatttctatatggactctatactctacttctaatattctttatttttaattctaaatttctattatttcctaattatatttctatatggactctatacacttctaatattccttatttttaattccgaatttcagttatttcctaattgtatttctatatgactctagtctcatcttctaatattccttattttttaattccgaatttcaactatttctaaattgtatttctatatggactcttgtctcctcttctaatattccttatttttaattccgaattttagctatttctaaattatatttctatatgtgtaagttcaagtgccttaatttggtttcggtgattaatgacacatctaattatatgagactaacgtttttatgagcctttctttgactagtcttatttggatatgaaagtaaaaatgatgagaggtatgtattaaaaacttcacatattctaacttggtctctcttgtggatccaaaatatagtgtgagctccctcattgatcttgattgataatgtgcatatgcattccttcatatccatatatatatgcacatcttgagggggagcttattctatattttattcattataagatctctatcttgatttgaaattatctttcatctcatcttattgtattgtttatatcaggttattatctatcacaaaagagagaaaagattgaaagattttggattaaacaatttgtgtaattgttgctttggtgatagatgataaatcgatgtttatgggattaacctctctttttcataagttgttaactaggttatttcccgatgatgagatgtggtagatatgcattctttggtgatggaccttaatcatgacaaggatgaaatgcatggaaataaaacgatatgtaccacttcttatctcctttttgataggtttatatgtatgattttcatgttattgttatataagtgtgagactaatgtttactcgagtcatatcttatttagtctaatttacattaagagcatggagattatgaaggtatatgttttatattggtctacatcattactacatatgccttctctatgtgtataggataaaccccccattggttcttctttacttatgcatacacttgtctctcttgtatatttctttgtatgcatatacttagggggagcaaatcctatacatttattgtgtatgttctagatccatgttgttcacctattatttatatcggatctttgcacttgagcttgcatacgggtatatgacacttgaggtgtaaatgaatactcaacaaacatatccatatctttcatatgcaaccggttggtcatcaagtgaaggatgacaaccgatttgttgagactaatgttctcctttgagatgtgaaaaggaataggttccatcgtaatgaggctaatggatgacaacatgggttgatggtcaccaagacaaggacatcgccatgttgacaatagtgaagtcaagattgtgatgagaagaaaggcttgacaaaggatggtcaagacctcgggataaacatggttcaagcaaatggtcacgagtgttgatcttggctcaagcattgaccccaagttggatggcgcaaggcaaagatataatagaactaaaaatgttttcttagtcttttcccggtcttggtgtttggtgtagaccggatttgctagataggcgccgtactatcaagaggggtctatgaagcgagcatgtggatgatcttgtgccatattagttcatatgcatataggtgtattttgtgggcttgtctagacaagtgtggtgagttttatcaagtcccaaacaaagagagaagtgggcacatcctataggtttgggtagcctcatgtggttatgtccggtggagtatcctttggagtgtgagctatttctccctgataaaagttgtgtttattggatggattgttcatgggttggatagccctttgaataagctttccatatagtccaagaacgccaaattccgagatccgagtcaagagatatcgtcgttttactaacggttggttgtgctgaaaagtgacctgcggtctgaccgtaggccttaggtcggtctgaccggggctgttagccggtctgaccggtgtggtaaggccggtctgaccggccctactggtctgttgcactggtctggtttttggtggcgatacagagccgccagagccgcaaccggtcagaccgagccgacggcggtctgaccaagccgtggacggtctgaccggccactacactgctgtcagaccggccaggttgagtgggctcaatgattgccctgtaacggctagttttctagccgttacaaagtagtccggtttgaccggccactctatggcggtctgaccggccgagcacagagttggggatttcgactccaacagctagtttaggtggttgggagtatatatacctactccccagcagcaagattaaggttttggcactccattgcattatcttgaacctttgcaagagctctcacatccttgtgaacttagtttatctagtgatgtgttagagagtgggataagccaatccaagtgcattgcttcattgttatagctagtgtggcacttgatcatcctcagcaagcatcctagacttgttactcttggaggttgccgcctcctagacggcttgtggaggtgttgcccggtgacctctccgaggagattgtggaggaggcccgacgccggttgtgagtagtttggagttcaccaacttcggagtgaaggaagaactactctagtgatcgaggcttgggtagtcctctccgtgggccggctcccaccttgcccacctcttgacgaagggggcgtgcggtggcttcgtggttgagcggtggagttgggctcgcctcaacggggattaggaaaccagcgagtttccgaacctcggtgaaaaatccctcatctcttgtcccatttatttgttgcatttacatttgagcaagtttacatagtagagcttatttgtgctattatcaccctaggcttgcaaaccttaacatagagtagcttctttgtgcacttacgtgagactagttgatttaggttttgaattgtgcaaaaccgttttgatttacgcttccgcatacaaaactcgattttagccaaaagttttaaaaccgcctattcacccccctctagtcggccaaaagttttaaaaccgcctattcactcccctctagtcggcctccttgatcctacaatatggactatgcttttttctttttctttttctccgattaatgtgagaatttataggtcatgagagcgaacgaggagactcctttttctatttctttaataatataatagatttggacaggcccttgttcagatttattggactagtatatattctatccaattccaaattgatgcgttgaagacgcctgctgaggtgtgatagagtaggtagacgatcgatgacatatttgcggatttgcctctcggactttattctcaacacgcgcatttctctcacgaccactcacacaaagggaatttgatttgagtgttgtggagtaggtcaatatataagatgaaaggccttgcggacaagatgcagtccgcaggaaagcaccttgatgatgatctcgtctcctacatccttgctagtatggatgttgattttaatccggtggtgacatcagttgcaaaccggactaaagctatcactgtgggtgaactctttgctcgacttgttagctttgagactcgtatggagtcgtggaggctttcgaccgcaggcaaggtggtgactgcggccgcggacgtcggcgcgacaataacattcatcccatggaaacaaatattaattgttagatttgtcattataattgcttccaaattatttctccttccattttattcatattataagatactttgattattttttcaaatttttaagtttaaccaagttaacatggaaaaaaagcaacacatataaaattaaattagtttcattaaatctaacactaaatatatttcttaataatttttttgggttaaaaatattgttatatttcttttatgaagtagtcaaacttaaaaagatgtcaaaatgtattctgatatgaaacagagggatgactatttttaaaaaatttagggtcacaattaacaaataatagtcatatactatgtttattaaagaccgtcttataatatataaacaaacctgcattttggatttgatcgattgatttagttgtgagggaaaaaaccccattaatccgtaccacctcctccaaaaaatactcaatccttgatactctgtaataaatatggccatatatattgctaaatacagtctgcggtctgcctatacttttgatttttttttcaaaccaccctgttaggggttaattaatctaaccatataatgtgtggtccaaaaccgatacacgcatcatcgcaggggagaggaaacggctcaagtgtgtactggttgccagcatgtttgacttggagcttcgattattctatgcgtgtcttgtacccaacgttgcagttgcactgccaccgagggcagcaacttgccacaaactttctttgccctaatttggtacgagcaccaagggattagactaattaaacctattgagaaaccggtcactaatcgttaactacctctacgtatactctaaaaacctcgtgaacagtcactggcatgtagaaccaattacgcctaacctgccaacaaatactataacgttagtgtgtctagctccgtaagagcaagaagaataatagtaagctataaaactgatataagctatagtaagctataaaattgatataagcttatgtgaaaaagagaagtaacaaaaaaaataaataaagaatattggctgttatgcaagagctagtttaacacgtgttgcaagacaaatatattaaatgtataagtaagagagaagaagaaaaattaaagctaatcttataactaatctatcatatatgttggttttaaaatgggctaaatgagtttacaattaaacttgctataacaaacatattctcgtaataagataaggtgagaacacatgacagccgccgaccaactaattaagccccaaacatgagacaaaaacgacctcgaattaatcatgggtggcaagtgcgagcctctgacagaataattggacctcaaatcgatcgcttagttaggatttatttctgacttgtgatctgcgagcgctgtgaaggtggggggtgatcttgatttgtttagcccagctgtggggcaagatcctaagctggctgggtttagcagttttcaaacgcttaaataatgcgtcgccgggtttggtgattagcgctgggaatctcttcgcagatgggaacaaaagtccaacacgacaccacacagggcaatcgggggcagcgtcctgccattttccgctgaaaattttgatcggtggttgacccctcttccgtgtgtgggacacgggtgaaattaaacggcattacgtccatggaaatggttctcgattgatcggtagttttcgtattttatgaattctacaaattgactttatatagatgtttaaaaatttattttacttttatagaaattatgtttgatcactcagcaatttctgtttcgtttatatttgacattctccctccgtaaaaaaacatagtattagaatgtgataacgactctataagaatgtccaaattctttgtattattatatgccacatcttagcacaaggttgtttttgttttttttttgacgaatagagtagtgcgcaggggtgcggtactctctatagtcgtcgcagctttcgattgtgtaacaacagggctcgtttgaaacacgagaggggaattactgtcaacgatcactgtgaaaaaaagcctgtaaattttctcgctgtcgcgagcactagcaacgcactcgcgactcacacatgtgtgtgtggcacgctttatggtggcacgcgtgcgtatgctagggctaggaaggtctcgcaggcaggcaggcaacgagaggcttttctcctctataaaaagtggttactgtgcagaggtcaagccacacacacacacactgatacacagatcggcagaaaggaaggagaagcagccaagcagaggccccggtcttgtcaccggaaagagagaaaaagagaagtgaaattgaggaagaggaggagaatgtgatggcgcagcagcagcggcggcggcggcgcgggggctctctcgccgtgctcctcctcctcctcctcctcgcggcgctgctgctctccctctccctcctcgctcgcgtcgacgccgccgccacggtttcgtcaggtagtactctgttgcgctatacctcgccgtcgccggccggccgtgcttctccctcttctttcggtttgcatcgtcgtcgtcgccgtcgttgcgctcatgcccgtggttctttctttctttcttgcagcgaatctcgattggaatgagggagaggtggcggtggcgactccgctaggacaggtttgcctgccttcccagttcttgaatctttgatcatctatgtgcatcctctcctcctgattacgctactctttaattaatcttgtttttgctgtgacaggaggcggtggcggcggcggaggaggagggtgaccggccgccggagagggtggagatggagtccatcaacgactacggccaagccagcgccaacaaccgccacaacccgcatccgtgacatgacctgccaaccggagctggatcttaattagctactactagttaattatctatgcaatgttctcctcattatctaaaaaaaatgtaatgtgttctcctcagtataatactctctccgtcctacaatataagagattttaattttttatttgtaacgtttgaccactcgtcttattcaattttttttgcaaatataaaaaacgaaaagttgtgcttcaagtacggtagataataaagcaagtcacaaataaaataaataataattttaaaaaattttgaataaaataagtggtcaaacgttacaaacaaaaattcaaaatcccttatattataggacagaggagagagagtacttgttagtgccaagctcacacaccactctccctgctggtcaacctgtacttgtagaggcatgcatgtaccttcacctttgcttcgttttcgtattagaaagagagatcaagagaagcatcgatttctagctttgtactttcgagttcgtattagctgaaagggacaaaatctgaagatgcaggcagtacatttgtcactcgcaggggaaaaaagtgcatcgactaaatttgacccaaaattaattcagcagcttcagtcacaactaaaaagttcagagagcttgggagctgagcagaacaaacaattcttgcaaacgtatgtaagttgagtccgccccaattcatgcaagtttctagcatctatagcttctttcataattaaaatctccccacaaacaacccagcttttcatccgatgatgaataatgctgagatcaaggccaaagcggtgactggtgatgacgccaaccggcggatggagcagccgctatcctgactctgctcggaccaggggctcttatgcaaatactcagacgctaccattggtaggctggtagcgatccaatgttttgcaaagattttgcttctctcatctcttgcttttggttaaatcttatctctcaactctaaaactgggtataacatctcctctaactttaaaaaccgatgtaaattaacacctttagtagttttgaaacggtttctgctcacgtggttggtcaactggtccacgtgtgttgatgtggcatcccgttatcaaagaaattgaaaataaaagtggggcacacaagtaagtgacaagagtaaaattttaaaaattgtgaggcccacttgttagcccactactcccttctcaatcttgacgtgtcaccgctggcggcagtggacagtgacggtgatgacatgcatcacccacaatgacaacgagcactgccgtcgcacacgctgtcccatactcgtgcttgaagagccccccgtggcggcgttgaagttgggtccggagacggcagtgtggttggcgacggcaggggtagcaagggaaagagagtagcgaagaagatttactgcttccccatgccaccggcctgtctcaccttctgagcgtcctgctgatatgagagtatcacctacctctgattggctcgccagggaagagaggaaagagaaagaggaggagaggtgaggaagaagatgaaagaggaggaagtcattggcatgtgggtcccacctgctgactcagtgagtcaaatctgccacatcagtagaaaccactccccaaacacccaaggagttgatttacgccggtattcaaagttgagggaggcgttaaaccggttttgcggttgagggttgtgattcaatcagaaccagagatgagggaggccaaatagacttactcattttgcaaaatgtcgtacactggctttaatgggctaggcccacttgtccattgggcgcccccctataccttgggcttccaaccaatccatgggccgggaaggcatcggacggccgagatcctcccatccatcgcggtgtcccgatcgcggccgtcgcaaagtcgcgcacgggacacaagccgaggagggttttgaaaccatcctgggttttccaccttttccagcggccgcgacaagtccagcgaggcgcttcctcctctcctctcctctcctctcgcgacttcgcggcggctcgctcgcctgatccatccgtgtctcgcgcggcggcgccatggcgggggaggcttcgccgcccgcgccaccggagatccccacgaggtgccaccactgcgccggccccctctccaaggacatggtacgcgtgatcccgctccccccaccccaccacagctcgtcttcacctccccgggatctctccccttggtcgtgcaggctccgctgcaggagtcgtgggtggctggtgcccctgcgtcgcgttcgagtggggtttagttttcgtttggcgtccggaattgggtcgtggttctagttggtaagttatggtgccatggtggtgttggctgttcatgtatataggttgtttctcccccttgttgatttggcctgcaccgtggtttgtttttggatcatgctgtgtggatggctacctaccctaggacaagtagtttcggctcgggagggaagagttttgtttcaggccggggtcaaactaatttgtgcgattgaactgattcgtcgtgtgtggttgcttttgaaggaaacgagcagctggacggtgcctccactggttcgagatagcttctccatggtttgtgttcctttgtcttcaactgtgctgcacacataaattactctctctttttttgtggttgcacaactttatcgaattcggcttttctttatctgtttttcttgtgttaggttgatactattgtacattcttttttctatcttgtaaattctgatcggtatgttgctaaagttgattagatttgtttcatgacatgtatgtgatttgttataattacaaacttttacataatactaaagttgtcctagaagatctttgctaataatatttgtgttatgttctgacagattggttctgctattgggggtacagctggagcattttatggtttcaaccacagtaagttgctaacccatttcattcagttactcatgcacaagttggtattttgcaggaaagtaaatcattaggtttctaacaataccttttagcaccttgtttgcacttaatttactgtggggggttctaatagttagcttactgtggggagttctaatagatagcaatatcccctttgcttgcttggctagtttactgtggggagttctaatagttagcatacttataatagtcatttgccttattggtgaacctcagtcatttcaaagctcagaaacatatgtggacaagataatctgtagttttttattgtctcggaaatgtattgttcatgttgtccactcaatgatgattgttatcttctttgtaaaaacaacaccttgcacactatagaacacctttcttgtacatcctctctgtgtccatgtctatatgcatggtaattcctcctgttttaagttattgattgcaacttttgttggcggatgcatcttgaacaaaattgattgaccatgtttgccctttcataaaagttgatatatcttctgagcagcactgattttgaacttcttttgtagctatgccttttgttcgacggtacataaaagggccaatgtggatgcattttcttgttggtgtaagtgacaattctttttcaaagtttatattatattattatcaatctattgagcatgaattaggctgtgttcgggagtgagggttgggtcctagaacgcaaaacgaagcagtgtttagcgcatgattaattaagtattagctaaaataaatttgaaaaatggattaatataattttttttaagtaactttcatatagaaattttttataaaaaacacaccgtttagcagtttgaaaagcgtgcgcgcggaaatcgagggaggtgagttgggaaagtagagataagaactcagccttagagtgttgcagtttttagatggtgtattattttttcacttcctgattatgtttcacaatctctaggtcatctcaaaactagaaacacaatttgatgccttttcttgacacctccgtttctatgtaaattattttaaaacactacagagaaagcattcaaatttcatgttctatctcttatcgccaaaacatctcttatgttcttttacttggacgggatcgtgagttcaaattcacgcgtatggtcacagactcacagttgcatccaaagggcagtctcagccaaatgctgtgcagttccttctggttcaacaaatgctgtgcagttcctgactttcgattaactaatggtgataattactatattcacaacatttaattgactgtctcatggttattacagataaaagtgttctcgctattactgataaaagtgtataaactgcgcagagatgctaccttttgaagcaaactgtggacattgataactctgatctttttttaaaaaaaaaaatcttgcaggcacctccagttattgtcttctcttctgcatgtgctgggttagcaggtcagttactactattttattttattttggttttttggccatttaactatttttttgctcatagttctgttgtctacaaactcaaattattatttgagttttgtgatatcgtggattcgtggtcattatattaggtttcaagccgatcttatttaagttttctgcagagttaatctatcttcctgtttgttttattcctgatgatgactagttgcgatgtttctatagtgccttgatacctgctcatcatagacagttacttgaaactatgagtcttatgactacacatacatattctgtttttaaggatgttctatgcactctttaaaatatgtatgtgagtacctttcttgttgtttacatgtaaacaatgccaggacgtagtgttatattgtttatgctgatagatcttatgagctcgtgaaacattgactagtcatctgccatctggttactgtgtggtccatgttatttctcattgacgaacctagcgagtcaaggttcatcctggaaatgttttattctcttcctcaaatcttatcttctattcaatggatctccatgaaattgttcgctacagatacattgattggaggccaaaaaaaaaaatcactaaagcgcagcaatgacacatgtggttttaataataatagaaagaactaatagttggaatattcagatgtagttcaaaacctcattaaaattgttgatttttgccatgtcactgtttttattcactatgcgtgatggatgatctgaaggttgatatgtttgtaggtgggacaataccagcgcttgcacagctggtatcatcatcctatcactcagccacagcgtcgtcctttgcccacacaacttctcgtgatgaaatgcataaggccagaagctcctcgacattgtgatctacagtggcagcaaattgttaactggaatcctaactatccaaaacaccatatactattataaatgtgcatgtgttaccacatatcatctgttttatgaggaatgctcttgtaaatggtaaaactttcccctgtggaatagtgcttatatatgttcccaattttgctatttatcaccatgcacaggctgttatttttgttatggtgtcgcaataagcctggagtgttgcgaattgtgatctgctttaaccttcaggatgccattttcgtttgcaatatatatgcacattaccttttgctctctacttgtctaaacatttaccatgtacgatgtctgtcgttttgactgttttacgcgcatgccattgaagtgagtttttacttatgtgatctgtactcctgcctcaatttatttgatggcatgtggcagattaaagtgtgttgtgccaccctaggaatctaatctaggatacccctgccggtgccggatcaccgtttgtgatgaccgtgcatgatagggtgtggcatggtgtccaatgtttttgcatgcattgaatcgtagccatcatacattgaattctcgcgcctcgtttcggatgccatttgatctatctcctctcgctccatccatttcatgtgccaaaaaggccactgatgatgcaaaacagtggcgatctctggctgaatcctcgcggaatggcagtgtgtggacgtgcctctctttgcagccttgtgttgtgatgtgttggagtacatgcttacatgtgtacatacgccgaggcactgtgagatgcatctagccacctgcgtcactgcgtgcgactgccaagatctctcgccgaaagttcgacgagatccagtgctctttcaagcactcactcatttggtgctttggcgatgcttcgagatgtttgggaagcttgttgaactagagtggagatagatcatgtatgcttgtgttaattttggcatgttcctttttagaaccaaagggagtaatacagctactatcttaatataattcacgccctatttgggtataactctaggctgcgttcgttcgttgtgatgagttagttagtttgtgtgttttgttttccgcgcgtacgcttccaaactactaaacggtgtattttttgtaaaaaatttttatagaaaagttgttttaaaaaatcatattaatccatttttaaaatttaaaataattaatactcaattaatcatgcgctaatggctcacctcgttttgcgtatcttcccaatcttctccatctccttcaccccagctgacaggattggaatccttgcgtccacaaatattacacatggatacttatggttggattttagttaagtcagcaaaattgtcactggactttatctcttgtagtactccctccatactcacaaaggaagtcgtttaggacattgacacggtcttcaaaacacaactttgacttcttgtttctataaaaatattcattgaaaagtgatatatgtatacttttataaaagtatttttaagacaaatccattcatataatttttatattttcaaactcaacaacttgagagttattcatgatttatattttcaatgtttgacttaaacattatcctaaacgacttactttacgagtatgaagggaatatgtgttaagcgagtgtactcgtaagcatatgtgctcgtctgaattgaaaaattaaaaatctgtcgtaggatgttttctaaactgaaaaaaaaataatatatattttaattatttgcagcagcacaacgtgataatagcaggttgtatggcgcattagccttggactgatcggtcctggccgaagtgcaacgctgtaaacgcagagcccagtgcaccgcaacggaggaaaaccgattggccgccgccggtgtcgtccgcccgcgcgggggactcacgtacatcgttgtaccgcgcccgccgcactccttcgctcgcgcgacgtcaaccacacacaatttcttttagagaaaatataaaaaagcaatccactgctccctccatcacataatataagggattttaagtttttgtttgcactgttttatccctcgtcttttattcaaaaaattttaaaattattttttttttacttactttattatccaaagtactttaagcataacttatcattttttatatttgcacaaattttttaataagacgagtggtcaaacagtacaagcaaaaactcaaaatcatttatattatgggacggagggagtacaaactagtctaagctaataaaaaaattttgagacacatgacacgtactttaagaaatgaaaaccagcggcacgtccctaatctcactaaagtctggttgaaaatccacctacatgtgcgtaatattcgtggacaccaggatttaaaccatattgggtgaagtcatgcactcacaactccaccaccacaccacgggtgcttccccaaattgaacataaattttaattagcttttaacaattcttagggtgaaatgatcttttatagcggttaacaagtaccgctaacggaaacctaccggcagtgatatgtctagcacaaagacacttgtacaatatcattatcggaaagatgggtttgtcaatgattcttcttcgattgatacgcttgtcgatgatatttttaaaatgttctcttttttaatacttcctctgttccatattatatctaaatttattaatattcatatgaatatgagcaatgtaaaaaaaagtatgataatatgaaacggaaggagtataaggaattagatcgcgcgagcgacgcggacacactcatgccgctcccgcttgcccactgacgcgaagcgtgctcgagtgctcgaccagccttcgtctccgctcgcctcgccgtcgccgtacgtcgccctccgcgacagcctgtgctcccgtggctccacccgctcgcctcctcctacaaatcctccatcccgcctcacctcacctcacctcacctctcactcactcacacgcgataaaagagtttgcaacaagtggtctccttccatggacaggtacagggtcgcgccgcgacctgtctacctctccgccgccgccgccgccggcggtgatcacggcgatgggccccgccgcctgccacgcggtgtcgccggcggcggtggcgccgagctcgacatcttctccgccgagcgctacttcaacgcagacgacgtcgtcaagaaggaggagtaccgcgacgaggagcagccgcggcaggaggtggccgtggatgcggccagccagagcggacgcaccgtggcgtgctcatcggaggcgagctggaccagccgctccgggctgctctccggccacgcccagtccggcgcgtcggcgggtgctgctgctaagctccagatgggtggtgcca

SEQ ID NO: 30247 - DNA, 20216 bp, Oryza sativa
gctttcccggcgccggacattgttggccgccgcgtcgtgagctccggcggcttcacgttcccggtggccgtcggcgcggcgaaggtggtgagcaccgttggcgacgagccgccgcgcgagtcgctcgaggtgttccggcccatagacgaggagtcggtgctcgccgacccaccggccgatcacctggcgacggtgggcggccgcggaggaggaggaggaggcctcgccgcaggcttcgcgcgcgccccaggggtggcggcggtggcgaccgacgaggaggcaatgagcgacgcgagctcggacctgttcgacctcgagagcttcgcggcgtcgtcgtcgttcccgaccacgtgccgcgggcgcagcagccggcgcaactcgcgggaggacgacgacgacgacgaagaccttccgtacggcgccgcggccgcggccgccgccgccgtcgagccggcgctgagcgagtgcatgtacgcgccgagcgaggtgagcgtggtgtggagcgtggccacggcggagggcggcgcgttcgacgcggccagcgtcgccaacttctccagcgcggcgtccgcctgctgcgtcgaggagttcagcttcgtcccgccgcctgactccgccgccaccgctggcggcggcggccacgagggcttcaccgccgccatgtcgcgcagcgccgcccgcaagaaaggcggcgggttcttgagcagctgccggtgcgagaaggctgtgagcgtcgggccaactcccgtccggatggtccggccggaggtgaacgtcaagaccaccggcggcggcgcggcacggtatcaccccggccgcgtccgcatgccggtccggacgtgaactcgccgccggtgagcaccggcgacgtacatacgttcaacgagcgggagaacgcgaaggcgtgcgctatggtttaattagttttgatgtgtaaatttgtgagtgagaaatgtgttggtgtaaggaatgcacatttgtgttgtaataaaccaagacttttaatttctctatacagatttcgtacgtacatatcccttcagacccttcacagagaggggagggggggagggggggttcgctccgcctctccctatacgcttcttcccttcctcctctccttcttctcttcctacaacatattaaaccataaaaaaattttaaaaaacaaatagttagaaaaatttatgtatagaaatactatatataaaaaatttgaattcaaattcaaattcaaattcaaattcaaatttgaattaaaatttaaatttgaattcaatttgaatttgaatcgggtatgtaaacttttgacttataaacattggatctataaactttaggtgtataaactttagatgtatatagaaaatatttgaattcaaatttaaatttgaatcggatataattcaaattcaaatttgaatcgggtatataaactttagttctataaactttaggtctataaacttaactttaggtgtataaactttagatgtatagaaataatatatatgaaaaatatttgaattcaaattcaaatttgaatcggatatttgaattcaaattcaaatttgaatcggatataattcaaattcaaatttgaatcgggtatataaacttttgatttatatactttagttctaaaatctttaggtgtataaactttagatgtatagaaatattatatataaaaaaaatatttgaattcaaatttaaatttgaatcggatatataaacttttagtctctaaactttatatgtgtaaacttgaggtgtataaactttaggtgcataaataaatttactaaaataggaaagtaatgcggtgccaaaaaggaaacaggtggagggagggaggggtgaggtggggagcgaatctgatcgctaccccttccccagggcgagcgatcgccaaacagcatttctgttcacaagttggtttctttgattatagagaagatgtaacaagcacatgcatcatccgtaaatgcattagaacgatcaggaagaaatactctctccatccctaaatatttgacgctattggtttttttaaacatgtttgattgtttatattatttaaaaaatttaagtaattgttaattctttttctaacatttgatttattgttaaatatacttttatgtctacatatagttttacatatttcacaaaagtttttaaataagacgaacggtcaaacatgttaaaaaagttaatggcatcaaatatttagagacagagggagtagcatatagcggttggctgaacaaatccgtaaattgacattgttatggattgaaattttgttgaacagtcataaacttgcaaggatttgaaatgaaaaattgttaatggatggcctttgatgtcatatatctagacaatcagataggccaaccgctagttttcaacagtatagatttctacaattagtgatttggttttatagatagaatatgtactacaatgctatatatgatagtattaggttatttgttggaccgtttattggttaacatttacacaaatgcaagttggacttttaaaagaaaattaatcatattagagatatgtcgctatttttttgtttatttaaacatgtgttaagggtgtatctatgaatgtgtgggtgtggtattgcgtgtaataatggtgtatgtccgtatcggccatatatttttttgaaaaaaaaacattgaagattctcttctctacccctctctcttcagctccataaagaaatatatatgcaatcgagaaaagttttaaaaaaatagtatgtatattcttcctttaggctgacgtcaccctacgtccgtacaattatataaagacaacgaatgtcttaatgagattgctttcctttattgtgtaccttctagataaacttatctcttttatggccttctgatgcacttgatttgtcaattcaacatggagacaattaatccaaaaacgggatcaacacgatgtgatgtgtggcaatgcccatgttgagtgtgggaggcaagtacgttgactgtttagcatctagctagacgtccgtgtgtacttaactcgtgcaaattaagccccactgtatatgagttgttgttgctttgttgggaccacatttcatacacatgactaattagtgctataaatctacatttgcattaacgttattagacggctgttttgtttttaagttgtgcttgctctctaattatctgaaaacaaaaatggaacgctctacattttatttgacaaaaaaaatccctagaactttttaaatgtcaaattgtcgaaatactctaagatccatacagtgctatggtgtttccaccttgccctttacccctgcacgaataactccggcacgacgaataaaatgtagggtttaattaactctgaaatcctaagtaaacactaactcgtcttgctgtcaccgttgctggagccaggggcggatctacagtagtaccaccagtgtcaggtgacaccgacgacttttgataaaagctatgtttaaactgtctatccataattataacactatattctaaatataattagtatgatatgacaccgataaacacgttatgacaccaatgaactaaatttctggatccaccactggctagagctgaaggagaattgagctacagtcattggagcacgaatctcgaattaaatcccaatattagaaatttttaagacttgggtacaaattttctaacgaatgacatttagcaaattttttttaaaaaatcaccaatcgtgagctaattagtcgcgagtagattgcaacatatatatgccatatcatgtccgcgtcatccgtatggggaagatcgagctagcattctggagtttggtttctcatgaagctttctcgccgatcgtttctaagcaaacatgcataatgtacaaattgtacatcatatgaacccatgcatgcgtgcgctccaaaaattcaaaaaagaccatatacacgaaagcgagacttcacataaataacgtacgcggcattccctcgtccagcaagtgcaaattgctacagtgggctagcaagcaagccaacgagctagctagcaatcaggacacttggattccaacaaaaggataagccggccggcgaccgatcgatgaatgtatcaagtttgtcacccagtgcatcaaatgaatgtatcagaatactaagaagatggatttttgcctcgggagggaatgtcccgttgtttctgataggtctcctaaagttgttatgattttctttaaaaaataacaaaattgataaagatgaaatatatcattctataaacacataggaggaagattaacaaaattgacaagatcaaaattgaccagacaatggacttcgctgcttaaggaggaagatggccaaagagtaaaagatggttgcatgatattggagaagagagtttctagtttctttgcaatgagagggtggaacttaagaagaagattggaagtttaatgctctcttttctttgcaccatggggttttgttgtcttaagtactgttttggctaatctctgtcattgtctaagtgtccgtttatggtcactcgaatttgcgttaaaccttttgtaagggtgtgagcctaagtgctcgtgtaagagacttttaggctgtgtacattttttgggtgtagaggccggtttaatctattatctaaaaaaacacataggattaaatttaacttctaccatttgcaaaaattaaaataaactctactagtatatgtatatttacagttaaattgttatatttatcgcaatttataaaagttgattttttttatataataaagagagagcttgtattattgatggaaatagggattgtattcctggtttattataaaagtcgaattgaacttgtgtgtttgtagaatatgtgtatcacatactagtttatctcattatatatttttttcaaaaaagaactcttaactatttagacgatgatatccatgtaactcgtcgatcgacagatattgaaaaactttgtggactaccaggttcatccatacccctccggcagctgacgaagctacccatgctttgcacgagcacacacatgacacactgtgctcagcttaacctacatatctgcatgcgctacgtggcctcgcgggcggccacaggctgcgtcgccaacaaaattcaggaattatttctggataccgcctgtttccgatgagctacagagctagctatgccgctgctagagtttgaagtgggcaacatgcagcagcaagggatgggggcggggtggccatgtggaacgcgtgtgggcgggcgtcgcatgatcgatcgatcgctgggtattgatttgtgaacaaactggccagcggcggcggcctagcctacgacgcccacctggaactaagagcaagtttaacagtattgtcaactactagccccaatttatctatagacaatctaatagctcatttatacaataattatatactatatacttactattaatacctggtcctacctatcatacacacgctgcgtcttgagtccgtgctacagctggctacaaatttgtagtccgctgcccttctctctcattatttatttccttaaaatatgtttgcagctggcttatagcttgctattgtacctgctctaagagaaacgttgtaaccagctgtagcacggacttcaagatacagtgtatgtattatagatgggacaatgtattaatagtgtactccctcccgttttattttaattgatgttttggacaatgatacagtcaacaaaatatatgtttgatcttatttttctaatataagatatataataaataaatatatggtaatttacttttcttatagtgctttgaaagacaaatatatatttattgttctagttcctttaaactaaacatttttaaagttattgatggtcaaagttataaaagtttgatctcaaccatgtctaaaacgtcaattaatatgggaccggagggagtagtatatatatttatagataactattgtatgaattaactattaaattgactagagatgatttaaagctagtagttgactatacttaaacttggtcttaacaaagctgcaagtatggaacggtggaacccgaggtgttgtggggcccggctgcatgaggtgagaggggcgcgtgggtccatgagctgtggggctcacatatcaacccctcaaagttagagggtagtaagttagagcatctttttacaaggcgagagtatggtttggacttaagacgtacaagaggatggaataattgttgggcttgtttagattagtgtcaatttttttttttgaaactaagattagtgtcaatttttgacatgctagtattttgaaagttttgaaagtttcgcaagtttagacactatcaaattaattggtagagctgagttggtattagtttaggcaaaaattggtatcaaatcaatttgttatttttaaagttgccaaaaaaaatggttgggcagaatttggcactaatataaacaaacccgttatctcccgcatgattctattaacatgcccagcatagcttgattgttctgaataagatgaataataggtgatatgttatttgattttgcgatggtatttgtgggcataaacgaattatggattaactgttacgaagttaattggttgtttttaaaattatcgtaagcaatttatacgtaagcttttctaaaaatcgcacagtttagaatcttgttaagcatcctcgtgatagtatatgagaggaattagggcctaattctgaactgcacacaaaggaaaacacggtttatttactactatttcaatattataagtcgctttaactttttttaaaatttttttaaaaaatggttaaatttgttgaaaaatatagtaatattttttaaaaaatattattaaaatatatttaattttacatttaatggaactaattcagtgtgttgtgtatgttgctaaatttttctatagatttagttaaacctaaagaagtttaattagaaaaaaaaatcaaaatgacttataatatgagatacggaggaagtagatggcaacttctgcttatgatgggcgatctgatcatcttattcagaagagccaatcggaccaaatggtgcggtggatctacaaaagttttagaccataggcaagtatagttatatcaagtgtttactaaaagaaatttatttacaatactataagtaacgctcaaattatattgcatgttcgccaacaagttatgacaactgtccaaggtcgtcaattggtggatctatgttaggtttgcttcgaccttaaaacacatattttcttagctgaagctttgaagacacatcatggatagtagaatggggctgtgtggttgtagccacagttacgacaagatcatcttaagcttgccaaggtgtcaaagattttgacaatatagcagtttttattgacaaattttggtagactgatacactataagaaacgtttaggggtctttccgactagctttacaaggtggtgggttttggagctagccggtctggattcgaagcctcgcttattctatttatttgatattaggttatttcttaataattgcggtctctgatacactaatacactatgagtatatgactaacaaacaaacaggtacatatgccacttagcaatcctcaagccaaaaccgagtgctaaaggtaaaacacacacatacacaaacaaaaaaataataattcggtagctcaaacaagtaggcccgtgaacaccagatctgacagatatacttgcataaaacataacatgcatgttcccagatatcccttttgttttcgtagtctacgatcgatttgtaactctggaaagttggtttctttaaacgaggcatgggtgacctttttgttccagagaaaaggaattcaggagtgctcaattcatgcaagttgaagtgtacatatcatcaaattattctgtgaggaggaatgcaacatgttatccattctgttttcttcccatttattatcgagagacgagtgattgcccaaacttttctcacggattttcaatgatatcatgaacagaagatatacataattaattattatcctccagctcgtaaactggcgaaatgggtccaaacattcattcaggtctctacacctactcctagctgactgtcattgacaaatttgatttgtcccatctctcaagtctcaaccgagctaatgctgaagtagtgttctgttgtaggaatgaaacacaactgagcttgaccattttaagggctcctttaaaatgcaacaattttataggaattagcccaattcccataaaatttgtttccaaatcccatatcttcaaaggaggcctgaagatgtacatcactgaccagccatttcctttctagcacagcacgaaacaacacaaatgtccaaagctagcaaatattcagatgcacaggaattgaacgcatacaagtacacggcacatcaaattatttattatggaggaatgccacagggtatccatcagaattttttttccgccgggccagcagcaaagaaatgccccgaccgaatttatccatcagaattttctcatttatatttcaggaagatgtcaatgcatcacagccgatggtccaaacgttccatcctagttagctaactgtatatattgacctatccgatattcccaacccatgactggagcaagcaagcagttcaactcagctaagcacgaagagggaggagctctcaagccagtatgctacctccctcttcgtgattcggggaatcagttccactatagaaggaggcctcacttgaggcgtccgaaccgccaccattagcctccttgtcagcggatacatgtgaatggtcctgaggcagggtgatgccgtttgatttgaatgaagaacccatcttaatgtcatcggctctcatacgctcagcatagctattgtattcgaaggtagctggattccttcctccgaatgctgagtcgagcttgtccaagtcaaagacgtcagccattatcttctggctctctttatcgctggagtacacaaatttcaccttcttgtaggtctcatggtccaaaaatggcttcactatctgccaacagtaactaatgttaggctaccttatctcatgacaacagagtaacacactaaaaatagattaattttactgtccttgagaatatgcacactttgtaatgttaatttgtggttcagtacctcaacattagggaggtaccaaaacaatacactagcaagtgtggttgaacggtaaaaatcctatatggtaaaaagacggaagaaagaataagtgaataactgtactctcaagatattttaaggttgttctcaccttccagaaggactcaaatatcctaggaggattgtaaaggattgctaacccaagcctctcagggtaacagtcttgcaagacgttcacagtctctcgggtcactttcagcggtgtgctccccaatgtccaactctggaagtctgtcagccagaccatcttctcttgatcttccgtcaggctcataattgctttctccagacagtaaacaagatatttgatctgtccctttcctgaagtagtgttctgttgtgtttcaaagttaaacatgtaaaatcagcacatagcatgcaatcaaaccagaaactgttgtggcatagctgtcacaaaatattggttcataacaaatgatctaacaatgcacacatgcacacacccaattgatttgagaaacaataagaaaaatccggaataataaaattataaccaaagagtgagattctccttttggtttttccaaatgctgattgacttcaagctaaaattgtaaagatgtatgtatccctccgttatccacatggtcgatttgattcatagcaggaaggataacatgatagcattgcacacattgtatggagaagtaattatgtcccttttatctggaaggtataatcccaatctgatttcagagcatactagatggttggcagatgtacaactaatgcagatgagtagatacatacaaagtaaacagaaagcacgagctatatcaaaacaagactgttatgatgttaatgtattcctttcttcctgccgaaagtgcactaacctctaagcctggcctcaggacaagaacagttcttccatgtttgtccttgtagtcagccctatatatctttcctgtctctgcttcatgtgcaacatcatcttgaaggttgaaaggacaataagattacattatgttgtaaacctgaaaatgcagttacttcttaagtatcaagaatgttttgatttagaatcacaatgctttctccccaatgattcatagaatgctatcctcctattagcacaatcctgtctaaattgacactaacagcagttattcctcctgtctactccctctttccacaaaatataagaattccaagcgtaatttgtccataaatataaggattcctatagtgccacttgaccacctctcattgaaattacttcccaccttactcccaactactcttccaccccccccccccaaccatcccccatttagtgaggggcaccaaagtcttttagtcttaaccttaatcccttctaaacaacctagaaattacctatggctctcagcatcaccaatgtttcagttataatgctatttctattacagcccataaagaaatgcatattcaattgatgattaacacaagcatacccagttaatcttttgtggcatatatgacacccgccactttacagctgacttcatcattttacttgctttctgcacgttccagtttcttgctcgaagaaatctcaggcacgaggcatctgaaaggaaatcttgtatttcttctgatgagtgttcaccaagctccttacgcaagtcatttatctgttcatcagtagatagcacaacaacaaagtaaatggttcaaagcgagagtaactaaattaaattacgaagagatatacaatcaagggatttttttcaataccttctcctgctgctcttctagggtcaagtttttctctgttgtagcaccattgcttgacttgaatagaaaggacattttagtacctcgacagagaagggtccactagatacggaactgaaaagcaataaatatcatcagacatctgaagagtactaaatatgcacgaactactttctgttcagcttccttgtatgaaggcaaccatctgaactaaacaacagaataacagcttatgaggcaggtgcgagaaaaaaacttgccgttaacaaaaattcagtttcatacaaaagataacagaaagtaacaacaaatgctactttaaactgatatcagtacatggttagctagctgctaccgcatgtaattcatacgtggctggaagagcagtatcctaaatgagaagcatttcacagaattcagaaggccgtgcttctgaaaaaccagccgattcagttccacagaagacaaaattgcgacccgaaactgatttcttaagttaaattgaccatccaagatgtcactaagttaaagtagcatcaccatataccgtatgagccagatccggcaacgctaagtttcttgcagattttacaagacaagtagccgagtcaagatcacgtcaacgcaaacaatcccggtggcaattgctactactacatcttcaatcctagtagcacgacacaacacagaacgaacacccgcaattcgagcacgaacagtcacagatcgccgccgtatacctaatgctcctcacatcaaagattaggtagtagagaaatccgatctttggccgagtagaagaaaaccaacctggatcgatgcacccccagcccccaacaaccggggaggctcgcggatcagggcccgccgcctgggcacgacggcgagggctggggtggggaggtggcgccggccgaggtgggagagtggtggtggtgggggtgggggtgacgtgaggagggcgagagtggagacgacggtggaactggagggtgagggtgggtggggttttcctaggaaggatggtggtgcggtgcggtgcggtgcgcctgccgtggcgtggtggtggtgggcggtggtgcgggtgcgggcgtgggagacgggacgcgcgccgggtgccaaaggcaaaggccccccgcgtgtatgaccggccaaagatgccgggtcaagcgcggggtcggggtgggggtggttaagtataatgcgcgatcacgggagcgcggagtgtggactggaatggagtgcaccacccaacgagatattaccactcttaggacaagtactatgagcataaagcatagtctcataggtgtcacataagctaaaatagtgaggtggaggagagaagagatgaaagagatatgcagccacctctcagagcatccgcaatggttatctataggctctctacaagatatccaagtcagcatattttcctatttgaaagagattaaatgaagagagagagtaaaactatctactaacctggagatagtctatagaaaaaaacgatgcaatagattagagagatatagatacccatatagacatactattaaggtgatttactattaatctagtctattgctgagatgtacatgttttatagaaagcaccttactttactattgcggtggatctcatgcaagatgcaaccaccacacaaaattcaagacaaaaggagagagaggaagagtagattaggcaaacaaacattggggctagtgtattagaattagtatagatgtgatatattgtacatattacctctacatttattagttgatgatgtggtcaagattagatgcaacatccacctcttttataaaacttgcctttatgctccgttcggtagtacaagttcccagctcctcctcctcgttttccgcgcgcacgcttttttcaaattgctaaacggtgcgtttttttgcaaaaagtttctatacgaaagttgcttaaaaaatcatattaatccatttttttaaaaaaatagctaaaacttaattaattacgcattaaaacgctgtttcgttttgtgtgccggggagtgggctcaggcacagtagactataagctaactttaaacatatatcgataatataaaagaggagggagaagagtaggctacaaatttattcagctgaagcacgaactcgaatacaagtatttgtatgacaggtggaaccatataagtatatgtttatagataactattgtatgaattgactattaagttggttataagtgatttggagctagtagttggctatactattaaacttgctcttacatgggtaattattaaagatttatcactgaactacgagtaataaatctttaattgttatatttaaaagtggcaaataaaagagtgctcgcacaagatttttttttctaaaactagttttacatgcaatacgttatacgtgatcgtgagatttttttttctttcacttttcttgagagtttttttaagataggtttttaaggaaggaaggagaacaactaagctggtggttttttaagttccttttcttaaaaaatataaagaaatatagcggttttttaagaaacactacgcttttaaactacttcagttgcctttgtttttataattttgtagaaatacattatgttttaaaaatatacccgtgtcaccgaccaacgggagattaaaacatcgattttgctatatatatatgtcgacaaatttttccctaaaaatttgacagatgtaattacagtacaatcgtagtgtaattacactgtaacttgcatgtaattacactgtaactatagtgtaacttgtatgtaactttcaaaaatctctctgtaacatgttatttcggtaaaatggaggtcgtgggaacaaattctttcacatacgtgtgtgctatgatttgttttcttcctcaccaaaacaaatcttgtaatagatctaacgattcaaaattatgtgaaacttacatataagttacactgtagttacatgcaagttacagtgtaattacatataaattacagtgtaattacactacaattgtactataattacatctgtcaaatttttggagaaaaatttatcgacaaatggataggtagtcccttaaaacattgttacctcttgatcgagcgacactgggccatgtcgtttctcaattgaaaaacagcataactgacactagctaagacggcaagacgcaacaggcaagtgagcggaggagcacctagcacaagcatatgccagcaggcggtggtgcggcgcgtgcgagcaaagtcacattgaggacacagtctcacccagtaatccgatgtatgatatgctctgttcaggagacgcaaaacgaagtctctattattgcatgattaattgagtatttgctttttttaaaaaaaaatagattaatatgatttttttaaagcaactttcgtatagaaattttttacaaaaaaacacaccgtttagtagtttgaaaagcgtgcgtgtggaaaacgaggaaagggggttggaaactactactaccgaacgcaggaacacgaggatcgactcctctcaatcagcaataaatgtagggcttgttttgcgtcggtaggacatgaggatgtttgtttgttacaaaatttctgaagatatattcatacaaactagtgtaaaaggtttattttctccatttttaaatatttgcactgaggcactattgatacgtgctttgacaacttttttctttaaaaacataaatacttagaatataaaacatcttcttttgtcaaagtttgttgtgcgctgaacatcttagctagtgaaaagtaaattctaaaatgcttctgggatgagccacatcatccagtgaacaatggttattgcatcaagaaaaagacaaaataaaagagaagagagttgagccatcaattataaagggaaaaatggatgatgaatttctggaaccttccaacaatttggaaatgagagagagaaagagcaaagaaagaaatgtagcattggaaaagagtgggggagtcagctagcttatggcatgtgataattttgcactatgcacactcagtagaaattatgttataaataaaatctcatcctttatttataaataataattcgaatttttttataaatggactatcggcttataggcttatattttatctatagataatccttacaacctactaattccaaattactgctgtaacttgaatgtcacaatatcacataacatactaataaaatttgctatgattttaatgttatactttggttcacttctttagcataaaagctaataggttgggcttaagaatgagtgtttcacctacagatacgctttcaggttatagctgatcaactacacttctctcaacacatacttaacataatgaaacgatgtttattgttgccaatttaaattacatgctcatgtacacatataacatgatggttaaagtcgcgcgaacaagcgacattatatgctagtaaagttgatggatgatttggtttgaagccaaaacttgcataccaaaatattggcattttaaacggtcattttggtaatgtttggtttgttaccaatccttgccaataccacataaatattgtcaaaatattggcattggcaaaaacttacctataatttggcatcgccaatagtttggcatagttacaaaccaaacaagacctgaaacttttgttcattgtagcctacccatcttaaaattactattaggaaaaattgaaatatatagtaaaaatttgaaattaccaagtaaacgctaccggagggagtatgtttcttttttttaaaaaaaaaaagaaaaaaaggaaatctccgccagaacgccacccggcatcgtctggactctggatcctcctggatccatgctagaggcctagagccatagattactgatttattgtacatactttcaacatggcagatgttcttctcgaatggctctcggcgttttgttaacacaaaggggcgtaatgtgtcatgtcgagttgtcaacgaagatggtagagggattccatcaggctgagcgcagatcggaatctatctatgagtataaatgataatgatgtggatacagttaattactaatgacgtggacacgctttaagatgctctagtctctttcacaggtcaaatctcgtgttcaatagtactataggagtagcagccaaggagcagtttagttagtattatgtactcctccgtcttaaaaaaaattcaacctaggactttgatgcgacataatatagtacaacgaatttgaagaaacctaactcctcttttttttcatcctccttttttttctcttccaaatttctctctccataaatattttcattttgaaattatcattgtttaagatgtgtagcggcaagtttgttctcatgcaaatgcttttcatctacagtaaaaaaaactttcactaattgaataatcaaaatttcaatttttggtcaatgaggtatagcaaaatacatatgcgacgaattatggaatagccactcgatcgattttgtgaggctattaaaaagtgtacgtaaaggattctccgtgtgatgacgcatgaagcaagtgtaattgggctcaatgctatatatgatttctgactttgttttgccattattttatttatcttgtttcagtttgtcatttaaattggcagagtttctacccatcgtaaaaattatcttcaaacccaacgccatttttgctagttataaacttataaataaagaaagcgctggcctgcacctgtctggcccaatcggctgggcttgcacccactcttgggccttgggccagtgggccgtaagggaaagagagaggaagacacgagcttttctcctcctcttcctctcccttcgcccgcggcgacaaccctgaaccctcctctctctcctccaccacctcccctgcgaccagcggcgcgcggcagcggcaggcggccaccgggatggcgtcgtcgtcggggacgagggaggtgctcatgctggaggccccgccggcgccctccggggcgccgtggcgcgcgccgccggacgcggaggccgtggacgcgctgccctacatcgacggcgactacggcgacccggcggtgaagcgggaggtggaccggatggtggaggaggagatgcggcgcgggagccgcaagcccgccgacttcctccgcgacctcccccccgtccccgccatcgggttcgaggtagattcgcgatctctcatctcctctcctctccttgtgggttcttggagcagctctagttcagcgtcggggtcgttgcgttcaactatcttttcaggcgaaaaaaaatagaactgtatcttttctttcgaatgtgattcgcgttagggttatagctacttgtaagaatgaaacgggttagaggctggggggtgtatagggttagtagttgtgtactcgaaagtgagagcacattgctaaatactgtacattatcctcctttagaactgtgcttataactatgttttggtggcggaattttggattatagttgagctaattaactgagtatatgtggcttgcttggatttgtatagaacttttttttttgtaaagcttaatgttttgctctgctataatgtctgtatgttaacgttgatcctgaaaagaacaagagagtatttttttctgttgccacatgcttcaattgattagctcgtatggaggacagatgcctgatggtccgtgccttcaaattttctgaaataataataattgatagttttgactagatccaccctgctgcaaacagaaaagcaacatattttggctgcaaatatttaacttttttacttagcaacatttcttgaccaccaaatgaacctattgatttgatcggttacttgaaattaagtatacaatttgaggcaccaagaactgaaatataagctcttttccatgttctgtgtgcattgagctaaaccgacaggcaatttgaacctgtggcagtcaataatatgacctaaggtatcaaaagtgcacacggcagtcaatgaagaatagttattataagaaaaaagaactaaattgaatgggcattcacgctttgatgatttcatctaaataattcttatgagatgtaccagtctaggtgtttgcatcatattaactctgctccataatagttgtcttagagctcagagagcaaggaaagggttaataccttttttttcacaaagtttgcccttttggatgatataatctgtgcttatctgtgcaattgagtcatatttgaagatacatacagccatttaattcgttgtaggcttgtattgcttattgaaattatacaaaatatttgaatcacaatttgggtttcatttttttagaacttatgcctcatcatgtgaatatgtttacaaccttatgagtttttattatttgatactcattttgcacatctgttctagaatcatcctatgcttgctaaagagtacgagcgtgttagagctgggaaacctcctgctaccatagagatgtcccgctatggtttggagccacccccagcgaacaagaggaatgatgttgctgcatggaggcaggctctaagaaatgctcagagccagctgcaccatcaaatcataaggtaagagtagagagccacagggtactgaactaatgaaatttaccatcaaaggtgcagtatcgttgaacgttgtgcatttgattgtgataggatcacagggaccagtgtcttcctgtggcatgtccttttgataatttttcattaccataatagcttttaagctttccctggtgtggaaaacatagacttcgagaatagtatcagagtagataggatgggctgcttgacaaaggtttctgcagtctgtttaaaataacaagcagtattattttgataaaagagcatgttttttggatacactgacaatttgtaaattggaggattgtataatgctcatagcagaagacttttccttgtactttactaaatgtatcttgggtaaattaagatatttgatcatgtattgcctaatatcagcttcaacagtttacttgacaatgggagctcctaggttagttatgattgaacatgtaaagcttcgatcatgttacttcagaattcgactgctgtacgcactgtgtaggatatactgcttttttctgaccatggtttcttatcatctatggagtcagcatacttctatgctattattagttttgaaataaagttaatattgcaggatagagaatctggagcttatgctgaagtatggtgttgaggtttggaagcttcagaatagacaaatggaatcagttttgtctaggtaggctattgtgacataagtttattatctttgaatttggagctacgtatcctgtgttattcatgagattcatttagagccatttcagtactcctgtttgtagactctggtctcatatgttgatagtgtagcttagctgtttaaacttccagtaaagcacttattttgatatttgaagcacttatttcgacattcttgtaagtctcaatgctacttatcactgtaacaatatggatggtagattatttttatgcctgattgcatggtatctaagatgtcgaatatagcatttatcattctagcagcatatgatgggttgatctctttataggatgcaaaagatggctgtcgaatacaatgagaagatagaaactgtcaaccgcgagaggaaatttcaccaggtaattatattactcctgctcttgttcttaaccacggcatatttcacagccaagctgatcatttgtgttttgatcagcaaaacactggtggtcaactccatgccttgacgacggaatggcaggagctgtgtcagaaaaatatagctattcaagctgcatgtgttgatctgcagaatcagattgatcagcttaaacttggagctaaagaattgtactccccctctctccctactttcctccctctctctccacatccacatgactaacagattccttaacaggggaatgcccatcgatgacagcaccggaactaatcagcaagcatcatcagccatttgaggtactatttgttattttgttctcaaagaaagcagtattcttaggagtattgaagttaagtcaagagacaaaatctaccttcatcatgcttacaagtttt

SEQ ID NO: 30248 - DNA, 12059 bp, Oryza sativa
agacctgatagagaaacagatcgtatgcatgctgtgtttctgttccaagtgatctaacctgtgtgagaggcagaaatctcatcactgaaatagaatgtaccttgacattgaagcgtcagttaaggtttttgttatttatgttgacatgtttgtgtactcttcctgctgttaccatacagttttactaaacatgagttgtactaaccatggaggttgatatggaaataattactacctccatcctaacatagaagtaccgacaggatctttgttcagatcactagtaataggagatggtccattccatccatccggttttaggtttttatattttgaaatggacgtagtattatacttagcatgtcatggattgaattattgaagtaagcccccaccttcctggtcggcgtagtcccttgaggccatctctaagtttgtaatgaaaaacaactatagttcacctagagcgtgaatactctattttgattttatgaaccacacctcaaaagaaaatcttagttttgaaagcactaaagcaactagaagttcattttccggcatttattttttttgtttaaaaaaatactccatgtaagaaacaaatcttcagctttaaaaccaaacattattcaactactataaaagctatcaaatttaaccttcaacatggtttcttctcatgttgaagaaatgtttttgagttattttaaaacacagatagatcatatgatccaattaaccctattctgtgaaagggcatctagcctaatggttacaagagtctcagtagcacctgagtaggggtggaactgagctggaaacaagataaaacttgagctcggctcggctcatttcctggctgcaagccttcttattgaaacacctcttcatatatattttataattattagaaaaagtaaaaacaaatcatcaacatataaaatttaaataagtttgtttattcaattcttcaaaatcttaatgataaatttcaagttgacaaataataacgccatataaagtaaaataatcgatataaacacacgatggcctaggctcacgagccaaaacaagcggctcgcgagctagctcggctcggctcattttcagcaacgagctgaaaaggaggcttgggcttggcttgtttggcttacgagccgagtcaagccaaccaagctcgagccaagcctaagctgagctcacgagcctaagcttttttttccacctctacacctaaggtcctgagttcgacaccccatgggaacgaattttctaggatttagcggcgctgtactttcagtggtaggcgacgtacccgtcgacagcgaggtgctgacttcatcaatctctccaggatttgccggcctagtcttcgaagatgctcataggggtagggtttgcgtgcgtgtgttcatagggtgagtgcgcgtgcgttgagagtttctgcgttgtactgtgtaattcaaaaaaaaaaaaaccctattctagctacaaagaaataagcatcgaaacacaaaggttcatttgaaaatctctgaaatttcatcaaacacccctgtccaaaattcataaaaaaaatttgagctgtggcgccatctcccatcccacccagcttttgctgtaccaccatgccgcgaccggagctacactccaatctcccactcgatccccacaaaaacaatttgggtaaattcgacaacgccgctacactccaatcttccactcgcatctcatctcgcatcaaccatggccgccgccgtcgccgccgccgcctgccactccccggcgcgcctcgtggtcacctgctcgagctccgccacgcccgcgccgccgcggcgcccgctgcgggtggccgtggtgggcggcggccccgcgggcgcgtcggcggccgaggcgctggcgtcggcgggcgcgcaggcgttcctcctcgagcgcaacccgtcgggcgccaagccctgcggtggcgccatcccgctctgcatgctcgacgagttcgccatcccgcgtgacctcgtcgaccgccgcgtcacccgcatgcgcgtactctcgccgtccaacctcgccgccgacttcttccgcgcgctgcccccgggcgcccacatccccatgctccgccgggaggtgctcgactcctttctccgccggcgcgccgacgacgccggcgccaccctcgtcccgggcctcgtcacctcgctctccctccccgccgaccccggcaccgacccttacctcgtccactacatctcctccgactccggtggcccctcctcctcccggtgcgtcctcgaggtcgacgccgtcatcggcgcggacggcgccaacagccgtgtcgcccgcgaggtcggcgcgggggactactcgacggccatcgcgttccaggagcgcatccgcctccccgacgaggccatggcctactacgacgacctcgccgagatgtacgtcggcggcgacgtctccccggacttctacggctgggtcttccccaagtgcgaccacgtcgccgtcgggacgggcacggtggccgccaagccggagatcaagaggctccagtcgggcatccgcgcgcgcgcggcgggcaaggtcgccggcggccgcgtggtcagggtggaggcgcacccgatcccggagcacccgcgcccccgccgcgtggtggggcgcgtggcgctcgtcggcgacgcggcgggctacgtcacccggtgctccggcgagggcatctacttcgcggccaggtcggggcgcctctgcggccgcgccatggccgacgagtggcggctcaccggcgcggtgacggaggccgggatacgggcgggatacctccggcggtgggacgacgagttccgccccacgttccggttcctggacctgctgcagcgggtgttctacggcgggaacgccgggagggaggcgctggtggagatgtgcgccgacgagcacgtgcagcgccggacgttcgacagctacctgcacaagcggatggcgcccgccgagccgtggggggacctccgcctgctgtggcgcacggcggcggccatggtgcgctgcggcgtgctcggcagggaggtcgagcgcctccgccgtctcgagcagcaggccgccgaccaggtgctcctccgccattgaagatgtgtgtactgctctgctctctctctttctcatgttttgtagtagcaactctgcatttgcaaattgcaatagtatcttacataaagatgctgctgctagtaataagcatggtaatttttgggatgctttaacttctaagcaataatatgacatttttattcagtttagtggaaatcccagttgtcatgaattcgtgatgattgttatgtgtaccagtactcaacacatagggaatttagtgggcattagcaacgattaattgaggaaaagaactgcattactcgggtatatcgtatatgaatatatgatatagttcaagctgacaattagtctcttaataataccggaaggggttgtagagagtagctaggtaacataacaaaccagatctgaaaagcctaacgaagaaatacaatatattcaacgaacactccagtgaaataataatccaaatctcagtatcaaaatgaccatctcctccgttctccagaaaatgcaactgctatgtaatgtggtattctggtcatccaatcaggcctgcagtcaattgaaagatgagagcgtgacagatactgtaaaaagaacaaaaccaccaatcaaattttatcaatataacaaaactttggaaaaagagttggcatagctgtgttcgggaggaggggttggtcaccggcacgcaaaacaaagctcgtattgttgcatgattaatcaagtattaacttttttttttgaaaaatagattaatcatatagaaagtttttccataaatcacaccgtttagcagtttgaaaagcgtgcgcgcagaaaacgaaagaggtgggttgggaaaatggggggaagaacacagtaagcttcaaaccatgtaccaccatctttcaaacaccctcatggtacaattgcatgacagagtaatgtggtaatggcacataggaactaccttgtttgcaatgttgctcgagagccagtcaaggccctcatataaaccctctcctgttgtggcgcatgtactctggatatacctaaatgacagcaaaatccaacaggttatgatatgtaaaaatagcataatattttcaaggaaaaaaacgaaagttattgatccattgttaaggtgattctattcatcatgtaataatgagccacataattgtataggtgaacatcactaaaaagttttatagatctaggatggttcttggtgaaaatatgtaaatggcataagatacatacggagtaacacagttattcaccccctatgactatttagttgataaaaaagagttgaaccacaaagtggagtaaggtaaaccaaaaggctgattcattaaaatattaaaacataaagtttaaaattgaaagatagaaatcgacaaaccagaatacaagaccatcaaacttagaacaaaaataggaatggatgagatgagaagtagacagcctacaagtgacaacaaaagcaaccatatattaccagtggcgttggcgcagggaatggagaccaagcttatctgtgatctcagcagcattcattgcattaggaagatcttgcttgttagcaaaaaccagcaacaccgcatccctcaactcatcctgcaaatgccatatgactgaatgcttaaagcagtgattgaaaagaatttgtatatgtatgtaacatagtccaagtgtatctgaaagcaaaattcaggattctaattgcctaagaggatagattccttaaccatatggaactaatacctagcaacattttgcataggcatgtcttaacttttaagctctgaaaagcatatgctatgtgtgtaatagtgtgtattagcataccatggcatattttggacagcatatatttatttttaaaattctgggcaaacggtatagtaacaaaaaattatgaggatatgtcggaagtgtaggaacatgcccaatatctctattgatgagttaataagtattgcaagcttaggaaaaaaacttaaacctactaccacttatgaggttatctgaaaaaaaaagggtacttgtgtatgaatatgacgaactaacaataaaatatgtgacatcagaaaatgagtattttatgatggtatatccaatttactcattttactaaatgtcatggaatggtgccatactatgttgtcttgtgaggaaaaattggctgcacttaaactaaaatcagtatgcgttattctgacatttataaatcaagtcactgatgatgcatcctgctgcacaaactatttggaggtggttatatgcttaacaagaaataggatgaagttaacaaaaccaaaaggcatgttcagcatacatcttatatgacagaacaaagttatccatgtaacaggttaagccagaaacatgaacatgatccttaaacaaagtttacctcattaagcatcctgtggagttcatcccttgcctcaaccacacgatctctgtcgttgctatcaacaacaaagatgagaccttgagtgttctggaaatagtgcctccacaaaggtctgatctgtagtttagaaaacataatgttatgagaaaaaaagtttctaaaaccctagagctgtggccatatattagtatgaagttcatatattccctactgtctgatgtgtttaaaatagtccaatacagcacaatggaaaatctactgctgattgcagaaataccttctgaagcgaaaagtgattttggttacaaaaagcaagaacgaattggtttttaccttgtcttgacccccgacatcccagacagtgaagctaatgttcttgtattcaacagtctccacattaaaccctagacatcaaagaaaaacagtaacttgatttgctctctttacaagcattatttcaaaaatgaaaaactatctctcatctgtctaacagtaatattttgcacttgcacatagagccatacaagcgtgcaaccatgtttgttcatatttccaacattatcaggttgcaatatgaaaatggatacaaaataatgcaagtgagccactaaatacaattgtaaactaagacatccaccaagccaccaatggaaggaatccagccctttttcatacaagggaccttacttctatgtgatctgtttttctttttgactacactatagtttgaacccaacttaccgacaacaaagtaggagtatttgaatgtacttaacagacacatccagtcaaaacatataaaatatcaaataggtttttacctattgttggaatggtggtgacaatctctccaagcttgagcttgtagagaattgtggttttaccagctgcgtcgagaccgaccatgaggatcctcatctccttcttggagaagaggcggctgaaaagcttcgtgaaagtgaggcccatcttgccgcagttgtgcaagaccttaaacaatcaagaatcaatatgagatatgatacaaaagcacatgcagcaaagttcttaaatctcagctcagataatgtaagaccaaaaccaaaatgggctccatagttcagttagttaaatcacaattcattcaaacgaaccagatcttttgcaaacgagaaaagtatataaggatatcgacattaagaagtactcccgtcatgccgttgtcttttaacatgacgtttgacatcttactaaaaaaattatataaataccataattttgttgtaacttgttttatcataaaaaaactataatattaacttagtacttttacatatttatactaaatttttaaataagacgttatgcgaaaagtcaagagcgtgcgttatacataaaaacctgaggtattatttgaaacggcaccgtgatccctcaggcaatgcaaagaaaacagcatctacagactatgatttcacatcccacgagtaaacaaaattcacagaccagtctgctgtgcgaaggatctatgcaatgcaacgcaacgcaacacgatgccactggaattaaaatgaacaatatacaagtctaacacgtgaaaaggggtcggcaatggaaacggataggcgatcacctcagccaaagcaaacaacggatcgccgaccagaagctcatctacggactaacaattccgcaccccacgcacgaacgaattccgcggacttgtagaggcctcccaaggatctacgcaacggaacacaacacacagcaccacgccattttctcgaggaaaaaaaattctggatcgaaccgaacgagatctacacacgcgcgacgccattggaagtttacgcaccacacgctacgaactcactcggctacacagatctacgcctccactccacggatctgggcctgggcagcagcagcagcatcgccgattcgccgccagcgccagcgccaccgcatccctccccagcaatgccccgagggcgaggcggagatcggagaggagaggagagagggaaaggagttgggcgtaccaaccttgctggagatcgatctcgtgcgcgcgcgtggcctctctcatctcctccccacctcgtcgagccgaagaaaaaggagacgacgcctcgacgcgcggtggttgcagcggagggaggcttcgagccgccgcggtgggtggacgcggtctacgtgagccgggtgtggtggactggtggtggtggtggtctaggtagagtgcggtgcacgtgagacgggtgcaggagagagcggtgcttctcatttgaagcttcaacgtgcaaccgacgctttctctaagtttcattttttaaaccattttaaaattgagggagcttctaacttctcccagctgtcccaaatagtctagattttcatttagatttcaagaatttgtaattgtagaatccagaaaatgaactaaaattctcataagttgactaccaaccagttgtttcttagaatttttaacttttcaatcaggaccaaaaccaaaaagtctacaatgtcctcactttatcaaattctaatataattattcatctgcaattatttctcattttttatttccaatacaattattctttatgttcacaaactccgatgcaatgattattttaaaaataaacttattatggaacggagagagcatataagcatgtgtacatgtataaagtcgtataaaattcaaatgtttaaagtcagggtggaacccttggccatgataccaataggaaaattcgattgggctgtgtacccaaaacgttggggcagagctgcaaatttattgtgaagatgctgttgttccgctagtttgcagtcacaattcattcagacgacccagatcttttgctcgagtatacaagatgtacacatataaagtcgtgcagaattcaaatgtttaaggtcagggtacttgggatgtaaagtgttctctagcacaaaatatatttggcatgtgcgcgttggaaatacaaaatattcactctgctcataagataaaattaaatcaatcaatacctaaacacatgagaaaatagttcaattctccaacatcacttccccacaccttgaaaactaggaaaataaatacatacgatctcctaaatatcaaaaagaaaaatagatacattctcctctccctaaactgtagttcactcttttcatttcatctcctatatttctacaacatactattataaaatataaaggcgacgaagagacgaactgaagaacatgaatcaagtcttcggactgggattcacagcatcagaatcagcgaccaggccaatctgcatagggaagatgccatttcagtcaccagggtgctccacagcacctcatatatctgtctgtatggtataatcctgatctttttgaagaacttatgatatcaccaaatacttgcaatccaataaataagatcttgtagggttaatgctcctgctgacgctatctaaagccatattgccactaaagaaatgaatttactgtcttgtttgcttctaacgccgcctcaatatccggcaaagcaacagaatagatgtgctactattcaaaccctagaattggccccaagaaatgggaaaaccaaacaaaatgcagcatgcaaagaggtcaacttttccttagctcattttctcttgattttcttgcattagtttctccagttccttctgcccagtagatatcagtgtcttcacagtatcgaacgcagtcagtttaatactgcatggattgaggaatactgtgagcaatgagaagttacgtgccagtaaacatactattacctatcagtgttgccataaatttaaatatatagttgaccaccactgtgaaaagaaaaggcacctgctatttggtagattttttaatgcatttggaacaaaacctctgtatagtccaattagaccatcacgttccacaatgcctgcattcagcagagacaaatttaagaaatgcttcagtttagcccataaaggacaagaccaagctacaagtgagcatgtagaactggcatctgagagctgaagtgaacgttatgcagtaagtaaaagatgatgtttatccaacaccagaaggactatatataaatcagctacctggaatagcatccaaaaccgtgttgtagggtgatcctttcatttgcatctgccttctaacagtgtccagaggataacacatcaaagttgcaaatgttgctgaaagaagagcagttgccagagatgtctctggtctactcttatacttctctggtacagatttcttcattcttacatacagaaaagaatagagggtgaggtgaatatctacttttgagaccaacttttttatatgatgaggtagaaagaatctcacaagtcaaaaacacagaagttcacagcaatgtaaggggcgattcctataagagacggacccaggcctccatagaaggaggccaaaccttcgtctctcagcatgttcatagcaacctaaaagttaagtcatcaggttacattaatttccagaaacgaaactcaagcttataaactagttacctgagacatagtactatgtccagattgaactgctagcctcagccgaagaacatccagtgggtaagttacctatcagcaagtagccaagtatatatagaagtttcataatgatcagaacacaaacaaacaaatcaaactagatataaggacaattgctcaggagtaaataaataaattacaagtgtagatgtcatgcccgcacaagcaccagcagcaagtctcccaaacacagtaagctctccgtcctttctccggaaaaatttctgaatgcaaagcaggtacatggaaattgaaatgacaggaatccaaaataggtaattgactgatgataaagagttggcgttatcaccttgtaaacttcataagaaaacagttgcaccgcactgtaaggaactatgcggataaccttaagtagtttataaagaaactaagtgagaacaggaccaacagaataaaataaaccatgcatgagccacaatctgcatgatggggaatatcaagcacctgtggaagattgcctttccagtaacccttcaagccctcttccttccctatctctgcaatagcctgcataattgtagatgtatcagattagttatgtagtaccagatatacaactctaagtaaaatctatgaaaaagatagctatgcttctcctccttgtttgaaagtggaaagtgcaagttcatatatccaagagaaattagaaacaattatgttaagaagtcagaccgcacatagaaacaacatgttaaagcatatgcgaactggcagtactttgtgtctaactcatcaacacatgaagcaccagcatggcagcatctgatatcatattaaaaacatctaaacgaacaaacatcatgaagccataagtaaaacttaatggcatgccactgcctatttctgaaaaccattgttaccctcatttctgaaccatacaagaagcatcatgaattcaggacacagtgagtatgttacagtgtattataagtatattggaacaaattatggctttccctcagatagcaaccacgaattggtagtggtgaaacacatcagtttcatgactcacaggttcttttttaaagaaaaatgctccatgcctcacgaaagcctttttcatgatatgtttcccagaatagttttcaaatttctaaaacgtaattttgagattgtgtgttaatttttagtaaaccacgagtttcattgttccatatcagttcacatacaaccgcaagaccagaatactgcatatttgtagtggagagaagagtaccccattgttatgttcaacaccacacacacagacagaactcggttcgttctaacttatccctgatgtattcggaagctgcacttatgaattcagggaatttatcatgcaattgcaaatgacaggtactaaaatagacagggttgggatcaactccatggctagatggaaggcattttatagcaacaacagattgacattgttgtcatgaaaatcgcagacgatagtattaacattactaaaatagacagtgttgcatcagctccatggctacagaaaagccattctatagcaacaacagaattacacactcttaccaacttagaaatttatagcaaactgaagagaagaggtggaggacatcatcagagttacctcgaggaatccgatccctttcttggtgctctcccccaccacccgcacgctgtgcgtctacaaagaagaagagcaggaaatgcagtgggttacagaccacgcacccacaggccaccccacagcaaggagagggagagaaatcagaaacccccgggacgggaggggcggggtcatggtgtgccctacctgcatgaggagcttgacgcggtcgagcggcgcggtgatcgtcttggcgacggcccccgcgggcgcccccgccgcgaagagcgcgacggcgttgggcaccagcgccagcatcgccagcgggtgcctcaccagcacccccgccgccggcagctgctgctgcttcccctttccc

SEQ ID NO: 30249 - DNA, 30911 bp, Oryza sativa
  unsure (1)..(30911): unsure at all n locations
tcccctccccctcccccctcccgcacggtgagcgacgcgaacgccgggccacccccacccccacccacgcggagggcgagcgcgcggcgggcgtgggaagccgccggcgtgggtgggggcctccatgagtcgcacgccgccgcatccactcgccggtggctcatcgtcgtcggtgggcaggcggtggccggatctgcttggccgcgagaggcgaggcgaggcgaggcggaatggaagagagaattaatgcggaggaagaagaagaagcgaagaaggaagaggggataagggggggaggaggattgatttcctccccgttttatgtcgaagctcgagagagcggtgaggaggggggttggttgtttaaaccctcgcgcacgccggacacgcgggcaatgcactcctctctcttttttttctttctttttcgttttcttttcttgagaggattaatggtgtatgagtgtggcacaatgaaagggacgtgtttcggttcttgccacaatgtcagcaagtaaatgcggttttggttgcccgtctgttcggcatttgtgccgtacatggacatgggaaccgaatcgtggaagaagggacagctaattgggtccgttttttttttttttgacaaattgacccttttggaaaacttatttcgaaactaacccctgccaaaaacttcaacaaaaaataggccgtcgcctcagcgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagcctgctggatggcttgcgggctgggacctcagcgccagcccacctggcgctgaggtgggacttggccgcaacccccaaggcccagaccagcaagcctgctggatggcttgcgggctgggacctcagcgccagccataatggcgctgactattggaaactcagcgccagcccacctggcgctgaggtgggacttggccgtttcggccgtggcccagcccagcaagccttctggatggctgggctgggacctcagcgccaggtgagccctgctaaactttagcaaaactttgcacacaacagaggcaaacatcaaatcatagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagccaactggcgtcgtggtcgacagggcccggcctgcgagatatctggctgtgacgactctggtgcgtcctctagctgcgagggaccgagctcaacggcgtccttttatctgtcctcatccccttcttcgtcctcgtctccttcccacgcctatttgtcgtgctcgccctcctcgtcacacacttcccattcttaatccccctcttggtgggcatgagcatgttcgaccacatcagtcgacctgcagccgagccttgctgccgacttcgaacatcgctgcggtagtctctgcataaaaaataacccatgttaagttatcgcttttggaagaaaacacggtagtttcatctctttccacggattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtaccccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgaccaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatgaaaaaatcacaatgagaacggaaaggaggacaacagaaagtaaacattgatgcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgctaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgcccaattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaattttaaacccatgcataaacattaattacttgaaaataatatgtaattaccattgcaataccaatacttcaaaagctaacaacatgtctaatttttccaataaataagtacattactcaaatactacacattattgataaaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacagaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcgaattaagtttttgaaaagggtcaatttgtcaaaaaaacggtaattgggtggtaactagaaccaatacgtacttcatatgtacttaaataatacttttaaatattagaatctacgatactatttaacccatcctataaacaaaacctccatacaaatttataggatggtttaaatcttgtagtaggttgcaacattttgagacatggatagtatagtaatatagtagctggattagacctaacctattactaatcttatctagatcttgttatacccctctaaattgatttgaagtactaaattgtgtctaatctggtttttcggtactaaattgctatattttagaatgagattcattcaaattctaagtaaatacaatccaaaaaataaactaaaaaccagaacagattctcaaaaattaactaactaccaaccaaatgtttatcagaatttagctccctaataaagaagaccaaagagttgttgggtggatggttggattgagcgtggtgcatagctgcatatcaaaggctgacatcatttgcagcaaacgcataccacaataatactatgcatgtacgtgaagtgtttttttcgtgaggattattaaaagtttaagttttttttcctgaatgaacgaggtttattaaaagttgagttcaattatactagcacgcatgtagttagtctatattgagtaccactagagcaatgatccagctagccaagctaaaacgacatctagatcaccccaagtaaagcatataggtttagaaaccattcggatacacagcaaaacaaaaagaaaactcatgtcccagctattctttagaaagtccatgggataaattggagcaagtctatttgcttttcccttttgctcttggaaatttgcagatcaacggtaagattacatatagggcataaattagttgactttctttgccaccttttgatgtttgttattcacaactgagcactattaaatatgatatgtccacggtgtgttttgtttatttcttctcatttcaggttttctacaatactgctcagtactatttaggattctcgtgtcatattgattggccttcttctaattattttagcatttcaatacataaacagttgacaggtatgtataccgaattagaagtatttatctatgtcaaggttcttttagtaattgtatgatgtccataatgtttctttcaaaatataggatcatgtcctgtccccccaacacacacacaaagagataaaaatagaatgtggttattcttaggtacccctctgttccaaaaaaaagtctaatccttgctaatccttggacacatgtgtgtcagattcgtagctagagtttgcctttttatgggacaaagtagtaggaactacacttttttgttgttttgcaagtttgaaatttgacatttcattttacatttattattttcatgtagagggattgaactttatttttccaagtctttgaaatcacttcttacagaattaagcatttcatgttcatacattctttcgctctattagctcaaaagatattttgttgcgatggttcctacaaaatgttaagagttattgcacctgcttcaccttttgtaatatcacatatattgtttatatatgcgtgccaggcaaattatatgtgtcaaccgctatttatgtgatatatgctcctttttttcgttatatactattgattagggattcttatgtatgttttatatagcaggttgttaacgccaaaatttggtaagattttgtagtggattcggttaaggaaaaaacacaatcagccgatggaaagcttatccagaagagtccaagttcaaggagtcatgaataccatggcgtggcagattaatttctatctattaattaggtagagtttagttattttcccttatctttaggaagttttgtctagtgtccgattaggacttgtatctttccttgtctttaggaaacatggtgtcgcgtccgatatgaactactatctaaccatgggtgtttctttgtaaaatgtaatctatctcttgatcaatacaacttcagcgcatatcattggacatctacttcaacatattatcatcggtcgattggattgattgtctttatatcatatttatctaagcgttaaaatttagatcgggcatataacctattgtttaagaccatatcgacatcggctagtactgatacattggcttaatggttgatcggttctttgaacatcaatttatctatcttgtcaattacaggatcaaactgactggcacacccaaacctgatattttaggacttgcactggagctaagcaaatctcccatgacttcaagtgtcacgaagaaatttcacgtcaacacatgcccatatatagatggatgtttgttcctcctttttgttgcaagttttctgtgcattatattcttattagacactctccaggcccattcatgaatgatcctatgtacatgtaagcttctctattgcctttatgtgtacatgaagattatttcgtataagccttttcaagtcttacttcgatacctcagttatcttgtatagttaggtataattatgatcaataattatttaaaaagtctatgaatgatatcgtccattcaaatatatgatccaaatgactacaattattctaaaccacaatagaaataatgatgtcggtatatatatatatctctactacctaaaaaaatcaaaacgtttccttcgtccatcaaaacaaaaaaaaggaagaaaataactaaaaaaaagtctgactcccctgcgttcgtttgccagggctggccctccggtatggaaaacggagcgatccattagcgcgtgtttaattaagtgtttgctaatgtctttttcaaaaatggatcaatatgatttttaagcaattttcgtatataaactttttgtaaaaagaaaagaaccgtttagcattttaaaaaacgtgcgcccagaaaacgaggaagaggggttgggaacaagcgggaacgaacgcagcctaaatagatcagattcccccttaaaaagagggaaaatatgagaaaaaatagcgaacaaaacaacaacaaaaaaaatatgtttcctttaagtggccaaacaaaaccgtagatccaaacgggaaaaaaaaatacgattcctataaaaggcaaaaacaaaaaaaaagtggtgaaaaaaacgctagatccgattcctataaaggtgaaaaaaaaatccaaaacatctttaaaaaaaagttcgtccgattccctaagaaagtggcgaaaaaaactgtttgtaaaaaataaaaatgggttcgtataaaataaaaaatacacccgagaaaaaaaaagggcctaaaaaagtttgatttctattcgttttagtagtcagtatatatatcttctttatctctaatctaatctaactatttaaaaagagaagttttcatcgtacaactgaaaagaaaaaatgcacaataaaataaaaacagttcaaaaaatacgggagaaaaaagtcataaaaaagcgcaaaaacacgctaaaaaggttttccatcttccaaaagaaataaaaaaccgagcaagaaaaaaatatttccatcgtcggtaaaaaaataaaaaacatgcgaggaaaaaactgtcagaaaaaacgcgccatttcaaaacaatggtttgaaaaaaccgcgcaagaaaaaaacaccgtctattaaaaaacaagccgctctgaaaaaattatcagaaaaagcagtaaattgatgcacgcttgagtcggaaaggatccatcgattttttgccatctaatacacggcttttgtttcgtcatctattctcatgtattggaataaaggaaaaagaacattcgaaaaaaaagagcaaacgtgcgagaaaataattgtcagaaaaaagggcaaaataacacgcgagaaaagaaaagcaaaaaaacatgagagaaaaatacggttttcgtcatcagtaaaaaaaaagcaaaaaaaaaacatgctaggaaaaaactgtcacaaaactgcacaagaaaaaaacaccgtttataaaaaaacgagtagaaaaaacaatcgggttcaacacgagaaagaaccgatgtttctaaaaacggttcgagaactctaacgtaacgcgagaaaaaaaaagcatcatttctaaaaaaaggttagagtaaaccatccgaatcaacacgagacatacaaaattgttgtttatgataagaaccgctctggaaaaccatcggactcaacgggagataaaattgatggacgcttgggttggataggatccatcaatttttttctatctcctacacggtttttgtttcctcatctttctcatgtattagagaccctgcacgtctctgcacgtatctgtatgtagatatcaatatttgaataaagtggaggaggaacctatagaaataaacatcaatatttgaataaattgatcaaatatttaaaatattaggatgagataactaatttaccatttattttagttaattacaacactttgagttcacagatatcacttgaaagtaaatagataacaggatgacaaaaacgaataatccaaaataagaattaacagatatcacacctaaaaataaacttacacaaataaatataaaaaatgcattatcatttctagtgtaaggatatcaaacttaatatgaaatgcaatccccagcacaagacgtagatgtgtacatagtccatagtcctaacacaatcagatgtagagtacatataccatcctaatcctcaacacgagaaatacgtgtacatatagtactatgtatagttttaaaaaacctcctacttctcggcacgaggaaatcagggcatgagaaaatcgggatcgatccataacatgtctagtgacttgacaacgctagaactccaacaaacactgctagcacagatccaactaggaaccgtgtgcactcaaccacgcttatgcaaagatcatgctgtctagcaagcagggcagtgcttaaggctgcaattccccccacctcacatgcaacacatgagcacatgcattaacatagatataacttaatcaaattagggagcgtttgttgagggggaaatgagttgtaagacctcatttgcatggccagcattgagtcccatataaacaaagcattaattaactctatccatttccaaaatatagtcagttttataaataattttcatgaaactgttccaaagccaagtaccatcatccactgttgtttaaaaatgtatttgctagtactacatgatgaggaaagtagtaaaatgctagtagtgctttactacttcatttattgccaggcttatttttggtccattattgattggggagagatataaggaaaagatattaaaagaatttcattttattctcaatttttgctacacaaactagtaatagttgtaccttgaaactgagagtataatttattgtttattgtcatgctctatgcatattaatcaggagagtataaagggactatatggcacagctccagcttcacccctcctagagctagagctcagccaaatgtttcagctccacaaaaaataggagtggagctgggtggagctctctcacaaaatggtctagagttgtagagctgggtttaagagctggtgtgctaattcaaggagcaactcaggaactccaaagcacctcaaaccacatatccaccgagcaactccagcatctccaaaacaccgcaaaccatatatccaccaagacatacctacgcatgattctttgtagacgagcacagcgcgaccaactgctacgagtagcgcctcttctatcctgccctctccgcaccgtcgttgcaacgatgtaatggagcgaagcccacaaggaggcaatgggggcacatgcccccttacgctcatagaacaaagcgtaccttatagtaataatagttgatctccatggttgtgggttgctcatcatcaccaatggagcttaaactaaagtggagggagaacctatagaaataaacatcaatatttgaataaattgatcaaacatttaaaatattaggatgagataaccaatttaacatttattttggttaattaaaacactttgagttaacagatatcacttgaaagaaaatagataacaggatgacaaaaacgaatcgtctaaaataagaattgatagatatcacacctgaaaatcaacttacacaaataaatataaagaatacattatcatttgcagtgtaaggatatcaaacttactatgaaatgcaatcctcagcatgagacgtagatgtgtacatagtcgtaatacaatcctcggcacaaggagattatttgagccagtgaacatatcatgttgatcatgaccatcgtgataagtagggtagtggatatgtgtctcacgccacaaaagaattggtgtgctaattggagaagcaactccaggaactccaaagcacctcaaaccacatatccaccgagacatctctgtaagacaaatccagcaacccgaaagcaccgcaaaccatatatccacaaagacaaatctccataaggtcggtaagcatatccatcaagacatgcatacgcacgattctttgtagatgagcacaacgcgaccaaccgcgactattagcacctcttttatcttgccctctccgcaccgtcgttgcaacgatgcaacggagcggagcacagatgggggcacatgcccccttacgctcatagaacaaagtgtaccttatagtaataatagttgatctccatggttgtgggttgttcatcatcaccaattgagtttaagctaaaatggagggagaacctatagaaataaacatcaatatttgaataaattgatcacacctgaaaataaacttacacaaataaatataaaaaatgcattatcatttgcagtgtaagatatcaaacttagtatgaaatgcaatcctcagcacgagacatagatgtatatatagtcctaacacaatcagatgtagacatgtgtacaatcagatgcacataacagtacgagacatgtgtacatataccatcctaatcctcaacacgagaactatgtgtgtacatatagtactatgtatagttttatagatcctcctacttctcggcacgaggaaatcaggatccgagggtccataatatgtagtttcttgacaacactaagaactccaacaaacaccgctagcatagatctaacatgatataaaaggcatcaagtggaaatcctctatgttcaaatttgaaatcaactagttattgagaggatttacagcatgtagttgaataaatttggaattcttgtaatgaaaagaggtctatattgataaatgcgatggagaatgcaaatgatgagaaaagggctaaacagatggaacatgaactgggatagtgaatacaaatgggaaaaacataggtggcaaattattcatatcaagtttcgatagagatgagccaagagaagtttggagtggagggaatgaagtttttgtgtgctcctctttttggcctgatgccgatggatgcaggttttatgccctagcttattttgtagttttttttagtcgatctggtcgcacctgaaccaatgagaattaggccaaaaccttttaatttttttctcctgaacttaatttttttattttttttctcctgaacttaatacttccctaaaaatacttccactgaactaaagtatataaggagaaatggtgatcaagctaataaatgaaacatggtgtaataaaaaaaacataaacaaacatgtgagattgtgataaaagcaactgtgactatatagcagctcatccctcatgcggagagagagataagggggagaggggtgtttataacaaggataagcatgcattcatgataatcttaacaacactaaacagccttgactaacctggccaacagttcttgtgtgcacaatccagaggaaggcactaaatcactacatgtcaatcgatagaagagacaaatacttgggatgagcccctgcaatatgtccacaggcaaaaaagttgacagacttgcttaggagcacaccaaaagccagaccaagtaaatacaagcaccaaacatctattttgttttgtattttttatacaacctcccaatgggaataaactaagcatattcttattgatttagttgattgacatggatgagttattgaaatatttgttaaatctatattactttcaactgaaagtataataacaaaaacaaggaaggaggtttccgcatgtaaaagtactaaaaagataattcaaaacgtgttcagactttagtagtacctcaagatacatttcatcgagcagtccttgagcaccaaaaacctctaatgcgttcctcctcttccttgttctctttgtatcctcctattctctggccatagcagcagtgcacagcagcacatacatcatgaggtcaacgtagagcagaagcaaatcgacaacaaatcagaaagagcaatgcggtggcagtaacataatagcagcagcagcagcaacaacatcaacagttgtagctgtagctgtagcctgtagcggggcagcaaatcgtccctaccaagcaaagcaagagcattgaactcattttttttagcagacggtaggagcaaccgcataggagttggcaagggatgtgaagacctgaaaaaatttgaaagccttggcaaatcagttacagcaactgtcaggcgactcaagctcgtgctgccagccgttgtcgctaccatctctccccctttgtccgcaggaaaccaccgctattgtcgctaccatctttcccctttgtccacaggaaaccgccaatatccccatccattgcatctgtagtgatagatggatggggatgaacggaagacgatggataattttataagatttcatctcttcctcctcttatggtgacgacgttgcgatctactatctaatcccgctttgcttgccctagggtcgcgctcagccctcaactcatgctcactgccttccttatggcgaagatgcagagttgaggatgacgacaaatcgacagcaccgacagcggtgggcaggcggcgatgtcgagcggagttaatgtgtagcagccacagcgcactgtgttgaggggagatggcgacacgagacgaggcgatggtggtgggctaaggcgcacggtggtgggcctattggcgagccggcgatgacattggctgggggatggcagtggcgacgagccacctgggaaggaagaggggtggttcaaggcggcgaccaagtggaggcgtggggtgctcgaagcagggaggttgtccattggtttcactaatcctgctactaatccatcggctaatccaactcacaacgtaggtcgttagatgagaggatccaacggttaggaatgatctgggtatattttgttaattcattttgactttttccgtagtcaaacttaaccaagtttattaataacatatttgttttgtatttaaaatgctatgctaacttgattaaacttaaagtttgattagtcaaaacaacttataatatgaaacagagagagtagatgcctactaattgacttactatactagtaatatgaacgtgctaatgctatggcgatatttcataaaacaatggtgatagacagataaatagaatcatgttgagaatcaaacaactaattatacttgttgctcacagtatactgatttaatacaagacttcctaattcataaaacccattgcatgatcagtttcacttgagctatcaaagcgtaaggattctttgaaaaacaaaaccacagacaacagtgggagaccatagtttacagggtcaacaatcatgttttctccttttctagcctccaaaaataggaacattgattcaatagttttttaaactcccaagttactctaggaaggttgactatgaagatcgtctgagttctaaaccagagatctaccgctctttacaaactgaccaaaatcaaatctatggagctttcccccgaatttagaatggatatgttttacacactttttcaagaacacacgaatgtattgcatgtccttcatacaaaggaagatagggttagacatatcgttactatggggtagtttggatacagggttagtctctgtcacatcggatgtttggacactaatttgaagtattaaacataggctagttacaaaactaattacacggatggaggctaatttgcgagacgaatatattaagactaattagtccatgatttaacaatgtagtgctacagtaattaatcatgaattaattaggcttaatagattcatctcgtaaattagcctctatctgtgtaattagttttgtaattagtctatgtttaatactccaaattagtcagagcgttcgttcgttgggtgattggagagaaagcacatcgttttccgcgtgcacgattcccaaactactaaacggtgcgttttttgcaaaaaaaaaaaaattctataggaaagttgctttaaaaatcatattaatccattcttgaaatttaaaatagttgaaactcaattaatcatgtggtaatggcttacctcgttttgcgtgccttctcaatcttctcttttcctctcctcaaaagtaaaagagagctgaaactcactgattctaaagtttggatcactgaaggctgcaatatggactgatcacttcagaaaagagtcgacacttcaaatttatctacattgatcacacaacctaatagattcactggacaccaatctaatgacatatattttgacaaaatatgtagcagagaaagtactaattattcataaatcacatcatgagctacaaaaacaccatgaactttgcttaccacgtagagcaacaatcgacagaaagctaggcttgcactgttgtttccagcttcctatagattttcctgcaaaacctacaaaactataaaactggtgaattttcaacaccaaacatggccaatgatatgtaatcatgaaaaatcggtataaatctaacggccttatcttgttgcttatgcttatgcttattagccaaaatttgatttttcaaccttaaatttggagttgattttgtggtttttttcatcgtagtttattttttagcctttgcttttagatcgttaggaacatgtatataaaagttttattcacaaattatttctcgtttgcaaataagaataagccaaacaatgggatgtaaaaggctaacctcaataaatggaaatcttcattgatcatgatgaataaaaaacatgaccagagctacagtactatacattaattaaaaacaatattttttgataaaaaaacagttttaattactgcatccaactaacattaataggtaactcggtaaaaaaataggaacattgattcaatagaataagatgctaatagctctcccatccctactgtcccaagttactttaggatggttgactttgaagatcgtctgatttctaaccagcatcttttaaggtgttggagaggttgttgtaaaaccacagacattaaaaattacatgatttagtataagatattcaattgttaagcatccctgtcacgaaccagggggctgctgcaacaccagagtcagcttctgctcctaatctcataccatttgtcgtgatctatgaagtaaaaattgtcattcagataattaatacgaagagaggaaaccttataattccttctagtggcaggccacacagttctaatagccttcacctccacttttgcagcaatgtggaagtaattttacaaaattttaactaggttagtagagtgcagatgttcagtgcaaaattactcgtctattttaatgcgcaccagttgtcttcccataaaacaaaaaaagtagttgagccttacaaaataaaaacttagatgcagggtgttgagcattatcggtgattaggaaatagttccagttctaaactagagtgtttacaaactgatcaaaatcaaatctatgnnnnnnnnnnnnnnnnnnnnnnnntggatatgttttacacactttttcaagaacacacgaatatactgcatgcccttcatacaaagaaggaagatagggttagacatcgtattactatatctgaataataagaggatgatatagttaaagcccttcatcatgctcagaagtaaaagagagctgaaactcactgattcagaagtttggatcactgaaggctgcaacatggactgttcacttcagaaaagagtcgatacttcaaatttatctacagtgatcacacaacctaatagattcactggacaccgatctaatgacatatattttgacaaaatatgtagcagagaaagtactaatcattcataaatcaaatcatgagctgcaaaaacaccatgaacgttgcttaccacgtagagcaacaatcgacagaaagccaggcttgcactgttgtttccagcttcctatagactttcatgcaaaactataaaactggtgaattttcaacaccaaacatggccaatgatatgtaatcgtgaaaaatcggtataaatctaacggcctcatcttttcgcttatgcttatgcttattagccagaatttaaattttcaaccttaaatttggagtcgattttgagttttttttcatcgtagtttatttttcagcctttgcttttagatcattaagaacatgtatataaaagttttattcacaaattatttttcgtttgcaagtaagatgtttggcttattcctcaaataagctaaacaatggggctgtaaaaggccaacctcaataattggatatcttcattgatcatgatgaataaaaaacatgaccagacctcaattaatcatgtggtaatggctcacctcgttttgcgtatcttctcaatcttctcttttcctctcctctcaaacactccctaagaggataatatagttaaaacccttcatcatgctcaaaagtaaaagagagctgaaactcactgattcagaagtttggatcactgaaggctgcaacatggactgttcacttcagaaaagagtcgacacttcaaatttatctacactgatcacacaacctaatagattcactggataccaatctaatgacatatattttgacaaaatatgtagcagagaaagtactaatcattcataaattacatcatgagctacaaaaacaccatgaacgttgcttactacgtacagcaacaatcgacagaaagccgggcttgcactgttgtttccagcttcctacagattttcctgcaaaactataaaactggtgaattttcaacaccaaacatggccaatgatatgtaatcatgaaaaatcggtataaatctaaaaggctaacatcaataaatgaaaatcttcattgatcatgatggataaaaaacatgatcagagctactactatacataaattaaaaacaatactttttgataaaaaaaaaaacagtactaattggtgcatccaactaacattaataggtaactcagtacaattagcccagcagccatttttcctagccacaactttcaccacaatgcattttctacaattggcctcatttctgttttgaaagcaataatgagaacataaaacattgggagctcaatttaattttagagtaaatttcacaaaactacatattttatggttcaagttgcagaaaaccacacatattttgatacttggcacttaagtacatatattttggtagtttagtttcacaaaaccacactatcgatgaatggattcacttgtgatatgacgacgtggttgtttcatctagtatgaggacgtggcatcatattaatttcgtgcgatggctgtaataggatgccatgtcctcgtcctaggtgaaatagccacatcatctcgcgggtgaatctgtacatcgatagtgtagttttgtgaaactacacgaccaaaatatatgtactcaagtgccaagtgtcaaagtgcgtgtggttttctacaacttggaccacaaaatatgtagttttgtgaaatttactcttaattttatgtctggaacaaattacgacctggaaaaatcagaaatgcatttgccgaggaaaaaaaaccagtgaagctgcagccaggtatttgccatgccgctgccatagcctagcatatatggccaacataaactgtaaacataacctagcactctataagtatatggccaacacaaattgtaaatattaattaattcaacaagtatatgacagtcaatacttccgttgtagcctaaaaacaaacatataagaaaagaatgcatcgacaattatattctctagcgtgttcagactttcgatatacatattgacaaggcctcacataaatttgaaagtgagtattaaactaagttcataagtgatcttaaaacaagtaaaaaaataccatttggagtgcatcttttggaacccctgattgcctagctttgtagcatgagtcttcaaaggagcaatcaacttcaaatgtctggtccaaaatttcccctccggtattcataatatatagaaattgtgttcatcaagggataaacctagtgaattactgttgaaacacaggaaacaaattatctccagagcataaggccaatctcacagatagaggtacaaaaccttgattgagtctaacattctacagtgcggactcaatatacacacatgacagtccatttctattttagagagaaatcaaacttcattgtaaattttcattgatgttaaaaatgaaaaataaacaccagtttacaataatgcacatagaatctatgttggcaagaaataaatcattgcaacggagaagaaaccaagtgtcattattatttccatacaaaaaaagagttagagaaacatcagaaattcattgagtaggaccacatcaatatctttacatttgatgaataatatctttacattgttaatgaaagtacatcaatatatattgtggtaaaagcagttctcaaatgatttgcaaaaaaaaagagagcatatagcaccctcaaactatcaccaacatggccttgcatgacacacttctgatgttcatggaagtataggcaaattatcatggggtgtacaatataccagcaccctgaagcaccatacatagcccttgcacactctggaaacaattgatcccaataaatcccaaaagtatatgggtgaagtgattccacactaattaacagagttgtattgtataaaaaccaaacaataatcaatattgatgcagaagtacttaatagcaccaattgtggtatacatggttttgagatctgcagttaaattacagcagttacaccaattgagtttcacaaataaaaacgacagacctagctacaatgtacatctagtgtaaactaaaatgcaatcttaaaataaaatcatgtttaccttcaagccagggcagatggattgaaattcaatctttaagattcataaaaatattgcccctcaaataattcctagggtgacaaatacattctgtatacagaactaaaaaactggagtcattgcctcacatcttttttgagaaggttgaaccaacttaggagcaatttaagtaaacaatattcattcaaactcattttcttttctgaatctatgaccaaaataaacacggtttgtagaagtttagtgatccagcaatgggaacaatatttatcatgtaaacgcgctttaatgaggccaaagtttgtgcctttcttatgagcttctcatatcaacctgccataccacaaaaaaaatgccatacaaatgacaaggccctgagcttatttattttccaagacataagaaacaaagagtgatggctgaaatgcatatataatttagtatgaaactaaagaatgtagaacccaaaatttcctagcactggtgaggggataaatgtacaggatacttcaaaatttatatcacgcatagaagaacacaatattgataaagatactgaaaaatggcaagaacaggagaggttttatgcgatctttaaatattgataaataatacatggttaattgaaagtactaagaataaattaactcaacattctgatagtcctgatcagatttgtagccttatttagcaaattttaacttctttgctatgagcaagcattgcctggtggttaaagtcacagattgcacacccgtataaaaataaactgcaaaggagcagcttaaatacctctgttcatttggtaagttcaccgtatgctatatgtagtaatctccaatatgggacctttcatgatatccaaacctgaacaattaaaaaacagaagcctcccaattagctcctagaaaccacagttcacaatagtacactgaaacaacacggaaaaagttgctctttttttcctaaagtaattatttagtaaaagcttgtaatgcttcttctttacacattccacaataattggattgtcacatgctatagctaacaaattcaggggagtgtacgtcttatgggacaaagggtctatgggagcactattcattacatggtacagtcgacatgtaatataacagctataatgataatgaccttatgatagtaatgaaaaacagatgtatacttcaatgaaaactcatgagcaagcaaaataatgaatagcactaagcatggtttctcaatttctcttctgtccataaaattcctcaatttctcttcctctcccacagtgaggatgataagcttcacagcagtcccagaaagtgaattttatggcagaaaaggaaaaatcataatttgccctgaaagcaaatgcaaaaaagagcctatgtgtatattatcatgggtaaacatatatgactattcagctgaacccgttgtgtgctggaactagttttgctgaaagatggtagtgttggttatgggacctggcattcttcactaaaattccatttaaggttttataacagagtaaaaaaaaactgatgttagacactatactgaaccgatcactgcatccggcaagctgtacacggagccaaccaaatgaaattattcgtgttggccatttcagttagcctttatgtacttgaataataacaagcaacaagagctaatgatctactgtcagatgggatccaaaccgctaggcaattcaaccagtcttatcagaaagcttgtctttatcatggattgactatacatgttagcaatttctgttgcatattctcaacttggacgtatgcatcacatatcaccaacttgaatgcctacaccacagatctatataaacaacgaaatgaggataaacaggtcttaccttcacaacaggggcatatgaagaggggaatgggatcagtgcggcgtcgtgcgatccggcgcaaagaggaccaccgtggagatcaacggagacaaacggatccagaagccagacacccttgtcgattgcagactgccattgcgcgtggagaaggggagtcggcgatgtaggccaccgcggagtgcagtggtgggcccaactttttgaacctgtgtattcgaaatgggaaggttaaaaaaattgttcatacacctaaaagcctaaaaattagcttgtatagttctgaaaattaaccaattatggtaatatggtatgaactaagcaagcaagtatactaaatcaatgaattgtagttcccaatcctaaaatcttcattacaagtatcaaattttgcgattttagtcatagagacaaaaaaaggaataatgagttttatatccttactgtcgatgctaagtatatttaaacatagagaccattataagtcagtcagatgatataatactagtactctagaataaaatgtcatgaaaacttgggccaagaacaattctgttatataatttctagatgaatgaataatatagtgtactgaaaactatgatgtaccaatcaatcaaaacataaatgattcaggcattggattactgaaggaattcctgaaagttgaaaactcttgagaaataatctggtgaagtggtgatgacatgttgatatatcccttctcttttgctgatcttttcagccttcgggaggaatatttacctgctgaggaggtgctgaggaggtggccgagatggcgtgccggcgccctgcgtggcactgcagcgccgcccgagccgctgtggcgctgccgccggtgcgcccctacctggctgcctcacgagtcgcgccgcgcggccgcgccgcagttgccactcgccggctcgccgcagccgcacggcacgaagcgccggccggtcgagcccgcgagccgccgcctccctgccgcagccgcaccggcacgccagagtactggaggtagttgtgaggtgggtggcggagggaggccggcgcgaagaaggggggagagtcggcgaccacgggatggaggtggttgtgaggtgagcgggggcggggagatcggtgaggcagagggacggcagcgcgagtgcgacgcggcggaggtagcacctggcggcgcttcgtggaaggagatcggcggcggcatgtgagaaggagagaggattagggcgtggaggagagagagagagacggcgagcgtgaggaaggcgtcacacgcagaagagtagccgttggattaagatgttaccgttaggtggccgagatgtaaattgtactccttctatccgttggcacgcttgtacttaagaagtatcgtatttgtttatttattcgcacaattatacaaagtacgtgagtatataataaaagttttttttcgcccattaaaaactaggtatctgttggttactccttcatatatttacaaaagaaaaatcagaaatcatctccttttccgtaggacgtttccggcctactccttcccttttgttcctcgtgcatagagatggcaacggagaattcaccgtctggggttacatccgcgtcaccgttcccatggtgatgaaatttcaccgtccctgtccccgccaactatgacggtgctacattttatccatccttgaccttgcacggtccgtcaccgcatgtgctcatcttgcttcgtcaccgtcggagctaatgggagaggtcaaagccatggccagtagccggcaagggagagaaacggtggggtggcggcggagatgggttgcaataggtccctagctacaggacacgcgggtcaccgcgggggacgaggacggggagtggagcactgtccccgcccccgcccctgccatccccgatggtgatgagttttgcaccactagatttcctgtggatggcagatatcatccatcctcatcccttaggccttgtttggttaatcccctttagagagggattggaggggatttatttcacacctattatggtgtggaattattccccctcaatcccctccaaaccgaataaggccttaatgtgtgatttcaccgtggggaatcgatgatcgtccccattgccatctctaatcgtgcggcccatccggcatgcctttgtttcaggctgtgccctgcctcgtgttgacaagtagggttgatgggaaggcggcggtgacggaggcagccctgcgccggcggcggagctccacatccttcgatctgaggtggggaggagcggcgaacttgcagtcggatccagtgtcgccgccaagctccccgctatggtcgccgcccttgagttccgcgagctcctccacactgacgacctcctgctccccggctccccatcgcctgcccctgctcgcccgccgcgacctcttgcttcatgccactggctcgacaacacttgcaagctccaccaccatgaccttcgccatcgctgtcgagcgacacgaggtccttcgaacctcctcgctaaggtccaagtcctccgatttgcccgcgatgcagaaatgacaccagtcgacgtcgcttgctgctccccgcgctagcgaaccccgcagcgtggccgtcaccgttgagggccattagctccatcgcgccgaaaccacactgttgtcgtcgtctccatgcgacgtggggcaaaggtcgatgcggcgccggtgcccatgcgaccggagggacgactggcgctcgcagccaagtccgtcgccgccgccgtaggtcccattgccggcgtgcggagggggagagggaggacaagggggagagagggctggcgccggctctgacgcacacatcgcccatgtggtgagggagggacgacagcgctctcgcggcgtggggaagagatgggacgggcagggaaggaagtagatggatagagtttggggataggagggaaggggatagatttggttgtttttcggaaaaaaaaaaaccttgtgtttttcatgtttacagtgctgcccctaagagcagaattttctcttcttcgtgtcgcatttctttaaaagctaggggtgtactgtataaaacggaacatggtgtcagtcggtggaagtacgtgcgcgctattccgtccaaacacgaggagtctttttttttataaacaccaccatgcgtcatttactacaagaaaggttctgcgtgacacacatgcaggacgagactggcacaaccggtggaggaaacggcgcaaaaaaaatcatgtcacccaatcgaggagcttctgcacctgcaaattacataggacaactactgaggagccaaaaaaaatccaaaaagggagaaaaagggtagctctaggggtttaatatattaatgattaatgatgtaggtgaagtattttctctccttttcttaataaatttatatgcaagttacttacaatttaactcaatatatacatttccgtgcctaaccaaaataaatattctataatgattttgaggacttcacagagagagagagtgtgtgtgtgtgttttcttttttaaaaaaaacctgtcgcgtgaatgggactgcattatgtcgctgtttatgtgttgggtttggtaccacggaccacggcgatggctgattggatatgcatttagggcatacaataggaaatgtatatatggaaatagatatctactgtacttgattgtgttgtcggtagttaggacttagtacagtgtttagttgttcacttgtttgcatgaatttcacataaaaccataaaaaagaacgtatagagttacggaattgctataaatatggcgtcatatttatagcaattagtttacagtcgatcttttaccgtacaattagttcagcgatttgtgcatgtccaaaactgctaacaccatcattactactattgttgatactatacatcgatatacactatccaggacatactaatatctaatcattacggagtaaaatccaagatgccatgcacagatggtaggcaaaaggacaagaaaaggagaagccaaggaagatagagagctcacgtcaatgtctgtttttaaactgcagttacatatgtaattatagtgtgattctattgtagttacatatcacttacacaccacttacatatgtaattaatataattttaggatttacatatataattttagaacttacatatataattttgggacttacattgtaaatacactaaaattacatattagaaatttataatataaatacatgccggctatttttttataaaaaaatatggcgtcataaatatagctactccctagagtatatggagagtctataattataatgtgtagttgcacttgaacagtgcctagaagcactctgccagtcatacttgtcactgcagcacccttttgtccatctaacctagcatgctttttgttggaggattttggtgagttggactgggccattctatttttgtaagtgtttggttgaaaaactccatgggttgagttagacccaaaagggaatactatgtatatatccaggttggcttgatccgtggaaaaattggtgaactgttttgacccacctcctttagcgcagtacacatgaggcgtatgcttgtgaaaaagaagaagatagtgaaaatacacgaaacgagatgagacgttatcgcatcattaagtattaattattttaaacttaaaaaatagattaatatgattttttaaaacaactttcttatagatcattcttttataaaaacacacatacttcgggaagcatgtgcttagaaaacgtgaaaattttctactccgtgtggtgctggtgaacttgcttgagctttttcgtcgacacataaaatgatacaggagattagagtatgattaatcaactattaattattataaacttaaaaatagatttgtttgtttctttaatgaaatatatgatatttatttatttttaaaaaaacaccatttagcaatttagaaagcgtgctaacaaaaacaagaaactttcaatttggagttgataaaaggaacgcagactaaatgaatgatgacaatcaatttcgcatcctccangaagtatctaaagtatcaaacctcatgacctcatcagacaaaatggtcaagcctgggttagcttgagccttagaaaatcttattggcatgagtataccaaattagtataacaatattcacaacaatttcagatcacattctctatcgaatatcgatcccataaagattgcatcccacattcctttgaattctagtgaataacaagggcccaaaagcatgccacattcctctgaattctagtgaatagcagaacaccaaagaagcaatgctggcataaacaaatcttccggttctcttctctctccttttttttaataaatccccaaagggacacgaatagcttgtttgttagtccaaaatatttgtgccaattgtttgttttcactctgccttttagcgcctaggcaacttttctattttatcaatagagtatcagggaaagcttcttcaacttcagccaagttattaccaattatttctgccccaagggcatcaatctcatagcgcacctcctccatgtgctcgtttatgctggtcactgcctcttgaacaccttgtatggcctctttaagagcaccatcatactcagcatctgcctctgcatcctccgtgccagcagcctcggttatctctttgacatgcacacagacatgttgagccatattgcttgacctgcaatctgcatggttcaccaggcgttccgaaggacgaccagctttcttcaacacctgaattcttgccgtctgaaataatcagagattaaaaaaaaaactttgttcagtgaattgagaaatttccaagctgagacctacagatagattgtgcgtcagatcaaaccaaaacgtgattagccacaacagctagaaacaatcgtttgtcaggcttctggactagttttgagtttaattttatttagcagcaatgccatgcgttgattaatgaaattacttttccctcacaaagaaaagatgatgaaaacaaaagtatatcagaaaatagttcaatattaaatcaaggtattgctgctagttgctagacaagcaattcaaacaccctaagtaaacataacaggctaagtgcaaaatatttcaggggtcatcagtaagagagtaataggtgtagttttcaagcaggaatatgccatcctattgcaattgatactatcatgctcaaacagattagtcaatgtgacattaacctttgaatgcatatcaattactattattgctaaatcagggaaacaagtttatattacttcctctgtttcataatataagtcattttgactttttttttccagacaaacttctttaagtttggcaaaatttatagaaaaaaatattagcaacatttacaacaccgaattagtttcattgaaaccaacatttaatatattttgataaaatgagtgttttgtatcgaaaatattgctatatttttctataaactttgtcaaacttaaaaaagtttaactaggaaaaaagtcaaaacgacttataatatgaaacagagggagtattttatttgatcttagagcaaagtataactccaaaccagtcagcactttgaattcaggaatcgggatgcatgttaaatttgttaattgaaataggttgagttgctatttgtaaaacggtcagaacgaaaccataa

SEQ ID NO: 30250 - DNA, 5994 bp, Oryza sativa
gattttcagcacttcaagattgtatgcttgtgagttgtgagttctactttttaagttacacttcaacatgaaacagctttgctggctcaatgtagtgattatgattttaattctgtacaaaagatgagttaggttaaccagcataccaacattatttaattgctgttagcaaatacgacagtcagtgacatctttccatatgtgatatcgtattttctgttcaacatgccacttgaagcatataatgagttcagtaataccgacgcattcctttcgtttcgttgccataatttcagttattttagcgttgcataagggtgatactacttccgtgctccaggaaaaggttttatcattttgttaataacttaatatctccaatagctcatcttttctagtttaaaaacttacatacccaaaatggcttgctcttcatattcaattcatcgcctcaaaaatcacattcagagtgcaatttatcactaaaaccacaaagatcctgcctacaggaatcacatacacagcactctaacctcggcttaaaagttaccagggcaatgaaaaatccccccctgattctaaaagttactccaatcctagggttttaggggcgggactgcacaagttgcacggacccagcaagcagcgagatagtataatatataccttcggagcgtggagtacgcctcggcgcggcgctgctgcacggcgaggaacccgcggagcactccggccaccctcgcgttgctccgcccgccgccgccgcagtccatggcgtcgctgccctcagcggcagccgccgccggagggcactccgccatcgggtcgccgctggcgctggcgctgacgctagcaggatccatctccgccacgctacggccgcctccgatctctccccccttgatctcagctcttcacgaggtgagcgagatttttgcgtgctccggccggcgtcccgccctcccctccccttcccttctctctctctctatctttttccggcccagagatcgggtcggttcaggagttttttttaaaaaaaaaatcagttaagttaggaatcgaagagcaaaccgaatggacatttaacttgccacttttaacatgtgctaattaattatttatacttaatgtatatgacatgtgggtccttatatgtatatgatatgtgggtgcagtgacaattcttttatcaccactaatagataggagtgacaaataattaattattccgaatcatttctctcggttgttaaaaaagaaaaatcagtctctctccttgttaagccgtttttcttcttgttatgaatttcgcgtgtcaaatagtataagattggggatttatttataggagtataaattactactgtacttgtaagtttcactagcctggtccagacttaggctgtgttctttcctggttgatctgggtgattgtgagtgagttttgtttcgttttccgcgtgcacgctttccgaactactatgttttttttaaaaaaaattatataggaaagttgctttaaaaaatcatattaatccatttttgaagtttaaaatacttaatagttaattaatcatcatgtgttaatggctcacctcgttttgtttttgtgtaacctaccaatctcctctatctcttctcctcaaacacacccttagactattaaactttatcacactttatactttatgacacagttgcttatttcgttgtcacgtggtggcttgccacagtttttttatccttcgacctgcatacacattcttgtgcaaaaatttaccaaatctatattcactaaggccttgtttagttgaaaaaaaaaacttttcacccatcacattaaatgtttagacacatgcatagaatattaaatgtggaaaaaaactaattatacagtttgcgtgtaaattgcgagaaaaatcttttgagcctaattgcgccatgatttgacaatgtggtgctacaataaacatttgttaatgacaaattaattaggtttaataaattcgtctcacaatttcttaacgaaatctataatttgttttgttattagactatatttaatacttcaaatgtatgtccgtatatctaatgtgacaactattcccaactaaataaggcctaatttgttagccacaccatagtttagcatagagaatgaagcaggggcaaaatttgctacgggttaggtcatgtttaatgtaggttaatgagtggattattcaaatgaattatgtatttgattatagaataaattaaatattttaagaaataaatatagtaaatactccctcctctatataatccagatttataatatataatccagatttataatggtaggttatatctattttaagacggaggatttgtactgatgggttatctatttttgagactattggagtagctcaaaacaaatactagtctaagtaactcagagcgtgaaataaataatccatttcaataatccaataaatgttcgggttcatatgcaaaacgatcacaacaaaaatttaaacgttaattttaggccctttttttggggtgtgggtgcttcgtgttagacttttaaccgcttgtaagacatatatatatatatataagtgctaaaattattcttcgttgctctttcattttcttccccgcagcttatcgccttcactcaaccaatcagagccttgttccgtgaggatcgaaatgagggtataacagaaattgcttcatctgctggtcctgaacatctcacgattagcaaaatgaatccttgttacattggccagtcccccaaatgataatccagcggtatacagttcgcaagtgccatggaaaaaatggctgcgtcgctgccgttgccggcttgccgcaacaacgtcgcaactcgttcacccgtccgatggaacaccggttcctcgttcctttctgggcggatgtcccatgtcgcttcttcatccatgcaccgtttggctgaccccattcctaaagaaagatgggatggatatgcatatgctggagtagattatctggcaaaccagcataaaagcaaacacaagatggaatttgcgtgacaaaacaatgtcctcagtattataacttgacctggttaaataattggaatcggcttaagtaaacaagcatgagctacatgagtttctgtcgttaaggctagataaccaagctaagataacaagctattagacaactctactatcccacatggtacaatgtcatgaatgccatgaactctaattcagtgcattatgatgcatccatgcaaaagagggaagcaatttctatttgcttgcaacagcaatgaggtgcttagcaggcaaatgttttgcctcgctgaatttcaccaatagaagccatattactggatttaacttcaaactattacagctagaaagataagtgataacagcactgagtgacagatcactaatctgaaaatgtcttcaagaataagagaaaagaaaaaagaatggaaggccggctagttaggagtttaacagaataaacactaatcgatgttagaatagaacacaggtgcaacagttcaacacaaagggcggcatgcatggcaacatagccaactaccatagcacagcagtgcaatttatgaaggaaaagcacagtttcatctgttagaaagttctaaaatgcaatatattcctgtagtcaagattacctgtatgcagaacaataatgacagactgggttgaaaatactaaggttactctacacaatgaaaaaagatcaactctttgtttagaaacatgtctgcatgacactcccatgcgggttaggataaaataagtttcgcaaatatgtaaaaaataatagaaaaggagctctgtacataaagcatgtgaaaaggtaacctgcattgggttcacaggtcaatttaaataatttaaaaggtaacctgatcttatgctgaaaatctgcacttatttagccaaaacgatgtagaaaagatccatggttctttaaatccacacaagctcttttacaataaggtcacaagccctgatggccattcgaaaatctaaatagttgtacatactgcttaattttgaaagataggattgaggaaacaaagttcttgtgaaaactttgaccactagagtaatcgatttgccagaaacagcttaaaacagcaagtttataagtgcgaagcaggaacacgtagaatcatctggccacagtaaaatagttataagcatcctgtaaaatagcaaggtgaataaaaataagtgaaatgggtctgcaaaaagttaaaatttgtatgtacaaaaaataagtttctgaaaaaatgatatacatgtactatggtgatttactagcagttaaaaaaacgttatggaagggttatgaaataactaatatgttacaacctagctgaacagttgcactgcatacgcatcaaaataaggttaggagcaaactgagtcacatgagaatgacaaggcacaacatgaaccatgcatgattgcgaataattgtgaatgactatggatagtgcatgtaaatatctttggatacttttggtaaatccgagagccagacatgataaagaaataaaccagaaatcaagcatcatttaactaaaaaagagaccagaaaagcacgtgatttcacctctagcaaccagcctacgcatatctcctattattatttagctgtacttcaatttcttttgattaatagaatatcaagcttcccaaatctttcccaagctatgcctaatatagagtatgtgcaatagaattattggaaacgattcaactaacactaacataaggcattaactccctgaaattttgattgcaaaatgcagacttcagattcttatggcaacaattgtggcattaaagaaattaacacaagatggcatgttatcctaactttcattgtgcatgcgaagcatctacctaaatagcaataccataaaaagagtaccttggctcatgcaaaagcaaactcagtttaaaagcaaccaagaagagataaataatatagcgactcataaagggaaagctatttctttaccgatgtaaaaaatgcaagatcaatttcttggcagaaaacacatgtgaaaactatttgtaggttcctatggttgggacacaatcacctatccggatcttacctaatgacccatgtaatttcttcctgggcctcctggtggagtactgccatacccaccaccacccccatagccgcccaaataaccaccagcaccaggcatcccaggcaaaccactactacccagtcctgcagaagcccctgggttaggcaaccctgaaccatttgcaccaactcccaggatgttgttcagacccaaccctccaccctgggaggcaaggatagctgtcaaggcctgccccagagcaggattcacccctgggccaccagctacacctggcaatgaagtcaaactggatactggagatggcatcacatggcccccaacagcagcaccaggcaaagaatgactatgagctccataaccaccagcgcctttcctcccgcctgaagtgccagcaccatacaaacccccaagtcctccacctttgttgggctttggtccatcaattgccttctggcagtgcagcacaaccccctcgaattgcttgtgtggctcctgaagcgctttcttagcactatcgagggtcttgtagacaaatagagcaaagcccttcggcttcccggtaaccttatcgagcccaagaggaccctcctcaatctcaccatactttgaaaagaactgcagcagtttctgcgggtctatgtctgcgccgacattgctgacaaaaattttccgctgcgtgtactccgacactggcggcaatgccagctgcgctggggctggggctaccgctggggcagggttagtggccatgccgcccggcggcacaggaccaacagaggcgagctggcaggccgtggtgcggttgccaatcttcttctggggctcacggagcgccg

SEQ ID NO: 30251 - DNA, 2495 bp, Oryza sativa
acctagcggcggcgggggatttggaatcgagcttccgcttcttgcccatgccaacggcgagcgcgaggcgtgggggaaccttggggctagggtttcgacggctgtggaggggaggggaaaggggggctgtgtggtgtggagtctggggctcgcgactcgcgaggccacgcggtcgtggggctttcttggttaacggcgacggaacgggggctacacaccgtttcccacttccgtgtgtggccagtttcggtcgtttttcccaagacaacaatgccacaatgatagatccaaactataaacagtacttgtactattagaacgtaagttcatcttttctttttctcaatatataaacttgactttttgagagcggtagatatcactatacttttgtattgttaattttgtctataatttttaacaatcatctgccttgaaccattttttttttgaaaaaatatatatacaagagaatatccgaatccattttcaagaatgaaggtgttcaacaatcatagcaatataacaatattaacaatagaatatacgcgagtcgaaaaattgtgcttctttagatttatcgaacctattagtgtacatatttatctttctaaattagcgtggaatcattgtaataattaagtacggctttgtgcttcttatttgcagcggccggtttatccattatgtaaaaaacttccgtgcacttaaaatagaaaacaaaaatacaaaatatccagcaaagttgattttgccccaacgtatgtacagcagtgcgaagaacgttgaaaatcttattgtcaagaagtgtccaatccaacaagagatgtaaagattaaaagtaaaccgtataaaatatcagtaataatatgggtttagctttacgctattttttctataatggaaataattccctagcttggtgatcttttttttatttagattttcctttatttctattaacttaaatggagatatccaagacgtcagacaaaagcatagatattggttaatagaaaccattggagtggagataacgaaatcctaatttaagtttataaaaaaacaatcttccaagctccatttaacacattccatgctgtagtacaccagcaacgatttcaggcggtgaacaagctggaagctaagagcaatagttcgtctaacatgtcagtttggggatctagcttcaaaggcttcattggtcaaagtctgaggcaccaaaaaaagagtaatctggatcagcagatgagccaagcaaagggatgtactctgatcctctcacatgaacactgaagcaagctgcaaaatacataaacactgtcaaacgtctacaaacatctagcgatatagtatcccagacaactgcatatgtcaaaaaggtaatactgtactaatcaactgcggacacatgaaaaaaaatgatgctagcccatatgtaaatattttcacaaatgagtggaacccgattcacacgatacactgaaataatttattttccagctgtaatatcaagtttgtgaattttgtccatactaaaacattaaacaaggtagaacaattgctatagttcaatacggtaagccgaggcaaaatcaactactcaactacagtctaacatgcaccccccccaccccccctgcaatcattcacgaggttaagaaatgactgacgaaagtcatgttaagcattttctattttgaactagaacatttggattccatcaatccatcacattaaacacttaaacttgactagtacatgcttccaagttccaaaaaaacttaaaatcaacttagttagctagttcaagtgggggcgtccttagaaaacaaaggattcaacaaaatgtcagagttatgaggttctccgtgcatagagaactaagccggttaaaaacgggattcgatatgtcagttgtaccaaaaagaacactagatcttggataaaggaacacgtcatcaaacaaaagtgtgccattttaagaatcgggaaaatatagttagaatttagcagatatagaaaccacatctttggttggcacaaaaattattaacagtcatttactagtataaatgagcattagaaatgaagatacctctgaactaaggaaagtgcatgttaactactaatctatatagcatgttaaagagtacaagtctatataacatgtctgtatatagtttcacttaaggaaaagataatatgtttcatctattattcatgttgtgataagtattgatacgtccaaggattttatgtattttcaaataaaggtcataaatgaggactctggtataaagttgatattgttgggcatcaaagaagtgataccattctcaattttcactacactttgcagcatagtctccatcttcttcttcatctcactattgtcatccatcagaggcaccacaagggtcagctccctgtatatatcacgtacaaatgcacaaatgtttttggcatattcaacttctccatcagatatacgg

SEQ ID NO: 30252 - DNA, 8168 bp, Oryza sativa
ttttggacagttgcatttacccctaaaacatagtcgagtacatttatctgtaagggctcaacagatttgtcacccagctctagcaaagaatcattgatttcagcaagacttaataaagtgccagtcttgcaaaatctgcagaatgttgcagcttcaacatattcttgtacctgaaatagtcatgacaaacatattggatccgttacaaacctagaacagaaccgatgtaaaggaacaacatttatactaacaccaaaggtataggcccttctgagcttccagaagtcggtcccttgcagttcttttaccaacttcccaatgtattggttaaccacaacagtgagatcattttcagcttttgaaagaacctcttccttgttattcttacttatcctgaaacaaatcagttcagttataaattaagtatagcagcaaataaaattgcaaagcagtataacagagagtaggtcaatttggttattaactatgaaatcatgaaagagacttttgagatgagtatgtatagttctccaatgttgtcagatgaatggacaattttgacactaaataataacttgaatgtatcatttgcacatacagcttttatcaattgccaaaggttgagactagcaataacttctcacaacgtgccacgagatgaaaataagttcatctaaaatcttgtttctgatcgccttcgatttggaggaaacaaatactccataaagcttagctcatggagagttcctgattgtccgtacagtgagagtaataagttttgcaaaaccagaatgacgtttttacactaagaataaactagaatttactggttcattgacattccacaataattttagtatcacatggcatactaattcataacaaactaaggtaatgaatgatacaaggggccctaagaatcacattatctgtcaaggaaacatacatggataattctcttcctttatttaatgaagcaatgtaatgccactagcacaattgtttgcttgtcaaattacctgtgaacctgaaagatggcctttttgctgttcattgtcaaatcccgacttgctttcacaagcctttcccttttatcattctacatatggaaaactgatgagataatataaaaatattgctaacttaagaaagatacagcctgctactaccataactgctttcagcatgtacaaggggaaaaaaatgttcaactgaagaattacacactaagagtagcagtgccgtccatatcacacactaaaccaaatatacatatcttaagcagagctacctagcatctagttcaagcagctttgaggatcagtttggtacaaatgtccaataacaataagttttgcagtgtccacaccccgtgaggtcagtaatctttacttgtcaaaacacttctcctaccctacaccacttacccgcactccaaagtgatcgacaaggctatctcgtcaataatgcactcattagcagaagccagtgatcgcataggctcaacgggaatttctccgagcacctggcccgcacaagatcttggcaccagatcacaccaacagtttccccaaaaaaaaaatcatgcctctactctactctaatatacgacagcgtcctctttgagcgcgccgctgcaggggggaggaaatagctcgagaagagagaacgtcgtcgcacgccaaggaggcgagggacgagcgctctaacgcgtgcgtacaacgtaccagggtgttgaggtactcggcgtgcttggcgaactcggccttcatcgcggagcaccccgccgaggccgaatgcgccgtcgccgccgcgtcggtggccatcgtcctggacctcttgggcgccgagccggcggtggaggctgcaaaggagggggagcagagagggtgagaccgcggagaggggagaagaccgatgaggagagggaggggagtgtccagagcgtacgcggaggagggctcgcgcggagggttttggcggggtgggagtgggactggggcgccgccatggacgtggtgggggtggtggtgatggaagaaagaagggagggggcggtcacgccgcgcaggaaaagaaggcggcggtgtcacccgcgcaggggcaacatctgtcagattgtgggccccgccccgtctcggcacttccgtttcctttgcctcacttggtgcgatttgtatttgtaaggcataatatgcttttttttattattgtttttttagaaaactaaaaaaaaattcgaataaggccttttttaatggtggtgtttgaatcagggactaaactttggtccctgtcatatggatgaatttggagtattaaacatagactacttataaaactaattacataaatgagagttaattcacgtgataaattttttaagcctaattaatccataattagcgcatgtttattgtagcatcacataggctaatcatggattaattaggctcaatagattcgtctctcgaattagtccagggttatagaatgggttttactaatagtctacgtttaatatttataattagtgtccaaacatccgatgtgatagggactaaaaagttttagtgccatctaaacagggtcttagttctcaaaaaaaattccaaaaaacgtcacatcgaatctttggacacatgcatagagcattaaatatagataaaatgaaaaattaattgcacagtttgcatggaaatcgcgagacgaatcttttaagcctaattagtccatgattagccataagtactacattaacccacatgtgctaatgatggattaattaggcttaataaattcgtctcgcagtttccaggcgggttatgaaattagttttttcattcgtgtccaaaaaccctcttccgacatctggtcaaacgtccgatgtgacacccaaaaattttctttacgcgaactaaacaaggcctatgattaagttcaggagaacccacccaacccaagtacatcgacgaagagatacacggaaagtattgaaccgtcttatcataaaagaggctaactgaattaaagaaacaaactttctaatgaaactgaagagtagcataggagcagatcgatagggtattgtgtcatttgtcgcaatgattgcgtccttaggccttcgttaacgtgcaatccgcttgacatacaggtaatttccttctgttgcctccacagaatgtacacgcattagaggtttgttgttgatgttgcgtggtgtggtgttcatcgttaaatctgaagagcactaatcgcaaccgcttggaccaagggtgcacaagcagtctatactcaacccgaacaatgaaccctgcatggttaccgttgcatagaaaacgtcgagaaagatgttccctaaatccaaccaaccttaatcaagagagaacttggacggtggcagtagaacatctgtcttgctagatcaagctggagtacatcatatgaatattgagagaaattaacctttggaaaccttaaaccattaaatgctataacatgtagacttggttcaccacattcagttgaacaagcatgaaatccacaccaacgtcatagtcttcgttaagcaatacctatctactcacctactccatcttgaccaccgaccatcatccgtagcccatccatcaatcgagggagctagccaatgagcagcaggtttggatcaagcaactgttggttcgggcaaccccaccaccagtggaagggcgcagaagtctccagccaaccccatccaaatcaccgaaaagaggaacctgaacctagcattgaggcatcggatccatcggaatatggctgcaccgaaacaacagcttcaagcctccatgatgatttagccaataaagtcgatgaagggactatccaccatggtctagcatgcatgacacttgagatgtcctgcaacacataccgccaccatgggtcctaccaccttcagcaaacgctatggacatgacaccaaaacaggattaaccttaaaacacaagaggacttgacatggaactcgaacactaaactatactacacttattaaagaagaaggcccgacccctcgtttgaccatcaccgacggaaagctgtcggaagcaaggtggaaaaggggtcatggaagggttttactgtagctctctctctctcttcacctttgatgttctccagaagcctcccttgtaaggtaggctgtttaaatacaagaatatgggtgtggaaaaagacacaagatttatggaatatataatattgtttatggagtttttatattgaatattgttcagaactatattaactcatctgtactacctgtctaactccgtccatactatattaactcattaatactacctgtctaactccgtccatacaccagtgtatagctgtatagccataagtaactattaattatcccacaaaatgtaacgttgagacaattttctgtataacagcaatagacttatgccactttttttttataaaaaaattgtagcattataagcacccaaggaactatgtataatttacttaacaatataaatattttgcaaagatacacaaattatgagttaaaaaaacatgtgcttttgcgattttgctatatatttgtcgacaaattttctcccaaaaatttaacagatgtaattacagtacaatcgtagtgtaattacactgtaacttgcatgtaattacactgtaactatagtgtaacttatatgtaacttgcaaaaatctctacgtgatatgttatttcggtaaaatagaagttgtgggaacaaatccttacacatatgtgtgtgccgtgattttatttttcttcctcaccaaaacaaatcttttaatagatctaaagattcaaaattacatgaaacttatatacaagttacaccgtagttacgtgcaagttacagtataattacatataagttacagtgtaattacactataattgtactataattacatctttcaaatttttgaaagaaaatttatcaataaatgtataggtggtcccgtgcttttgtattgtgtttgcgtgaaaaaaggacacggtaaaacaagacgttggaaacccagtcacccacggccacagcccaacaagcccacacaggccacaggagggtccaaccgtccaagggacagacgacgacgagcacgagccccagcgaaaacaccgcggcagcaccgcagcagccgccacccgtgcatccctacccgctgctggccccacccgtcatatacaccctcatccagccggtatttcctccccacggtcggggccccacatgccagccagcgctttgcctttcccacatcccctcctaaacacaaaagtccccataggtcatctccccctcctctctctcttacctcacgcgctccacgcacgcagagtcgagacgcgcacgccaccctgtcgctctctctctctcgctctcgccctcgcctctcccctccccatcaccacccaaaaccctagttacccccaccctctcaaaaccctaaccccacctcaccaccctccccggcggcggcggcccttgtggctgtgcacccatcactccaccggataagctctagctatctatcatccaaagcagcttactagtctgtgctctctctgtgtcggaaggcggcggcggcggcgcggcggctggtggtggtgggcgggggaggcggcggtagagcggtggtatctgggcgttttgtggcgggggcggctcgggcgtcggcgatggaggagccgaatgtgggcggaggggcggcggcggtggtggcgcctgagggggcggatccggctggcggcggcggcggtggaccgggcgcccccgcgtctccctggaggaagaccacgccgccgcctgtggcgggtgaggcggtggtcatgggggccaagtcgtggcccgcgctggaggaggctaggcagaaggtcgccgccgcggaggccgcggcgaggccgggggcgggcaatgctggcggcggtggcgaaccagcgaagggggcgcaggcgcagcagccgtcccctcccccgccacagtcgcaggtataatctggtgctcgtggccagccatatgcttgtttgctatggctttctatttttgttagtttagttcttaaggaaattttagtgtatggtaaagtttgctcacttcggtagatgtttatagtatttgtctctctatacgaaataggtataggttgggtctgggtatgcattggtctactggtgagtagtaaagtaaagcttggctgtttttggaaccacgtatttcaggttcaactttctcgagtgtgttcaactgtccatgttagtttttttgcttgacaagaccgcttgtccgcttatgttcaaagtaggttacacatgcattttgcattatgatgtaagtttgctatttgtcttagaagtaatgttctctctcaagtcaaccatgccccgacagcaagtggttgatagattataggtgtcatattttgatacgtaggatttgtgcattttttgtaacctattatcagattttgtttccacacaagttgtgatccaattggatctttgtatgattttgtccactgtgtctgtagccatcacattattttaggtattgctgtttggtcgcaaacttgcaatcattccaatgctatctagacggttattcaatcttaactgaacatgccttttatagctatctcctttgtaagactgctgggatggttacctaactgactcccatggaagcactttcttgggtgctatggcaatgcagtacatattgaacttatttatcatcgtgggggtaaatataagccttgcatttgtggcagttttgtaacgatcatgatatacatttatcattgttaagatgcatgggtggtctatcccatgaaactgatttgttccaaggtccactcggtaagatcaggaaaacatcattcttatttggtttggttccttgccttccctgtaaaccaaatagttgtcaaacaggtgttttgtgtttcacatgcagactaaggataattgtatgcttttcatcaaatggtttaaagtcccttaggagttattttttttattttaatgttttatgagctgaatatacattattttgtcactgttctacacaagcattttttttgctgatcatataagcattcttcctgttctgatttagtctgatgcaaagggggaaacacttgtttgtaggcacctaatcgcacgcacaagtttgatggccatggaaatcccaacaagaataatcaagcataccatagaaatggccccaagagacgttctcctgctgcgaatgggactccatcttatcctgccgcgatgccatatcaccaacatccagggcaacctttttactaccctgttattcccagtccagtgatactacatgaatatccttacccaccttttgctgttccggttccaagtcatgacccgcatgctggaaaatctggatatgagaattctatgcctgcttatgttccagtagatcaagctggtggcaatgaaggtaaccggccagtgcctccacaaccaaggggagaccttcatgcttggaggcctcctgttggtgcaagaccccagcctggccttgaaggccgtggccattttaatcacaattggcagaatccccagatgttcggtaccagggaaaacacaagtgtaccacaaggtgctgggccaagagctttcatgagaccaatggcacatctgcctcacactctgggatacataaatggtccaccataccctggtaatgctatgctcactgtaatggcatctcctttcatgcttggtattagagctttttttgcaccaatattaaaaaatgtgttgacccagggccaatgcctcccatgtattattacatgcctgctgtacccatggagccgatgagaggtccaccacgttttgtccaaaaccaaccacctcctcatcctgttttatctcctgaattaagagctaaaatactgactcaagtggagtactattttaggtaaattcttatttcttctattgagttgggtagctattttatattgggttaagtctgatttactccccctcaattatcacaaaagtacgatctaccccccttaactctaaacaagatattttacgccctcaaacttttaaaactgtacgaattaccccctttgcactatat

SEQ ID NO: 30253 - DNA, 10829 bp, Oryza sativa
  unsure (1)..(10829): unsure at all n locations
cagcaacagttccatttctgtgactcgcctgatgcaatcaataactggctttgcttgaagggatgcctcccactgaatccaagcccatatgtcatcgaagtatccagctgcatatgactgattacttcctgattgatctctctgttgagctatgatgcacacctagatggagctgctgcacatggttggagctcgtcaggtgtccttttcctgaaagttcgcgaggagatcgccagcagcttgaatgggcctggctgtggatagatcggggaaatcactagcagcttgggctccgctgtcgctcccgcctcataccagtctgccactgttgtctccatcgtgctgctacagtggagataggggcagggagatgcgactcggttgctgctcagaaccagatgccatcgcgcctaaagtccaaaggttgcaggagggagaggggagagaaataagaggggatgaagaaggtagggagaggctgacaagtgggtctgattccacgttggatgccatgtaggcttaaaaccaccatatggttagcagaagggggtaaatcgtctggcttaaatagtactttttccccaaggaagcatgatggttgatgactagaaaacaggcatttgagcatttacactacctgatagagttttcatgcaatttcagaaagcagtgacaagttagtcccattgtatgtctattgaactttggaatatatgaactacaatttgattttgtcaatttcattgttgttatcctatatgcaaacactgacatgctgcactactaaaactattttgtatgtatgtgatgcacatgggttatcatatgcacttttatcatttgtcattcataaggtcttttatttacccattatgatgcttttcagtgatagtaatctggatcatgataattttcttaaatctttaatggacgaacatggctgggttccaatttccaaagttgcagacttcaatcgggtatgtttttctcagtacttaaacttttgctatttcacctttatattatgccatataactactctgctagtttggcttgtttagttgttttgcagcttaagaaaattatcaaggatatacatctaacaactctgttattgcttggttcatttgcagcttaagaaaatgaccacggatatacaactgattgtagaagcattggcaaactcaagtcttttagaagttcaggtacgtttaatgcaactattgttgcttagatccctcttagaatgtcatctctcttatttatcttatgccttttgtataccaccaggatggtaatatgaggcggcgttctgactggtcaaagtgggtttccttgtctgggacatctcttccgagtccatcttcaaccagtatggataacactactggtgaatgtaataaggatgcttattctgaagatgaaaagaagcctcatcctcgcagcgtagattgtgttggtatgggggcttctgatgagccatcacatgatacactcagtagttcagtcacttcactgaataagggcttatcaaacattagtattgataataagcctaagagcatttctgcatgctctctgaactcacaaaaacatgaagctgcttttaggactggtgatgttaaagttcagaaagtaaacacaaagatcaaagtgcctgattctcagagggaaagaggtttctgtaatgatttcataagtgactctcctagcttcagcggcgatcaaagcacattcttgcttgatgaggaattagaattggagcatgcagagctttcacatgatctctattcgcacaaaaggtgaattttaactagtttatatatgatctgttacttcatttcatgagctataatttgttgttttattagtttgttattcatttggtagtttatagtgttgttattgtgatttgagattaaggcgattttggttgtaatttaggcttcctactctggccgaagtgattattattttatgtattcatttgtacagttttatgaaatgaaagatgtatccaggccacttatgtgagatgtgtgctatactgctacaccctccttttccatcagttaatgtcctattatttgatgaaactggatattcttctgtgttcacattttggagtgttaggcacatgtattctcagaagttcaaaaattgattatatattttttcatgtaatactgcatcttttatctactacactgcagattctagaaatggtatgcatataattgattctctttatgtttgtttaagcagggtcgatgatgaggaagatgatttttatgttgatgaccaagatgtgaacaggctaataatcgttacgcaggttagatttcaagtagtattttgtattgctagctctgtgtagtgatatacctccttcagtttgcagctccttgccttcgtaatctgaacacactgggcttgcctttttttatgcaccatgcaccaataagttttgggacagtttcaatggcgttggatgtttaactatttctaattttcatgttatgatgatttacctgatttcttattttttgtatttataatagtcttgctatttcccttgctacgaatcctatttgagcagattatgttcatgcttaataattacataacaaataaatagttgattgctaagtgaaattttatgctttatagggacatgccctttttatttcatgatttttgacttgattgagatacatttccatgtactgtgatataccattattttaacattatttgctttataatgacttgaattttctcatctctaaatattatatgttaattagcaccttagcatccatcaagcaaattttgcagcacgctatcttgtatgctttcaccatgttaagcaagtcttgtcttggtaatagtgcaataaactcttgtcaactatctgcgttacaggacggacctcaagcattttcaaaagaggaaatatcaagaatcaatgaggggttatattactatgaggtaatattttagagcataaaaagaacaagattatcagtaattggggttgtatgtgcattttaggggccaatataatgttgacacagtgctgtgttgtttgggaactgccattcactccaacgcttgtatttattattttattttaacaattacatgctcaattttatgcaagtaaataagctttattttgggcatgcaattcaacccagtaggccagtatcctgttttatcatgaagtatccataaaattaagtaaaattcctgctcaatttaatacaattgtccaggctctaattcaggttttctgttttttagattatcatcccttttctttctcaagaattgcctgcatttgatacttgatacatattatagctttgagttatatgttagaaattagaaatgtcccagtagcatgaatctttccatgtatagtgctggatttttttttttggtatggctaatcaattctttgaatttttgaatcatttgtactaaactgagtgttgggaaaaaggtacgagacaagggttatcttggagctaaatcgaatttaagtcaagccaggttgatccaaacctgagctgttcttgcctttctttatcccaaagccctttctggatttatgcttgcctataaaattacattattctcatgctaatacatgatatttattcttgctttagaatcacgcttataatcaaagaagttcccaagctggcaccatagatattgattctaaaccagctggtggttcaaaggggaatcccattaatattgtaaacaatggaattgaagattctggacagcctatcccacgaaggaggcacaacagaggcaatagaaaagcacagtcctctcataagcagaggttctttcctggtaactttgcgaataacaccaataatagatctcactatggcggtgtatcagagagccccccaagcaattcaattggatatttctacggatctactccagaaaaccacaggttaggttaataaattaattgaggttttatttctgtaaaacaaatacttatctctatgctttgtggctggtcatattgtcatatacctgcaccattcttagcaagagatttgaaaactgagtacatgatttgcgcatgacatttaagtttcaagtttatacacttgcatggacaaatccatctctgccaacctgttttttttattgaaggtggacagacacccactgttatcatgagtgcctttttcattgaagcaaagctattgaagttatcttaactaagtgttgttgtttagctatagaagttcaaggttgagctcatctcctcatggaatccctactggtagctcgcctgttggttctgtgcccaaatctttcccaccatttcaacacccaagtcatcagcttttagagaaaaataaattccagcagcaaaggtaagctgtcagtatagatctcaattgagttgcagttctttctagtactcattcctttgcaagtgtattactaccctttattcgttgtttcatagtaaattgatccgttttaatgttttcttctgcatgtaaaggtacaataagttcaaaaatcgatgcatcgctgaacgcaagaagttagggatcggttgcagtgaggtgcaacttcctcgcacatctctctttctatggcaacgttctaactagatatacataaatctgaccaagctcatttattactctctttgaatcattttcttcatatgtgaaatcatttggtgttactattgttttggcaattattactgattatatgccgcatgaatacttgttctgtttattgattatatactgatgctcttctatcttccaatgtaatgcaggaaatgaattcgttatatcgtttttggtcgtattatctaagagataattttaatgatgatatgtacaaacattttaagaagtttgcactagatgacgcggcagcaaattacagatatggacttgaatgtctcttcagattttataggtacggtacataaaaattttatagtaatattcccatttttttccttgcattccataatatagcagcaatgttcactgcctgcttgtatttacagttatggtttggagaaaaacttccaacgcaatgtgtatgaagatttcgagcagctgacactcgaattccatcacaagggtgatctttatggactcgaaaaatactggtaatttgcatttctctgttacttcctgtcccctagtaatctaattatgtggctactgtccttggggaaatatttagcacagagctatttacacctgagcaaacaccaaacagtatgcaactcaatggtgcatttccaatatcaaatattcacaaccttatgctgtggagtattggcatgataaagttgtacatgctcagtcccagcacaaagatcatcaacaagaaataccatctggtgtcactaatacgttacctcccttctcccacatgtgaacctcacactagatcgtattttccaatttatatttttttgtggtggcactgaaccaaatcttcttttgattataacacacgctattgttacatgaaagctggttcagacctgaatagcctgggtacgccctgaaaagggtaactgaaaatgaatcttaaaattatgctggactagtggaattggccaacctagcagttgtaagatttttgagtttgcgatactttgttgctgacagatctgctttttgctaattgaaccagggctttccaccatttccgaaatcaagatagcagccccattatcaagcatccagaattggagaggctcctaaaggaggagttccgaaccatcgaggatttcaaggcacggaaggcagcagagaaagaaactggcagcagtactgctgccgccgcaggccataacaaggctgatgcgaagtaggtcctagcatggcatgaaattttggtggtcatcccacaaaaaggagaaagtagcaaaaccgtttttgtttggtgaaaaacttaaggatttgagtagacacctgtgcagattttgttctcccctgccgacgatacttgtgtggccttgtccaggaaattttcctctcgnnnnnnnnnnnnnnnnnnnnnnnnnnnnnngccctgtgggatttgtacataaagataataattacttgttgattaaatggacaaataatagagcctggagttaaaatgacacggcattgtcgtcttgccgttgcttttggaaggtttatcttaggaagtttcttcacctgtggtccggaggctggaaaccaagtcacggtcatattgcctttgtgagcttctctccatggaccatggtccttttcgaagtctctttcacttctctggtggcaatgcctttatttttgtcgtcggccgcacgttatatgtcagcacaaagtgccatattctcgttactggagatccggcgtactggcacgacgaggttttctcggtttgtgatgccttttgctgttgcagtaagggcctgttcggagaagtttccagctgcagcttctcccaaaatctctagctcacccaagcaatctagattgtcatccagattttaagaatctgtagttgtagaatccagaaaataaactagaactctagaactcagaagcttaaaaacccagctcatacagattctcagaaattggtcaccaactagaaaattcttaaaatcttaaactcccctaaatagggcctaaatcgtttcttaataagtactagtgccatgtgtctggggttggaaatggtaaaggaaattttcgattgacggagcacagtttccgtataaggggtattgttactcttttgttcccaaataaacactatgtttatttatggatagaggaaatatttcaaattcattaaaaaaaatcaacttctaagaacgagataaatgactattcagatttattctcgtaagttggttttcaggaatggaggatatgtacaagtttttcgattttttgtttgcaaaccgacataatggacgttggacccaaagccagcacggacgataggagaaaatacagtggccagggctgaggctctgcgtcatatggatccgagcctaagtggagtagatgctctcgtagttcgaatgagtacccaatgccagtgtcaaaggaccacctgttatagatgttagtccaaataatcttttcaatattgttagccatctatcgactcaatcataccaaattacgataaacaaaataatactacgagtttacgtatagcttatatctccagactctaattattaaaacacctcaaccaacatggcacatcggctactacaggtttaatagcctaactgtcatccttcctctatatgactgctacattgtcattatcattgttacattgtaatattcactctgtatttaaaagaataactagaggattagagtctgatgctaacttaactttatatcgctattaaaacttcaagtttaattttactttagtatagtatagtcagcgccatattttcacttctctcttagaagtcatttgatattgtcattcttgtttccaaaggccggtgttctatttaggttgtggtggtcttggagtgaaaatatttttgtcacatgtgattcattgtacatttagttaagaaattttgtattgcaactttttttcgcttgctgtttttcactctccacctttactagtaagacgtttggtcgctctctaaaacgtgtctaataattcgtcgatgattaactttagagattggtcctacccaatccccaaacggaactaactactactgtagttccggaattatttgatgatagaagacatctgaccctagatttaattagaacagtaactaagttggcgtgtacctaaaacctctgcataattgtgctacgagtcattcctaaatggacagaatgaacagctcacacatggacggtgacgagtgacgacaagccccagctagatccgataattttccagctcacttgggagttcaaatgttaaaaatctctgtaaagccgttattgcgtaattaatcgaaatgtgaccttagcaagttggcaaattgtgaaaaacgcctactaaaccaccaatatttattacttctaaaacgagccaatatttttgtaataagacgtagccggatacagactgacgtggatattgattgattttcatcattaaaagtacagtgtattcttaaaaacgattattcatgttttttaatattgaaataataatttctggcctctattcatgatgttgtacataatcgtaaaccgttgttcatgtaaatcgcataaacggtgatgtgggtattttaagataaatgggaatgtgcttaatatacttttggacaaaggaagtatctgtgtgtatctacacaaacatttactccccgatttttgtcgtccaaaacagttcttgggctgtgttaggactttggagtactggttgataactcattcccctcacaggaaaaacaagattaattaagtattagcttaaaaaaatagattagtaagattttcaaagtaaactttttatatattatttttaaaaaatgcatcgtttatatgtggtgaatggttgaaatcaatttaaactagctctctataatagtcaatactatagattaaatgtatttaggacgtgtaattactctcagttagagttaactaaatagagtattaccatatatctaacgctacaatagtgttgttagtgatgggagtgaggatgttagcatgttgcctcccactaactaataatgcttttaaagagaagaacaatcccacctactcaggttgattatatggtggacacatcccttattaagatcaactccaaggctcataatgctagaaaaagatatgaacgtacatgtataattgtgtcgcccaagcagacattataagcaacagaaaattaaaaagaaaacatacctactctaaaaactttagggagcatttgtttgcacaaagacaatattaatagctgtaatatttaaagtactatatttaattaaacaaatttggtcttgtagatgttgaattttttttataaacttgatgaaaactaaagaaatttgataagaaaaatcaaaacgacttagagcagatacaatagcaggctattagccagctgtaaacatattttactaagataaaagatgagagagaaaagcagcagactacagatctatagccagctgtagcacggactccaagatgtaatgtgtgtatgacgtatgtgaccatatattaatagtatagtaagcaactattgtatgaattggctattagattggctatagatgaattgaagctagtagtaggctatactattaaacttgctcttataatatgaaacatttggagtaggtacgaggcaagaccactcctaagctaagggcctgtttgaggagctttcagcagctgcagcttctcttagaatctttagttaccagacgctccctaaaactgtccagctttttacccagattctgagaatctatagctatagaatctggaaaatgaactagaagccagaagctgggtttcccagtttctccagattctcacaaactagcttctcagcagctgcttcttagaatctcaaactcatccaaacaggccctaagagcaattgaaaccccacccaagcaatcatcacaaatcaattttttagcttttcaatataagtctagaagtaagtgattttcacatgtaaatccgtccccttgacgaaattgaagtacactccttgtcgtttatcgtgtaaaccatccatgcatctccacgaaaacgagaatgactatcaattgcttgaatcggatagtttcttgcggatcttgtgcaagttcggaattccatttcaaaggccggaacttccgattcggcatgtttcaccggaaggcttggctgcggtgtgctcccgtgttttcgtgcaaacacctaactagaaatccgtatgattgtaatatacatgagaattaactaggattatcacacaattttccatgtacctaaacgttcctaaccatcaaacagctctaggtatcgcatgatacttgagtatcagccgatacctactaggtatcagtcgagacctcagagatattattccgttcgaatggggtatcagccgatatctactagatatcagacaatacatgtaaggtatcataccatccgaactagatactgttctcatttgccattttagtaatatgccacttcaggcttagaacggttagaagttgctgaggcccatgaaatttactcgaaaaggaagcaaaatctgatataaattcggtgaggccaccgccggccaccgcgtccctttcatcgcgtggctttcccacacatcgctgtgtctctggacgccatgacaaaacaaaccaaccccttcaaaataaaaataaaaataaaaataataaaaaaaaacaccacccttatctaaattattattattattatcatctcctcccgctcccgctcgctcgcgccattttccagcccaaagccaagcgcctcggctcgctctcgccgcctcgccgcgcgccgcgcgctcgccatggagatcggtggcgtgctcgtgtcgctgctcttcgccgccttctccctcccctgcctcctcctcctcctcgtcctcgccgaggccggcctccgcctcgcctccctcgcgctccgcggcggccgctacgcctggcccacccgctccgacttcctcggctaccgcatcgcccgccgccgccgcgccgccgtctccggcggcgccggcggggcggacggcgaggaggaggcgcagccgacggcggagtgctgcgaccgccttgc

SEQ ID NO: 30254 - DNA, 1760 bp, Oryza sativa
ttctgcctgtcgcgggtggacgacggcgaggaggtccgcgagctccggtgccgccacgtcttccaccgcgcctgcctcgacgcctggctcgtcctcccgcgcgccacctgcccgctctgccgcgactgcctcctcccgccgccgtgcgagccgccgcgcagcttcccgctcgactactacgacgacgacgacgacgtccacttcggcttcaacgacttctccatcacctcctccaccaccaccaccaccttcgccgccgccgccgtcgcctacccacacggcgtcgcgctctggcccatgtaataaatgtaataatcgccattgctgccgctgccggctgccgccatgcgagaagccgaggagcagagtgttctctctgtttttcttcttctttttttttggtttctttttgcatagttttttttagtaattagttgctaattaatttgggactgattgcttgattaatctaatgtaatctaagatgatctggctaggtggcccatgtaaagtaatgtaataatctccaattctccattgttgctgccacacgagagaagccgagaaacacacagggatcttttggctagctttacgaggtgataggctagacgatttgaatttgaagcctcgttctttctagctatttgatactaaatctttatctaatattcacgtcttttttagcatagtattctctctgttttttcatattttaggggttttttagtagttaattgctaattaattttgggacggattgcctgattagtgcaaaagacgatcaggcttaggtggcggttgctggctgctgtcctgtcctgtcttgctctctctcccggtaaatatcagcgactgataacgatgcctcacctgctactatttctcggatcgtccgtacatctttcatctactacacgagtacatggccatatgcattcatcacgagaaaacgctgcataatgcaaaccacaccccgtcccactaatgcttcatttctgggcatatacaaatactacctctatcctaaaatataaaatattttatccacgtagaagtagtgcttcattcctgcaatcctactgatgtatatatatagcgagaaatgaagtgttatgccaattcagaaaacacaaaaaggaaacagtaatatattatttgtgagcaatttaattaaaaatatggattagataccacctaataataggaataagtttgctgggatcgtgaaagagaaagtaattcgttggatcggttctcctgatccatcctccattatcaaaggatcagcggagtcccaatccatggtggaattccccgctccatggtggataatatcacagcaaatcgatggattgacctaacctagtgtgcaaagcacgtagactaatgcaattagggtaggtggcggtgtcaccgagcgagccagccagccagccggagttgacaacaccggtccatcgcgatcacgattatgcagcccccctacagtagtaatttctccatcacagtaaaaaacaatctagaagtacctgaagtagatttgacactatttgacactatttagtactccatccgtttcataatacaagtgatcttaagtttttacttatactacttcctccgttttttaatagatgacgccattgactttttctcacatgtttgaccattcgtcttattcaaaaaatttatgtaaatgtataagatataaatcacacttaaagtactatgagtgataaaacaactcataacaaaat

SEQ ID NO: 30255 - DNA, 18707 bp, Oryza sativa
tcatctattaaaaaacggaggtagtatttaacaactcatcttattcaaaaaaattatgtaaatataaaaaacaaaaagttatgcttaaagtactttggataataaattaagtcacacataaaataaataataatttcaaaactttttaaataatgcaagtaaaaaagtcaaatagaacggagggagtaaaacagatttgaacagaacagttcagatttgttttgtaatagatgatgtcaaatccatttctaaattatttatttttttcctaactaagggtctgttcactttgataccactttcaaccttatcaaattttggtaaagttaacaaaaaaaaaaatggttacatttagtttgctgccaaattttggtaactatataagaaatcctaccaaaattttggcaagttaccaaaattttgacaactataccaaaatttgataatgctaaaatttagtaaggttttttttttattaaagtgaacaggcactaagagagtactccaaatagtagtacagtgagtgactgtgaaggccagccagccataagcctaagctaacctaatcctccgtcgcgtagcaagttgacaaggccaacttgcccagcaaccagcaggtggcgcggccgtagcatggcgcacgtacgcgcccaccgcatttccgcccaaacgggggagctatccgtgaccgtgcgcccctatccgaagttgttaagatcattagcagttcgaaagaacgtgctaatgatcttaagtcagaaatcagaacagaacgaagccctaacatagtatgatccggaccggcatcctaacaacctcgcgggcgtgatatatcctcccagggttcacaattccgacgaaaaccgatcgaattcctcgaaatttcgacgtttcgatacggctcaaaattaggttttaattggaatttcgaaggctaaacagtatatttggtcgaaattcagtcggaatttatcaaaaactgattgaaaatcatcgaaaatcgtgatatcaatgagacttaaaatttagtggtcaaccggtaatgtgatcctccttcccgcttgcaggtgcagctcgatcgcgcgcgcacccggcaccgaagcgcagagagatcaggtgccgcggcgaccggcccggccacgacgaccaaaacatatcagcattcaacacgatcccgcgagggcgcatgctaaacaaccttatctttttctttttcttatgtttatagttatcaaccaaaatttaaaattttaaatcgttaagaacacgtgtgtgtatatatatataagaaatttataaattattttttatttgtatcctaataagcaaaaagatagccgttccccaactgccgtggcagtacagcctacaggtggtgtacctgcatatggccggcaggcgacatatccatcgccgtttggtactgtggcgtactgagttgtacgtactactactgtgtagcagccagatcttttttttcttcctaaaaaagagggacgtaacgtaacaaccgattgataaaaaactactaacctcttctgtcgcacatatattttcgaataaaccaaaacggcttattaaacaataaaagttaatttataagtacaacttctatatatttgttcgtagcgacttaaaagctaacactaaaagtaaattacatttaaaatatttaaaaatcattcaaaaagttaaattttagctttttctttggtttattagaccaaccaataaggctctatgtctgatctgatgagggaaaacaaagagcaagtttaataataaatgagctataagattatctcttttttttctcctcctctttctatctcttacctatgtatttaatgtatttatcttgaaatatatgaatagctagctattgatgagagccaaccctctttattttttaaattctcttttctccacagttggtttatagcctctaaggacgggcaattcagtttgtataccgcgtgaagccgtgaaagttgaaacagagccggtgagttccatcgtcggacggtcgccgagaagaggttacgcaaaatatgcaacgatagatcatacgttccctatcaaaatcgcgggtgttttgcttgggaaggcgtacgccgtctccgtcgacgatttaatttgtcccgtccccgcttggattcaatgttcgttgccactgatcaagaaccaataatatggtttaggcatttgcttgctcgctaaattgccctgcctcggacatcttaattcacatcgatcgaagacgacgacgaagaaggggatcagtcctgcatgtgactcactctgatttaacggggacgccacgctgccttgtgtctagcttccctctcaatatactactactcctattcgtcgtataaagagttactcactccgtcaaaaaaaaatcaacctagaaagagatacgatctctcctagtatgataaatataaacatataatttgtccagatttattgtattaggagggatcacattgcctcctaagatgagtttttttagacggagagagtagttttttttagaaaatctcagataaattagtatcacattgaaaaagatgtcaacgtcttccattaaaggcttctttgggacacatgaatagaaaaaaaaaaatagaaatgagatgccatatgtaagcaaatcccatgaaatacaaaacacaggaatttgcaagacaatgtgtttagatagctcatagtaaaaacttggggatttggatggattttagagagagaagagagagaaatagaggaagcattggacttctcaaagcaatgttaaaatgaggtaggagagctcatgtgcaaaattcctaggaattggagtataggattacaattcaaaggaattttcctatgcttcaaacaagctagatagaaaattttccttaagatttaaatcctttgaaattcaaatccttgaaattcctatagaaatactccatttcaaaggagccataaaccccatagttcgtagtagtgactattggttgtcctgaccatgattttcttttcaatgaattcctaagcatggtttaattactctgcagatactttttaatatttattcacttcttactaaaatatagcaaccaagtgctcgaatagacaccacctaatactaatatttagtagtacgagtatagacaggtccctttatttagaatcgttgagctatgtggtatctactatgttgctactctcttcgtccctaaattaagtactaattaagtatattttgggatatggagggaataactttttatgggagagattttatatgctaaattatagtataattttaatacagacccttgcaattgattttgcagtatatttcgcacaagctagtctgttatccaagtatggacttcacaaacaatgagaccctgtttaaaagggactaaaactagttttaagtctctatcacatcagatgtttggacactaattataaatattaaacgtagactattaataaaacccatccataatcttggactaattcgtgagacgaatctattgagcctattaatccatgattagactatgtgatgctacagtaaacattatttaattatggattaattaggcttaaaaatatgtctcgcaaattagctttcatttatgtaattagttttgtaagtagtctatatttaatactctaaattagtgtctaaatatagagactaaagttaaatctctggatccaaacaccacctgattcggttgtcggttgcaaaaacaaagagaagaaaaaaacatttcccttcaatccccgtgcatttaatttccctcgtactaccaaggaaaaaaccgaaaaatacgttcccactcccacgcacatatggcctgcacgaatcgtcatcactctcttcatttcacgaaagcaactttaatttgctaaaggaaatcagacaggttcggaaagacaaacgagtttccatttttaaaaagacaatatactctctccgtttcaaaatatttgacaccgttgacttttttagtatgtgtttgaccattcgtcttatttaaaaaatttaaataattatttattcttttcatatcatttaatttattgttaaatatactttcatatacacatatagttttacatacttcataaattttttgaataagacgaatgatcaaacatgtgctaaaaaatcaacggtgtcaaacattttgaaacggaaggagtattttcctaaaacatcactttacgtcgccttattcttatatcagtgacactcaacctatccgtaaggctagaaatgaacatcatgtggacaacgtatcatattaaatctttagttttcctaagccactaccaacagtaacttgctccaccataggccagtattttgctacagagcaacagttccttccggctgcgttgccgtgtgatgctctgtcgtggctgtgatctgtccgtccgcttgccaacccgatatgcttgccctccacacagcacacacccatcaatccccaattcatgaaaataaatccctaatccatctgcttgccctctccaccacacacccatcgatccccaattcatgaagataaatccctaatccatcggagaaatcgacgccatcccctctgccccatcgatcaccagttcgccggcggctgcctttctcttccccgacctgcgttcttccccacccaccgcctgtgattgtagggttgccccgtggtggttgccgctggttatagtcgtcgtccagctatctctatcggtcaggctgccggcgcgctggccgcacccatcaaggctcccgattgttgccctggtcgagcggctgccatctgccagcctgtctgctctggacagctgcctccatcctcggttttcttcagtaagtcttttttctctatactgctctttgttgctgttggatgccaatcttgctttctttcagtttgagtcaccgagacaatgcccaggctgatcaatctttgctgttgttaacagccaaaacatgaatctatttccctatgcttccttgcgatagttaggctgagtgaatactaccaaggttgcgattttttcagattaaacactatatgacaaaatgctaatgaacgaaagatagatatgcgcttttccttgatatgttctcattttgcctgtcagtttattaaatatttgtaggccgtcaacttgcagcttggcatttggattattgcagtgctaattttgctatttattttggcttgccatattgggtcgatttagaatatatgtacgcttcagcatggcatttggtcttggtggtttgattttgaactctctgttactgcctatcaattccctatgtgcatatctttttttttaaccttctttccggtttggtgctttctttcataaacaaaatgcattatagcctcttcattacaatttgcaagtacactcacatttaaagaactccatatcaattggtcaaaaagattaattatgactagatgtgtagtgcattttatctgctttcttttatggctcttcccatatagtttaattagtattacctgatatagcaaactggccagtacctaatgtgccactttatggatgcataaatttctctttatatgtatactacttgattgctacacatataatgatgttttggctgctataaaaaatatattactttcattattatagttccagtaaaccactaattactttcataaatcagtttgaatgatgtcagtctcttctgggccatcaacacctaaaccagcttgcaagcgcaggcaacccgagagagcttttataccttcaggttagctccaagccatataaatgcttatttctacatttgaaaccattttcctattgagctctcctatttgtcaacagatgattctgttgtgccatatctatttcctagggaatattcctagcgatggcgttgttctgctggctgatgacgccctctcccatgtttgtgatttccctacaagttttcatttgccatcaaggcgctctatacgtcgaagactacttactcagtctgctggtataatatttgttgttttgatttttttttccgttctaattgtctaccctgttgttttccaaatgtatggcatttctttccatttattatgcataatcatcactaccaattcaacctaccgcagtccacatttacatatcaatttcccatgttattatcctaattcttttttgaccaaaaattgttgctcatattctaaatcaggatttccccacccggatcctgtaacagctgctcaatcacgtcgaaagcgtaagcttgctatggctgccaaatcatctagaggtttgattatattctttatccactcacatgtttatctacatgtgcactttcatgccttatacaaaagttttttttccctaacacatgttgttttctctagaaattaatagtaccactgaaatgatagagcatcggacgcatatccatgtgctacaccggaatgttcgacaacgaaccggtctgtctcagtcatccaccttggttcctatcaattgtggccatacacaaccttttgcaactgtcgatggaggtctgtcctattcctatttccacttattttactgtgtttctctcctaattcttcaacaaatgtaaccaatgatagcatgttcatcgtcgacctcttcagccctattgtctccatctcccacacatcaacgtaagtttagtcatatattagttctctacaactatcatttcatttcaccctttacaaatcatgacaactacaatgctaataatgtacagaccatttgctcatcaattctcgcggttttgctgatgtaaacctgatgctcgacatgtcaaatcagatcactcatacagtatgatgctcgacttgctgttcgactcactaatgtaattctgatgctcgacctgatgtatgtcaatcaatagcacgaaaaaaaattcccaccttttacacacacttatgtcattttcttttaattactaggcactattttctctccatcaaggcttgggcccccatgtcacacttgtccatattgtggggctttcttttggtttgaggagcgtgtccgccgagaacagcacagctcatcaccaatatacaatacatgttgtaaaggtgggagtgtcatcttacctccatataggccacccccagaacctttgcatagtctactcacaggagttaacagatcattgtcagcccatttttttagaacattaggttctacaattcgatgtttgccttcacatcgatgggtgtaaatgtcattgattctatcaatgatggacgaggcccatatgttttcaagattagtggccagctctgccatcgcattgggtcactcataccagaagaaggaagacgaccagagtatgctcacttatatatctttgacacagaaaatgagatcaggaataggataaatgttggaacctatgcaaataggagttttcgtcctaatgaggatattgtggctggacttatagacatgttcaacacccacaatcctattgtccacctatttaggacagctcgtgatagattggctgaaaatggtgatgattgatacatcataagattatttggtgatcccgacaagcatggtgatatatttagtgctccagttgcatcggaggttgttgggttagttgttggtgatgtaggtataagtgatgttggccgtgaccttattgtgcaggaccaagcgggtcatttacaaaaagttgaagaaaagcattgtaaatttatgtcaatgcaatatccaattctatttccatatggggaggatggctatcatgaaaatatcacataccgacgttgtgctcgattacaagctatcaaaagaaagaagtctactatggttgaatactttgcatataggcttcatgacaaagctgatgacttcaatactcctatgcgctgcaagagaggaacccaggcctatgtcatagatgcctattgttgtatggaagaatctcgcctgagtcactatagatccaagacatttcagcttaagtatagaacaacttcatttagtgaggtatccactatggtccattcaggcatcacagaagcatcagatgccgggcagcaagttatattgccttcttcttatattggggggggggcaagatatttatatcaaaattacttagattcagttgctctatgtagaaaatatggttgccctgatttgtttatcactttcacatcaaattccttatggtcagaggtaacacaagctttggctatcatccctgggcaacactcagcagataggcctgatattattaatcgtgtattccatgttaagctgcatctcttcatggacgacatcgtaaagaagaaattttttggccctgtcactgcaggtagtaatttaattgttcatgaatcatgacacaacatactgcacacttcatatattcaaatattttgtatgtgtcattctcacataatttttccttttatgtagttgtgtacacaattgaatttcagaagcgtggacttccacatgttcacatcatattgtggttagataagagtggtccattgacacctgctgatattgacagactaatatcggcccagcttccagatccatccattgatcgagttggttatgatgctgttgcggcattcatgatgcatggaccttgtggtgatgcaaatccgcattgttcatgcatggttgacggtaaatgctcaaagaattacccgaaggaatattatgagaaaacaacaatcctgccaaatggccatgtaaggtatgctcggccaaaaaatgatataattgttgcgaaaaatggaatttctcttgataattggcatgttgtcccccacaacgtcgatttattagtcaaatatgaggcgcatatcaacgtggaaagagttaatcgtgatggaatggaaaagtatctattcaaatatgttgctaagggttttgattgttcgagggttggtctcaagcgcaagcgggcatgtgctggaactaatgagattcatgactatttagaatgtagatgtatagcgccgaatgaggcggcatggcgtttgctttagtttgagattcattatactgatcctgctattgagcgtctccatgtacatatgccattagagaataatgttacattcacagaggatgataatctggaacagatcttggataacccacgcaatcgtgttacgaaacttacagcatggtttgctgcaaatagagaatactctcaggctgctccatatacatatgcagagttcccagaatactttacctggcatggtaatggcaaatattgggctccacggaaaaattgccgcaagaaaattgaaaggatagcacatgtttgtcctgcccaaggagatgtctactaccttagaatgttgctgcacattgtcaaaggagcaaaatcctattctgatctccggaccattgaaggacatgtatatcctacattccaatctgcatgtcaagccctaggccttcttggtgatgaccgtgaatggtccttcgcaatgactgatgcgactcattgggcacttccctaccaactccgtgagttatttgtaacattgcttcttttctgtgatgttacaaacccactgagtttatttgaagagcatctgtcttcaatgggtcaagatgcagcctaccaccttaaccatgccacactaggtataaattcttctgcaccttcagtcatacaatatgtcaagtcctatgttcgttccgagatcgatagcatacttagaaatgttggtcgtactttggcacatttccatttacctgagcctactattcaaagcacatccatccttggcaataggttgctaatagatgaacaagcatatgatctagagaagatatcgattgaagcggctgatcagttaggcaagttaaatctgaaccagagacatatatatgatgctattctcaattctttaaatagtgacattgggcataccttctttatctatggctatggagggacagggaaaacattcctttggaataccctactaaatagtgtaagggctgaagggaaaattgctttggcagttgcttcttccggtatagcatcacttctacttcctggtggccgcacgcctcattctcgctttagaataccattggacatacaagagcatccagtttgttctattaagaagaacactcacttggctcaattaattcaacaaacctccttagtcatatgggatgaggcacctgttaatcacaaacattgctttgaagctcttgaccgaacattgagagatattcttgcatccaatgatccatcacttgctaacaaacagtttggaggcattacagatgttcttggaggagattttaggcaaactctcccggttctaccctatgaaaaaaacaggaaatcttatcttcatccatcacacgttctcatttgtggcagcactgcattctcatgcatcttacggaaaatatgaggcttcaatccccaacattgtctaatactcatcgtcaacgccttcaagaatttgcagaatggttgttagcaataggggagggagcagtagcagattcttcacctactgatcgagaggatgtttcttgggtaaaaataccagagtatttgcttttgccagatgacacaagaaacctttcaggccttatctcttttgtatatgatgcctcaatcaattctcacacagccaattatctctgtgagcgagcaattctagccccaacaaatgaaatcgctgcaagtataaattcccaaatgattgctcagctgactactgaagaaatgtcatactatagttcagacacaattgaagatactacaagtaatcgtgccactcttgatgctctttacccaactgagttcctgaacactataaaaatcagcggtttgccagaccatcaccttcaactaaaaataggagtgctgattatgctgctgcgcaatctgaacccaaccagacttataatgactcaattgacttgtcgtgtgatagaaggggagataattacagggaaggctaaaggatccaaggcatatataccaaggatagtaaccacttcaattgataagaagtggccttttaaattaaagcgccgacaatttcctgtatgtgtgtcatatgcattgactataaataaaagtcaagggcaaacacttagtagagttggtgtctacttacctagccctgtcttctcacatggacaactttatgtcgcactctcacgtgtaacatcgcctgatggtcttcgtattctaattgagaatagtccaactgagcatgtgaccagcactcacaatgttgtttacaaagaaatatttaacgatctggatcaacaaggaatgcatacatgattacaggtaagtcaagcatacgtgttctacctattagtaatttgttgtgtttggttgccttgcccccaatgtgagtcctaggttcttttttctcagacctactaacttgacctgattatattctttgtgttttgatacttaatgtcaaatttacctatcttcattgtttgcaggattctttatctgaaacctctgccttgtcaaagcagcacgcagttggtattattacaatggttcagttctttcctgtctattttatgtgatcttcacactcaactttcctctaatatatgccttctggtatccatggtttcttcgtaagtttgttttcctctttttatattttgcattctgaccactaaacaagttcaatgtgaaaagaagtttacagcattttacaggttacctatataaatttgaagatccttgcattcatgcattaattgccaaaagaaaaaaaaatcttccacaccaaatctagattctctcacggctaatgcttttaagtattctatcatatttggtcacacacctattcctattaatttagtcttggtacaagttcatagtatgctataattcattaagttttccatccatatatatgtttcataacatgtcttaccacttcatttgtcatctcatcaactgtcacatgatattattttccctgtttcaatgtgatcagccacttcaacaactgtatatggatgtttcacacacatacctattttacttaaaaattaatctgttattcactatgctaccagtcttgattatggctgatgctcataatgatactataatgcaggctgccatcatacgaagaaccaagcatccaaccatctcaatgatcattataaatttcatttttccatcagcaggtgttctgctagaaaacatatcaatgcacctctatgccctattatgtaccttttggcttgcaagagtgttatacgagataaattatttgtctcactcacctgtatgcctgccatgtaaataatataactattttaattgccaactgactaccgtcatcaattcttttgtccgatgaaataacatatcttacatatattatatgctttttagtaagtaaacttccagtaatatttttgttgtcatgtgaaatattaaaaatatatgcattcacatttatattaacgacaatgcagtttctaatcatatcagctttgacgttggatttatatttcaaaatctacatgaataccttttgtttccgtgcttcactccatgcttataataaccaattttcattatgtcccgcggcaacgcgcggggcacatactagtttagtatatacatcgtcaagattctcacgtagtccttccatcctaaaatatttttagacgctgttaactattttaaaaatatttgaccgttcgtcttattcaaaaaatttaagtaattattaatccttttcctatcatttgatttattgttaaatatacttttatgtatgcatataattttgcacatttcacaaaagtttttaataagacgaacggtcaaatatgttttaaaaggttaacaatatcaaacatttagaaaatgagggagtattcggtatggtcctagatttacacggcgacatcctagatttacatggccctttttcgagtttttaatttacgtgtttggggtatctttacaacaaaaaaaaagtcacaaacataactcaagcaaccgattagtctcgccctgttttagcatactaacataatttgagatcttatctaaaaaaataggaatttcaacggagacagtttaaataggaatttttcaggaaaccattacaaaagttgtttctacgtttgggttcatcccctcataattccacctcatcagtgcgtgtgttcggccgtccgtagctgttcattgtctatcgccgtcgtccatcatatatatcgtcagatggacggcgatgggggtgtaaaagagtgacgctgaacggaggagggtcctgtgcgttaatgtcagctacttgtcttctcctcgaggccatagtacccaagctcatgattccgcagtgtcttttatcaccattttttttcttcgggcttgttcactttaatgccaaaaaaaaaccttactaaattttagcaatgccaaaattttggtatagttgtaaaaattttggtaacttgtcaaaattttggcaggatttcttatatagttaacaaaatttagtagcaaactaaatgtagccacttttttttgtcactttatcaaaatttggtaaggttgaaaatgacatcaaagtgaacaggcccttcctctccagttactacctccacctccgttcgataaaacaccaacttctgactttaaatctagatgttggttttttatgagattaagagagtaattagtagtagtaaataaaaacagtaaaaatcaaagttaaccggcttggcgacctagaattattaaactgagcggagattattaatttgtaagttattcataaactgattttgcatgcggggtccgaatgatgtgcagtgcgcatgaacctgaacatgctcgtcgacggtagagctatttccccgacttttctaactcaccatcatcgttttttgcgcccactcttttcaaacggctaaacgacgtgttttttataaaaaatttctatacaaaagttgctttaaaaaatcatattaatccattttcaataataatatatatctataactaatataaatatttggatttttcctgtcgtcacctctcaatgatcgctgtttttgtccgatcatgcgacaaaattttcgtccgtaatgtccgactgagcggcgcccaatttccatccctaataatgtctgactgagcggcgccctccctctctgcgtgaacgcaatcgtgtacggtggccaaagaaaaaatcaaagaggatacaaaatcctaatcgtgtatgacaaatcacaacatcaaaaccaaccgataatcctagaaaatcagtttttcattcactattacaagatcaacactacaaaaattatgaaggtggaagcagaaacacacaaacaaatcctagatccctaaaaaaaccaattgcagcagctcgcgatgcggcaaatccaattgtgaccaaatcagcccaaacatctccacaacaccaatggagagcaaatcgggtaaacaccaaagatccccataaaaaaggccacaaatttccaaagaacatcgctcatgaatcctcttactaaccatcccacgattgatggaggaagagaagcaagggtgctcgagtgaaagcaggaggaaaggcataaaaaacaatgttggatctggaccggtcgccccgcgcctcctccttcgtggaaccatcgcaccgtcctcgccatgctccctgccgccgtgctggtccccagctcgggggctgttggatctagcccccgccgccccgcgcctccttctccacctcatgagagaggagaggcctcgccgcacaggggagagggaaggagaggcgcctgccgcggcgcaggggagagggagaggcgtatatcccagataaaacggacacgtatatcccatatatatataccggttttaaaaaaatatataaaatattactggtgccaacactcaacacttttaatgggctacaggtgcgtcacaaaattttcatctgtaaagtccgactgagtggcgccctccatcttcgcacgagtgtaatcgtgtacaacggccagagcaaaaataaataaataaatcttaatcttaactaactaaaagattaataattttcctttcgtcacaaatttttggtccgtaaatccgtacgcgtttaaccgttttaatcggatttcatgcgcgcaggcctagacagagtccggagctagcctggagtccagtacaagcccaaaatgcccaaatacgttcgcacccagtcacaacatatcctaatctgttttcttttcctccattagtttgagagaaaattatatttgaagtataggtagatgatgcctattatagatggagtggtagctggtttagttacgttctttattatatggcgtccccacatatgtaagatgatacaattttctctccataaagcaaaattcaaacaggtaagacagatcgcaacgccgcgagacattacggatcacaacataagacaaatcttatcttaactacttaaaaatttgtaattttctgttcatcacatcatttttcatccgtaacatcaatttttttgtctgtaaatccgattgagatccaatcagacaatccaaagaaagagaaaacgaatggaaaaaaaaaaacccgcataaatcttatctcaatctttgtcaccgccagatccacccacgggaagccactgtcaccatcggattggcctgtgggaagccgcgtgccgtcggcgccagatccgccatcgacgacgctcgcgggaagtcgctgtcgctgttggatccggccgtgggaagccgcggagggcgccgctgctcgcggtgggggacggcgcagcttcactcgctcgcagtgggggagggcgccgccggcaatgctcgcggtgggagggggaggtcgctaccatcgccttttgagatagagagagagagcaaggggatcgggggaaatgatattaaggttagggtttgagctgccgaatatttatctaggtcgggatcaatcgggaccgtccatcagattggatggccctggtttctcccgcgtcaggtcgggcgttgttcccaggccacctagctattgggccgcatatcctttatattaagttgtattatttatatagacagattaatatatccagtttaggggtttttttttggcagaagacttgttttatgcagatatccaattggacaacgtcatttttccaaaaaaaaaacaaaaaacaaaagtaccaaaacagtgtgaaaataacttcagttaaaaacaaatatttttagttttaatacgccgtagcgaagcacgggcattttgctaataataataaatatttaattaattataagaaaatgtgtcaaatgttttgcgtgcgggacctcacctcccagccccgtactatcttgttcgaaacagaacgtgctgcagcaaaactcttggtttacgtacgcggacagcagtgcagttgcaggttgttacgctttaagaaagtacgatctcatacatgataacgtacctaggcacagtttggacttggacatatatgaatatttgtcgatggtttggacgtttggaagttgtgatctgcaacaaaagtaattaacaatctaccgcccgggcaaggttttttctagtgttaacaagaagagatgcgtaaaagaatcaacagctatatgtacatgcttgtttggtttagtcgtaccaataccaatatcaacacctaaacatgtttttggcactatcaatattttagtagggtccgtagcattctaagtaagtgaagtgggtttaaattgatactaattgagagccaagttttatcaaattaagcatgagcaagctccaaaccaaaccatcatatttactactccctccattctaaattgatctacatatagttttattttagttattcctaaatgatctatacatttgtgatcattcattaagtctattcgttatttgtgtattggagtaaatggacattgatgcatgcatccatgcacacaagtatttataacccacatgcaatatcttgatttgctattggctagaaaatagtgggggtgatgcatacattaagtttgttgctagagttaatatagtataaaaaagttcttagtttttcttgatcttagtgtacctatgaaatatgtagatcaatttaaaatggagggattactccacattttagtatcaatccaaaataatcctacatcaacgaaggacagatcagggcgtaagattcactccttttcactctgtagtcatccaagagcatatgcgtgtgctcttgctaaatccaaaaagaaaagacatgcgtgatcaacaatcgagaacgagagagagagagagagagagagaagaaaccgcgtgcccgattgggccttctgccgactgctcggcctgttccggtgtgcgatgccgcggtggcgtcgagcgtgcatccacatccaattatggaaaaagtccactttcaatccatcggctatgggcttacgacccatgcgccgcgccgatgaccgatctgcttgcggcgtcactgtcacaccatgcataccagccaccaccctgactttggcctcgtcccgacagcatccgtgtcactattcatcggcttggtgtatctccgtcctaaaatataatataaatattttgtatcaaaaaatataagcatttttaaaaattgatatagatattaaaaaaatgattgaaaaattgttgtgatcggttgataagacaaaataagataaaataattaaatggataactattgtgatttgttgagaggaggggataggtggagaaatgtttttttttttcagaacagaggcgccagtaatttttagctgagacggtcgtgcattttgtttgcttgcgtgtgtacgtgacagcaccgagcagttgccgactaacttgaagccgtgaagcgagtgaagctgcgaaacatacatagggaaacagcatgctctcgtgaggagaagttgacttgagcaaatcaaatggtcctatacctggtttaattccgttaaaaaaaatggacatcggcgttggccgccagggtttatggacaagtcaccagatacgtgccgtagcggagacaagggggagcggctgcgagacaggagctgggtggtggccacaacgggcggaggactaggccttgtacaacgctccaccgtggagtgtggtcttagaccttcacgtcggattcgtgtgctcgtgacagtgagaaccgtggtcttgcgatgccgtgcgtgacctatagaggttccggtggtctcatcgcgtctcagctcaggaacaacgacgccacgacctggaaccacgcgttggatgagtccggagagaaatgagtggcttcggtgagagaaggtggtccataagggggaaaaggagaggggggaatgagaaaaggttggtgcacctgagaaaatatcgttcgactggaatagaaaaagtatgtttggtggcataacatgcccacctggattcaagtgcttgcatttacgactatttattgttttaatgctagacgatatactcagtggacaagttaattatggtgacttcattgatataaagatatatcggctcagtctgtatatgagtgtgggtgtgagcatttatagggtgagtttgtgtgtgtttatat

SEQ ID NO: 30256 - DNA, 2234 bp, Oryza sativa
ttttgttttattcaaaaaagattttaatgtatgacgccattgactttttgacaaacgtttgaccttttgtcttattcaaaaaatttatgtaattataatttattttattgtgatttgatttatcataaaatattctttaagtatgacataagtatttttatatttacataaaaattttgaataagatgagtggtcaaacattgattaaaaagtcaacggcgtcatacattaaaatacggttaaaatacggtgggagtactacctaacatggaccgtacatcagctgaagcacgaaaaccaccttttgttggtacacgcccacacatgccgcagccgtcaacgggtaaaccagctgcaccagcaggcccctgatggccaggccagccaccatttgaaaccaattgaaaaaggcaaaattgccaatattcaaccagcctacttttgttgatattgcggaggaggggactaaaagtttttcttttactttgtgcatgtacatagagtttttgaaatttactcaactcactttgtactcaggactcctttgaaacataaaataaaagatacaaataaaaaaacacaggataaaaggtcattctgtatgaaatcctataaaaattaaaaacaaaaatttatcaaattggtcgtttggatactccacataaaacttataaagactttagagaaaaagtatcatttaagtagagtagagttaatagaagagagatagagatatggtatcttggactttcggtagtacaagttcccgactcctccttctcattttccgcgtgaacgcttttcaaactgctaaacggtgcgtttttttttttaaaaagtttctatatgaaagttgcttaaaaaatcatattaatccatttttttaaaaaaatagctaaaacttaactaatcacgcactaaaacgctgcttcgttttgtgtgccggctcccgaacatagccttaaaaggaattcaaaacttgaggtttaagctcatgcttgaaatcctccaagaagtggaggaaaaaaaatattcgtccgaaacttttccaaccatcaaatcctacaaaccaaagggcattgaatccttagaaatcctatgaaaatccctcgttccaaattaacctttaacattgcagtttgacatactgaagttcgtgattaattttggatggtttatctatatggaaatttagtgtaaaaagttgtacttcctctgatcaatatgacgttgagtgtccaagacatttagccagtgcggagtagtatacttaataaaaataatgttggcggcataacaaatcaatgtgtattaataatatatgacatcgagaatacggagtacaccctccttttttcatgttacttatctcttagctttgtccttagctaattatttctaactttgacaacaaatttttcaaaactagtatagttttttttaaagaaaacgtatagtttaccatcatgtaaattatacattacgaaaatatttcatatggtgaagctaaaaatcataaatcttatcattgaactatataatttttttagatattagtggacaaatatacacatatttaatttaaaacaaaactataatgactttgtattaacactatgattgtagtacgattgagcggctcaggcaccaccctggttttgtggactatgtaaaaggaaaaaaaacgctgccacgccgtttcatacggagtactacggaagtaccctaacatggatgtaccccttccgttgggtaaaatctaaatagtgctcgcgtactatttgtccttagggcatgtacaacccacagataggggttcgtctccaagaacctcgaagttatcatccagacagatataaagacagctcatacaacccatagacagaggatctgtctgtaagctgtttaatgcttttgcatgtagctttgatcaattgcaaatacgtttgtgtataccattgtgtggctatatatttgaaataatactatcaagcatgaataagatacatgattataataatttttaggaaccataaatataataattatattacaatgcctttagtctaatttcgtcgccaaacttttcaatcaccccttcagcaaattttatagtataaaagtgaggcttgaattcacgttcacattcacagaaacgggcatgcacataactgaagcattcacataaaggagcacatatacataatgcctgtaactgaagcatgcacattcac

SEQ ID NO: 30257 - DNA, 9520 bp, Oryza sativa
atgcacattcacattccaacagaaactgaagtgcacattcgcatttacaaatcacattcacattaattcataaactgaaactgaatgagacctctcggcactccaactgacctcacaggatgtatatatctcccaggatgtatacctcccagccatgaccacaatcaaatcaatatttagctcccagtatatacctccaatgatcaagctctgaatttatttcctaaattttccttttctgatcatttgcagattctctccgcgcgggatcctgccgcgccgtcgcctcgggacgacgagctcgtacaacggtgctgagcttgcctcttccgcctcggagcacgggtcgtcgccgtcgcctcgcgagaggacgcagctcccgtcgcttgactcaaccggggggttttttttgcataaaaggcatcacaaagacggggcaaaaagacccgctgtacgtgcccttatcccgttaccctttcgtaagccgtccaattagttaatggtagtcgagttacgaacacgtgaccatctaagaagcgagtctattccaatgtcagacaaagagaactgcatgccatccgccagttatcacgtcaattaacactactatttttttatagaatctttcattacttatatattctagacaatatgttatttttaaaatatgtttgaaccattatactgtacttaaaatatgtgacaaaacgaatctaatatcaaatatgttaaaattatttaaattttgttacttcctaatgagttactttcttccaacagtacagttatttctagtattttgaagaccttgtagcattgtagttatttctgcacaccataaaaagatacttttctctagcagtagagttacttctaatatcttatagagatatttctaattttaagagttagttccctgtaggctgtaccagtgtaggtacttcaaataccatagaaagttacttctgttctttcaaagttacctttgtaagcagtgtagttacttctaggatcgtgaaaaattactccgtacatgatgctaaattatatatgtatttttaaaaataacatagagatcactttgaatgaagaaagtatatgtatttatttgaaaatcgtccgtacgttttacttgtaaatttactgtaaatagcctcacgatataataatttgtagtgctataaagagttatttatattacagagctaagctacttctataatttaattaaattactttaaaattgatatatgtttagatatactcaacactatacttgttttatttgttatatattttgagtgaagtgtaatagtgcaaatagctcttaaaaatactatacggtttaggaaatataaatcattaaaaagttttaaaaagatatagtacgagagaataatatattgctatttttaggaagggttactcgttgacacacggcggatgaggtggtcgctctgtttaaccatgtgctgtgtatagacgtgtcccttttgttggtacacgcccacgccgcagcgcagccgtcaacgggtaaataaaccagcagctgcacgttagcacgtacgcctgcacctccaggcccccatgacctgtccccaaccgaaaaggcaaaattgacgcccaaactgcccattttttcatcgagaaaaccagcagctaagaccgtgtttagattttttttcttcttcaaacgttcaacttttccgtcacgtcaaatattttaacacatgtataaagtattaaatatagacgaaaaaaaatcaattgcacagtttacatgtaaatcgcgagacgaatcttttgagcctaattacaccatgattttataatatggcgctacagtaaacatttactaatgatagattaattaggcctaatagattcgacttgcagtatatatacgacatctataatttattttattttattattaggataaatttaatactttaaatgtgtccatatacttaaaaataaatttgccgcacaaactaatcacagacaataaagctgtctcggcaaagacaaagcgcggccgttttcccgggtgccccacccccaccccaccccaccccggcccgcaggtttccgtcccaaaacccagcggcgaccgaccctggccttgccccatgcgtcgtacagacgaaaccgcagtcagtgccgccaccagctgacctgcctgaccaaccaagccggcggctattcatggcggcaccaaaataccacccgccgcccgcccaccgtacccgcgcgcgctgcagtcgcggtgcgatatatagcaacccccacttgagctagaattcccaatccatccaaacccaaaatcggaggtagctacagccgaatcccccaacagttgtgtgcaatttcttgcttgcttggttttcttttccccccactcggatcgatctcgttgttgtgtgaggttttttgagctttggtcgatggcgtcgatcgtgctgctgctgtcggagctgctcggcggcgagagcaccagcgtaatggcggctgactggtacatgagcggacacagcctccgggagttccggcccgtggcggctgctccggcggcggcggcggcggtggccaagtgcgagcggccggcggccgaggcagcgggggagaagaagaaggaggagtcgttcgaggatctcgccgccgtgtcccggatcgcggtcgacgtgatgtggccttagagcatccgtcgccgccatctcgccggagaagaagaaaaagaaaattctattcttgagttttttttctctatttttctccttttttttggttgccaacgaggcatgtgttgtgtactgttctttttgagatcagatttgtaaatatacgaagtgattcttggatgtttttcatgtcattttgtcatcgattttctccttcactcgtttctttcactagttctccactctttttcattccgtctcaaaaaccatcacgattcgctctgaagtcttaacctaaatacgcacttgcttcttcagacaatgcagttcccgcatccagattgcttcataaacattgcagatccttttattcccaaatataacatcaattacaatcgttcgcggtacgcgtcgaacaacaacaatttctccgctgaactctcaagcatacaagagcaagcagatcgccagacactctgacagagagagatgctacgccaagagagtcccggccatcacagtgacagcttctccctggatccggactctcctgttctcgccgtccagctccaagtacaatgttccactccttggcgaagcctgacgaccatggtattgtgccgtttgtacttatcttttttttttcagaaaagtataatgttggcaacaattgtttaccccctacttgtcacaagaaggtagcaaaaggataatacctgaaacgccgtaagtttttgtttccccagctttccaccccagtaaggtgccagaacacaatgtgcgcttccacacacaggatcctgtaagagtatatccgagttgttagtgttttaaaagcctgtgctaaaaaatatactacgagaagtttcaaattttggtcgataaggggcatagagattaacttgccaagttataccaaaagtttctgaacactcaaggaacgatacagccatacagggaatcgtcataaaactatcaaatgcatgataacaagtttatggaactgtcacaagaaatcatgaccaaaataaatttcagtactcagtcaaattcacactttggtcacttcacaagtctatctaaaatgatgtttttttaattactagttgtcgataaccccttgactcaccttgaggtattaagaggttctgattctttggagagattatatcagtcatctctgcatcaatgccaatgtttttcacctagtgtggtaggaactaggaagattaaaactacgcataaaccagaactgtagagacttcaaataaaaaacaccatattatatagagttaagtattgttttcttttatgaaaggagttaagtattgtagtaatcatgcaaggtgtaatcaatttatgtctctgattgatgaaaaatagcttgtgatgatttaacaattttgaatttagacaagcaacattggtaacatcgtgacagcagagaatccttctgtacccatgcaatgactaaaaagtgtaccacatatgagattatatctacatattctggaactaaaatggccatttttaacttaacaagccacattgtctgcataaaaaacttggttgttgggtggaaagaatcggcatacctcatctatcccaaattttgggcagaagaatcgtgaaaagaagtcataatcagatccagcaggtgctggtcccgtaacaataactcctctaccatcacattttttaatttcattaatgttagggataatatcagcaacctcttttccggaagaaagttccacctgaaagccatgccagaatcatttagtactaacaaacaaatgaacaattccaactccttcctctccatcttctttttttaataaaaaaaatccattataaattttccatcttttcagaaaagcttaccaactcctcatttaatattagcatccttaaaagattagcaattctttctcttagggaaataatcgtagcggtagcattgccatggttcatgacctccattttaatctttgaacagacattttttaatcattgacaatgttgactcgcctaattaaatttggacaaataataatttcaaagctattctactttgtaggctaaaaataaaattgtaagattcattccatattactattttcataacagtgcagagttcagagtatttacaaatttattaccaaaaagtagtggtcaaagtgtgtataattcaattgatgttgccaatcattttaaccaaaaaaaaaagacatggtaatatccaaatgtactagttatgaaggcaacattcagagcagcatatatcaaattttgccaaattttgccggatgttgtaacttgtattaaggggatataagaggaagtacgatgaggtcaccggcggttgatgatttccaaacactgacgactcgggcgccattcagagtctccggaatcgacagcgtctccgcggaatcgtactccacgagatcgatcatggggaaatccagctcgatgaacagcttctcctcacccgggacgccgccatcgttcgccggaggcggcggagcaggaaccttcttggcggtcaggatgccggacctcgtcacgaactcgaccatggcggcggcggcgtgctgctgcttcgcgaggacggtggtgaagaggaagtgggcggatgccagcgtcgcgtggccgcagagattcacctgaagacaacgacgacgacgcgtgcggatgaacacaggggagacgagtaagaggaaacctagggttggggggaagggggaggcgacctcggcgacgggggtgaaccagcggaggcggaaccgcggggcggcgtctgcggcggcggcggaggaggaggggtcgcggatgaggaaggcggtctcggagaggttgaactcggctgcgacggactgcatccaccgctcgtccgccgccgccgcggcatcctccccttccaggaggcatacggcggcggggttgcccttgaacggctcggccgcgaacgcgtccacctgcgacgaccgcgccgccgtggcgccaccgacacgtcagcgtcagcatcagcatcgcgcggtgggtcaacaagagaaagggcggatagtgtactgaccacggcgtactggatggcgttcttgaccatttccggcgaggcggcggcgacgacgacgactgcggcgggcggcggcggctgctccgaattcgcgcgcgtgctgaggtggctgcgcaggcggggcacgtttgtttatactttatagagagtgaccagtcgtgctgcaggtgaatgctggtgctgtgttcatcagcactgacgacatggagcttggcggcttatattccttgtaggcactgccgcaccggacaagtgtcactgacaagtggggcccatggacaagtggagccctcggtgtgggagcagttggaaagttacaaatttggaaggcctctcaccaatcacaaaaattttaaagaaaaagttgggaactaggggtgtgtttagttccaaagttttttttccaaacttccaactatccatcacatcaaacctttcatacacacgcaacttttcagtcacatcgtctccaatttcaaccaaatttcaaactttgggtcgaactaaacacagcctagacaaggcctaggtgactggagacagtttaatactactagcatatactcctcccataataccaaaatatagcaacatggtattatattaaaacctacttattcagatttgttgtaatataatatactatatcatatcgaatgtatttactggtgagagtaacttggtactagtagaattctccattcagtcaagatggaaaatgatcaatcagttcggctcccatgacaaacccaatagccaacttcatcatcagttcttcacctgctcccttcttttttctatcctcatatttctgaccagctaaaatgatagtcaaggacagagctcaaccaaccaatttggtaatccagttgaagttagagctcacgtcaatgctgacaaacatgttgcccggcaagctgatttgtaacaggaaaacaaatattctgggcgtagcaaggcagactacaaacatctttacatggatactcgagtagtcgagttttcgtttatttactacagcaaaagcatgcatgctgcatgagaaaacaaacaacgacagaatttcgttactcggatcagatttggtccaagatcacctcggcaccagaaaccttgaagtcagaaggagctacctcaacattgaaagccttgatcttcccatcgtcaacaaaggctgaccacctaaaacggacagcaatacttttagaagagaagtaagaaaaatctatccattaaccagtcacatttcacaatctcttaaatgacaaaacatgtaaattacatcctcaaaaaaaaaaagtgtaccacagcatgagctgtccatggagattatggaatggcatttcaggcttagccaaatgcatacattgtgtcaccagagtactatttacaacaaatgaaagggggcacacaaggaggttcaaaagtgactcaatgttgaatgatgttcaactttgcggaatcacgcaactacatattccttcacaaaaaaacatgcaatacatgcacctggtgaaccataattatgttccaaatatgcacctcagctcttttgtttgaaatttcaatgcacccatagatagttgtgcagctaacaagggcatgctaaagtgcgacacttaggaagtggtttggattcatttattggagtcttttgagaggttagcctcagtgcagtaaattttgtcacaacaacagcaaaatccattggaaatcgactgaataagactcacacttaaatcatgtataggcatgtgcatgcagcttgaagtaattgatcatttacagtcatgaatcatgacagtttaacagtagggaacatgtgtagattagcaatgccgccaatgcagaatgtccttgacaacataaaacatgctcaaatatgataatgaatgcaatgcactttgaagggtaaagctacagtaaggaaaaggagtacttgagttaacccatggtaagtaataagtttaacacaatgatttaattaaacaaataaagcaaaaggcaactgaaatacgttgttttatgttcaattgtaattatataaaacaggcagcagttttaactttttaaggacataaaccaagttaaccaaagtaaaattcattgacctgtgggaacggcggccaagcaaagcagcagagaggtctacttccaaatccaagcttttgtggaaactcccatcaaaatcaccataaaattcaatctggtatcaatattacaaaatcatagcagatggttagatttgaatattatgtgattgtgagcaagtttgatatgaactatatctgcatggactcatgggacaaacattcataaacaatagccatctacaatggtacgagactatgatacgctggtccttattatttttaaagtatagaatatataactattatatacttgaagaatgtttatgtttcttcttacattaaagtgtacattaaacaaatcagaagaaaaacataaataaatttaggtgaacttgaggagatacatgaaattagctttgcaatttactgttttacaggttatatgatgaaataagcacattactggcagacatgtgcagctttcaatcattacaaagtactgaggcagggagagaatacaatagcattcagcatttgtattatggataaagtccaccaaacacaaaggtggatattaatataccatgcatgattagtaaatataattagattagcaaaacatacagcgtgtttaatgcatttcttactatttaagcatatagaatggtaactcacagcatcttttgcctgtagcttttctgcccatccattcagggcataagggtcattcacagagacacagataacagagtcaaccccttttgctttcaacttgtcaatgttatttttataactagggacgtgtgcctgtgaacagactcctgtgtatgcaccctgaaatatgtggtaaagataacagtcacctatattatcagatcagtagatcattcagaaagagaatcgctccaggatataagaatttggaataaacgatgaaaaaatttagacaataaacaaatgatatcaaacatataaagcttcataaatactaaaagacagttagaaatcaactaggaattttgatagaaatgccttattggctggctctgaaagcagaattgtgtggataagtaacatgaaatttttacctttttgtttttactattgcaaccccaaaccatattaccctcactagattgtttgattagatgcagcaccctgtttgctgttcagagaatagagaagaatcgaagaaatggagagttctattaccatttcacctgtgggcaccacgaataccaggctttctaatttctgcactcctaatccgcaaaagaactactctcaagtctggcatttcctactccttaacttcaaatgttggaatttatcttgaaagttgaagtaatcgatgcccaaactacctcttcgccatggcccatggctaatgtatgtcactgtaatgacagaggctacaggaagacgaatccataatccccaatgcgcattcaggatgagtgtatccacacaaaaagcaacaaaccgaaggtcctcatctggtatccgaaatgtatagagtacgcatgaatttcgggaggaagagaggaggggagagcttacaggcaggccgaagatgaccactttcttcccctgcaaaaacacgagggatcatcagaaaagcctggctgagcagcagagcagacgaacgtgggtagtgtagggctagc

SEQ ID NO: 30258 - DNA, 8036 bp, Oryza sativa
  unsure (1)..(8036): unsure at all n locations
catgctggcgccctcctcctgccccgtcggttcacgtgtgccacggtggcaggaggatggtgccccaccctggcgccccaaaaagaacagtttctgggataagttttttcagggatctatttgtgaaataagttttttaaaatgaccaaaatgtgaaaaatccagcgacaagtgataactggcaaaaccagtgaaattttagagaagttctgtcaaaatcttgaattctagtttgattttttctttcattggtcggattatcaggcagccttaaacccttgtttgatgcttaggaatagtttctaccagctacaactattcttaccagcgtcaacttcccctgcaatccgtccaaattctaatcttaagattttgggtgcattagcttaccggccatacttagccaacatatatcaataaaagttgtcgtaattgtctaagttgagacgaccaaatccattctgacacatttagatcttaggttcagtttgggagagcttctagcagctacagcttctcacgtaatctttagcttctcccaacaatctagattatcagttatcacccgtattttaaaaaaaccaacttctacaaattctcgaaagctggctaccaaccaacaaattctcgtaatcttaaaactctccgaacatagccttaggaaatctcatcataccttttaaagtaattgacatatgggatctaatttgttaaaaaaaatcctaccaatattatggtaccaactaaacagctaccaagttgatcaaacttgtagcaaaagagtgacgggcaaccaaacacccctagggctgtgttcacacataggtgttcccatcctgaacagtgattacggaaaatggagcggtctattagcgtttgattaattaagtattagctaattttttttcaaaaatagattaatttgatttttttaagcaactttcgtatagaaactttttacaaaaaaacgcaccgtttaacaatttgaaaagcgtgcacgcggaagaggggatagcgaacagagcctagcatctacataatccaaaaactaagccaaaagctagagttatccgacttattcagattctcatcagctgattatagctgaattctttgtaatctcgccagcaaaataaccaatggacatatctcaaattatctagctcccaaagcggctcgagttcgataactgtttattcaaaaatccacgtcgatcaggaaaggatctatcaagaaatagcagagagagagagggggcagcggaactaaataaactagttgtgacttgtgaccactcttttctattaatgtaaacagaaaattttataagagtttgaaagggtcaattagccctagagggggggtgaataggctaatttaaaactttatgtgaaagctaaaactgaaataaggtcggaaagtctgatccacagtcagactatccgaaaatatcagatagtctgaagttggatcagactgtctgatccaccaatgaagcacaactagatctatcacacaaacaagagtaaagcacaaacagcgactagatctatagcgacacaattaagcaaagctaaaaggaggatgaaggaagattaccaatgatgttcacgaagttgttcccggagttcaaatccttgaggggattctactctccgttgaggagctcactaagagccgggtctttgctaaccctttcctcaagaggttgcactaagcactcctccttccactaaggggtatctttttccttgcggaggcgagatccggccttcacaaacttctctcggccaaccacacgtagatcggtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatacaccacacaaagaacaaggagggatttgagagagggagagagctcaaagatccaaagcaccttagcaccaagctcaacccaaagtgaatgagaatgaaatgagttgggtaaccctagaaaagggttaggtggggggtatttatagacccccccccccaaaaaaatgtggccgttggagggaaatctttcagcccacgtcagatagtccgatacaagatcggatagtccgatattttaaacctccaaggcaacgagaaacagaaaacgaagttccatgaaatttcgaactttccgagacatcggactatctgatgttaaatcggagtatctgatattttagaagcaaaaacttcgtcctcaaacagagaatcaagttctatgaaatttcggagtctctgtatcatcggactatctgatccgacatcggatactccgatacttagaaaaactcactcgataggatttttttaaatcaagacagagagtgaagttctgtgaaaaatcggatagtccgatacatcggatagtctgatttcaaatcggatagtctgatgttgctcaagtaaaactgcaataactttttactccgaactccgatttcgaagatcttggagtctatggaaagctagtttcgtgggctatcaaacccaacataaaacatggtccaaaacctttaagagatgttgaaaaacttgcaaagaaacccggtgtaagtgttgtgacaagtgaaacaactcgggattgaaattttgacttaggtttttcaactcacacaaagatgaaccattttgagcactagtattctaccaataatatgcatgtggtttccctcttaatagtacgacattcctacgacacaatgtaaggtaaaagatacaatataccatttgatcattgccacattgcatcgtgatgtcgcattcatggggtatgcatctcattacaacatgtcgaggacataacaaccttcacatttgcttgaataaaagtgttagtcctctctaatcgcattgtaatcaatcatcaaaatcattagggacctagatgcactttcaatctccccctttttagtgattgatgacaatacgattagatcacaagagagaatgaatataatagatgattttggtgcaaagatttagtaaaagctccccctaaaagtgtgcattaaagcaagtagagagctccccctaaatctttgcatccacattgaagctcacaagacaacaaatatatcacattacataccaagcattcataattaaacaataatgtcttacaaagcattaaactaacttaagaaacacacatctctcatacaaataaaaaccactcatgatcgaccataataaataaaaggatagatcttctccccctttggcatctaagcaccgaaaagggaggatttttgccggaattttgatgaaaacattttgcaaacttttggaaatgaattttttaagggaattgcaccgggaattttgaagagattcaatttttcacaaacttttgatgggagttggagagaaaggaatggccgaacattctggccccatttgagttcatggctagcacacaatcaaccacacaaaacaatagccacaagtcaaatggatgatccaaaaatcaaatgagagtgaattatcatgagacaagatgattcaccctcgagagagggaatgtacgaatctatagcaaattgtgcaaggaccaaaattcattagagaatgagatccccgtacacatagattcaagctatccactcagattatgactagtgttcattcatgaattgaatgttcactttgtcatgatgtggcatgcaatcctattctagtaattgaaaacaaatgcatgcaaaagatcaagccacattccgagaatccaagatatttagttcacttctcaactcacaaaacctagcttcatctagaggcttggtgaagatatccgccaattgtttgtcgattctcacatgttggatgtctatgtcgcctcttgtggaatgatctctcaagaaatggtggcgaatatctatatgtttggttcgggaatgttggacgggattattggctatcttaatggcactctcattgtcacataggagtgggattttggacacattgaggccatagtctctcaaggtttgcttcatccaaataagttgagcacaacaactccccgtcgaaatgtattccgcttcggcggtggatagggcgacggagttttgcttcttggaagaccaagaaacaagggacctacccaagaattggcaagtacccgatgtgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcaggcctagatgcacaaaggtaaaggagtgagccaatgatggaacggtataccttttggtcgacgtctttaccttgctcgttgaggtcgaggtggccatttgatggcatgggagtgtggattggcttcgcattctccattccaaacttcttgagcatgtcctttaaatactttgtttggcaaatgaaagttccttccttgagttgcttgatttgaaggccgaggaagaacttcaattcacccatcatggacatctcaaaacgcttggtcatcatcctactaaactcttcactaaaagacttgttagtagaaccaaatataatgtcatcgacatatatttggcagacaaaaatatcattatcatgtcttttagtaaaaagagttgaatcggctttcccgatctcaaagccgtttttcacaagaaaatttcgaagacactcataccaagctctaggggcttgcttaagctcgtagagtgccttgtggagcttgtacacgtggttgggatattttggatccttgaagcccggtggttgctccacgtataccaactcgttgataagcccgttgaggaaggcgcttttgacatccatttgatatagcttaaaattgaggttagtagcaaaagtaagcaatatgcgaattgactcaagtctagctaccggcgcaaaagtttcaccgaaatctaatccttcgatttgggtgaacccttgcgccactaacctcgctttgttccttatcacgaccccggcctcgtcttgcttgttgcgaaagatccactttgtgccaatcacattttgccgagatcgctccaccaaagtccacacttcattcctggtgaaattgttcaactcctcttgcatcgccatcacccaatccggatcattaagagcttcttccacccttagaggttcaagagaagacacaaacgagtaatgctcacaaaaatttgcaatatgagaacgagtggatactcccttgttgatgtctcctaagatgttgtcggtggggtgatctcgttggatactttggtggattcttgggtgagctagatttattgaagagggtggcacttgctcgccttcttcaccttgatccaagcttgaagtagagggatcattggcttgggtcgatgtaggtggctccacttgtgttgaggaagaggccccttgttgtggctccctaggacgtacgtctccaagagccaaccttttgattgcttctctagggtcctcctcttcacctaacacatgtgagtcaacttgctctacttgagagccgttagtttcgtcaaatgtcacatcaggcgcgatctcaacaataccggaggttttgttgaaaacgcggtatgcgcactcatttgacccatatccaagcaagaaccccccatccactttaggagcaaactttgaggatctagccttcttattaagaatgtagcacttactaccgaaaacacgaaagtaagagacatttggtttgttaccggtaagaagctcatagggagtcttcttaagaaggcggtgaagatagaggcggttgatgtcgtgacatacggtgttgacggcttcggcccaaaagcggtccgatgtcttgtattcgtccaacattgtcctcgcaatctcgatgagagtccgattcttcctctcggctactccattttgttgaggtgagtatgaagccgagaactcatgcttgatgccttcttcatcaagaaaactctcgatgcacgtgttcttgaattccttgacgttgtcgcttcgaatgttcttgatcttgaggtcgaactcgttttgggctcttcttgcaaacttcttgaagatggcttgtgtctcactcttgtcatgcaagaagaacacccacgtgaagcatgaaaagtcatcaacaataacaagaccatatttgttacctccaatgcttagataagcaattggcccgaagaggtccatgtgaagaagctccaacggtcttgtagtagtcattacgttcttgactgggtgatgtgctccaatttgtttcccggcttgacatgcactacacaccctatctttctcaaattgaatatttgttagtccaaggatgtgtcgtgctttagaagtttgtgaagattcctcataccaacatgggctagcctccgatgccaaagccatcccatgttggacttagccactaagcatgtgtcatgtttggctttagttgaggaaaaatccacaagataaaactttcccttgagaacacccttaaagactaccgagaaatcatcccttctaaatatggtcacatcaacatcggtaaaaagacaattgaatcccatggaacataattgagaaacggacaatagattgtaatttagagattttaccaagagggcgttggaaatggaaaggtcatttgaaattgcaatcttacccaatccaattacctttccctttccatcgtccccaaagatgatgttctcttgagaagtgccatttggatcaagagatgaaaacattgattcttctccggtcatatgattagtacaaccactatcaatcacccaacttcttccaccggagacatattcctacaagagatcaatttctagttttaggtacccatacttgcttgggtcctctcatgttagtaacaagtgccttaggcacccaaagcactctcttgatagaaatatttttaccccttgggccaacatacttagcaacaacgcgaccactagcgttcttcctaagaacataagatgcatcaaaacaatgagaagcattatcattaggaaggatacatttggccttaacaaagttgctaagacattggggcttcttgatcatcacactcttgtccacccttcctttaggtggaggaacatacccaagaccttcatggttgaagttgtccctttgatagcctaggtactcctttagggccttactacccatatggcacttaagtaagccattatgaaggagtcccatnnnnnnnnnnnnnnnnnnnnnnnnnnnnnnnnnnnnnnatggcattggcgatgaccaaatgcttgtacccgaggattgaaattgataccattgatggctttgcagacgggacaagcgaagaagctgctcttgatcttatcagtaatgctcaaagtgcggtgacaagattgtaagtgatgttgtagagcaattccgcaacaacgaccttcagccgagcaataataactctgatgatgaaaggactgattctgactgagtgtaaatgtagcaaatggcggctcaatttgtacaatactggtgtatttatgctgagcttgatagttctaaccaagtctttgatttcttaaaagcttttatcaagctttgttgagcctaaaacccaaagaagctattaaaaactttcaatcctcgcagactaagtagaaaaaatcaaacaaggcaatgatagaccaagtaagcaaattgaattgataaaaaatcaccctcccttattatgatgatagcccccgactgacaacggcaagaagaaaacttgatggtgacagtcaagatagggaaatacaatgataagcttaagcatagaaacgaaaaaagtgttcaatgttccaagagttgtcgacaagagtac

SEQ ID NO: 30259 - DNA, 966 bp, Oryza sativa
ccccccccccccccccgaatttttttatttttcttttatttttttgatattttttgcacgcttagggacacataagaaccaaccatagaaaaaatgaactcaaatggacgtaatatgtaacatgtagaatttttcctctcctctcatatctctccgaactaatgcagaggagagagatgtgcaacttttttacttttattttatttttttgatatttttttcatacttaggaacttacaagaaccaaccatataaaaaataaactcaaacggatgaaatatgtggcctgtggaatttccaaagctctaccgaaaaacttctctcctcgaaaacacaatcttgcaagcagaattcggaggttttaatatcgccgaacccggcgaagcgggggaggatcggatgtaacattttctgtaaatgtccgtggatatattatttgcctgattccgagtccgtatgagaaagttacgtctattttaataaatgacatattttgtccgtttcggtagagttttggaaaattttacaagtctgtttgagtttattttttatatggttggtttctatgttctcctaagtgtgaaaaaaatattaaaaaatgaaataaaaataaaaaaattgcatctctctgtactgtttaacttatggctatcatttcatgtggttatattttaaattagattaagtaattttatatagtgatagagtgcattatgtgtaacatgatgatcaaagggttttactaaaggagttatggtctaattttagtgaaggtgcaaagtagactaagtgatatgctagctattttcagacttagctaagtggtagttcgagtttaattttttttttgtggttagttgtatcgtgatcctaagtgtgaaaaaacattcgaaaaaataaaataaaaatgacaccattgcaactccatacagagaaacaggaatggaggcgaggggtggggggcgg

SEQ ID NO: 30260 - DNA, 475 bp, Oryza sativa
aagtggtgtgtaacagtttggcatcttgtacttagaagatatgcacttatatgggcaggacggctcggtaacaccacctagcatgtaaaaagttaatggttagtttctccaatttaacatcataaattttggagttacaaggcaattaaataattatagttccacataagaccatgtctttccaaggacctacctcttacatatatgaagtcagcgcggttaggaagactatccagagaacaaggcatacacagagatgaatcggacccaacaacatttttgtatgtaccgattgggcattcctggaatataatttaatcattactggttgcgaacaaactaataaaaagcatttgctagttaccaaaacaatagtacataaaaagaaactacctagttgcaaagtattgaccatatcaatataggatgttttattagctcatgaatacagatagaaaacccggagtacacaatg

SEQ ID NO: 30261 - DNA, 347 bp, Oryza sativa
gatgataagaagaaggttgtggcggataaatccctctcagagattgtcttgactgatcctaggagggtcaaaaggtgtgtgagtttcaatttttgtgtactagaccatttagggggattgatagtttgacatagtgttttggttactgaaaatcaccatcttattgtacattttcaggatcctgaacaatcgggcatctgccacgaagtcaaaggagaaaaagatgaagcacgtaggggagcttcaacacaaattctaagtgttgcagttggagactgctacattatgagcacaagtggcaatgatgcaggtatgttattagaaggagtggtcattttgattcggag

SEQ ID NO: 30262 - DNA, 484 bp, Oryza sativa
taaaaaggcagtcgggggttacacgcatctttttgtggccattgacaaattctccaagtggattgattctaaaccggttgtcacaatcacagcagataatgcgcgagacttcttcatcaacattgtgcatagatttggagtgcccaatcggatcatcactgataatggcacacaattcactggcggagtttttaaagacttttgtgaggactttggaattaaaatttgctatgcctcagtggcacaccccatgagcaatggacaggtggagcgagccaatggcatgatacttcaagggattaaagcgcgtgtctttgaccggctaaaaccctatgccggcaaatgggtgcaacagctgccatcagtactttggtctttgcgaactacacccagtcgggccacaggccagtcaccctttttccttgtctatggggcagaagcaatgttgccgagtgaagttgaatttgaatctttgcgctttcgg

SEQ ID NO: 30263 - DNA, 498 bp, Oryza sativa
  unsure (1)..(498): unsure at all n locations
nnnnnnnnnnnnnnnnnnnnnnnnnnnnnnnnnnnnnnnnnnnnnnnnncaccgactcttgctctgccgccgacgtctgtttcttcctggacaccgtacgcaaggagcgcgaggagaacacggagcccgccgcgtacgacgccagcgccgacatcgaagatgactaccgcttgttcttggagaacttgcttgtctacgagaacgaggactttgtgctggagtacgatggcaaggtggtcatgtatggaggagaccaagccgcttctgctggtggtggcagtagaggggaggatccggtgatggagaaggagaaagagaaggagaaggaggtggacgttggggtgatctcctccttctctgacgacgagtctaccaagattatttcggagcctaatccgcttgacagaggcgtgtttcagtgaaaggttaatacatcgttccacttcaccaatctcttttttttttctttgggtagctttgctgcattgctaacacaaa

SEQ ID NO: 30264 - DNA, 410 bp, Oryza sativa
cgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcctgccctaaagatccttttgggttgcctcgcattgaccaggtagtcgactcgaccgccggctgtgagcttctcagttttttggattgctactcgggggatcatcagatccgactgaaggaatccgactgcttgaagacttcattcatcacgccttttggggcatactgctacgtcaccatgccgttcggactaaaaaacgcaggagcaacttatcaacgtatgaaccaaagatgcttttcaacgc

SEQ ID NO: 30265 - DNA, 589 bp, Oryza sativa
aggtagtatgaccaaaagtgaaccaaccccttggactgttgcgaaattacaccatctgatttcaaagtagcccgatctaattcaaaaatttcccctaattgggaacgcctcgcatatttttttacagtagcaggattagaataacttactccattaagttcgccaccatagaactccaccgttatgcctacttgttcaacactgtatttggattctgctcttctaaaaggaacgtccgctctcacaattccctcttcatctaccaaaacaaccggaaatgtttcaaaaaaagtaggcatacggcgtacaaaaagttcgcgcccttctttatctctaaagataggatgtcctaaccatccaacagctattccatccccattgtccattgagcctgctctgaataatcccccctttgccggattattaccaatataatcataaaaggctaatttttcgggaattttagaccaagcttctgataaactgagattttcggctaacccatcactaactcttcgatatatttcttgttgaaagaatccctgatcccactgataacgagtaggcccaaacaattcaattggggtag

SEQ ID NO: 30266 - DNA, 6485 bp, Oryza sativa
  unsure (1)..(6485): unsure at all n locations
agaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccattaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttctnnnnnnnnnnnnnnnnnnnnnnnnnnnnnnnnnnnnnnnnnnnnnnnnnnnnnnnnncaatttttcgtgctcttgctacagttaaacgatcctcctccgataattcatccaacccaagaattgcgataatgtcctgaagttctttgtaacgttgtaaagtttgcttaactctttgcacagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtaggaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatatctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaaatactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaagcgggcgcggatctatgaatagggaatgttgcactagtatctacaggacccaaattgtcaacaggctccccaagaacgttgaaaattcgtccaagagtagctccaccgacaggaacactgagaggagctcctgtgtcaatcacttccattcctctcatcaacccatctgtagcactcatagctacaactctaactcgattatttcctaataattggtgttcctcacaagttacattaatttgcttaccgtcagtgtctcgactcttgactaccaaagcattataaatataaggtaacttgcctgggggaaaagtgacatccagcacgggtccaataatttgatcgatacgccctgtacttttttcttcaattgtagaaaccccgggatgagaagtagtaggattggttctcataattatcacataattttcaaaaaaaaggaatttatcaaaattttgattttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagtccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtctacaataaagatggatttggcgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttgaactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccgggggattcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgatatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccaagtttaaatagattttgatacgatcatgagacttgacaaatcgggattcctctattctatatatttagaagatataaaggtataatccaataaataaatccaaatatagtattatcatatgataatggaatcaaatacgcagtatttacagaaaaagttttcatttattgggaaagaatcaatgacatacaatgcattacagacgtatgatcattaccctttaaccgggttattccattccacttctagatagagaaaaaaactaaaggagaatgaatgaaaaaagacaaagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagaggcgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgtgcggggtcttactaacaggacttcgctgcacgagacgagaattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattcttttttttagaatactttagtattctaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctatttttgtgcctttagtaggcttagtatttccggcaattgcaatggcttctttatttctttatgtgcagaaaaataagattgtctagaaccgacgggaccgaattttctcaatgtatttccacagaggatcataatacggatcttttgtagtgtaagtaatataatatggtgtgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatct

SEQ ID NO: 30267 - DNA, 166 bp, Oryza sativa
tttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctat

SEQ ID NO: 30268 - DNA, 136 bp, Oryza sativa
aaggtctttttcctcgtcgtatcctctatatggaaatccggggccagggggccattcccttgactcgtactgatgagaagttttttactccacgagaaattgaacaaaaagctgcccaattggctatttctttgcg

SEQ ID NO: 30269 - DNA, 1223 bp, Oryza sativa
acccaacccagtggctgatgaagttttgaaccttttttctaatatccgttgaaaatttgtgtgtttctgtttgagccgtacgagatgaaattctcatatacggttctcggaggggggtttaggttagttacctatctcaataaagtatatgattggtttgaggaacgtcttgagattcaggcaattgcagttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaatggttattggccagtcaaaattgtgacaggtgtgcctaacgcgattccagtaataggatcacctttagtgaagttattacgtgaaagtgctagtgtgggtcaatccactttgactcatttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatgcaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcataactcaaccatgtcatccatgaagaggctccgtaagatcccatagagtagaaatggaataagt

SEQ ID NO: 30270 - DNA, 3790 bp, Oryza sativa
agtagtcaagctagttaaaattgaacttaattaagacacatgctcatcatatatctttgtggtcagactaattaccatttcatccactcaactagccttttgcttgccatcatagtaccctagctagatccaagagataaagatttttgcggtaccaaattttatattgatgtacatcgctctgatctcaactttcaaattaaccctcctatatatcggtaaactactacaaatctagccatccatgcccccacatctatgacgagtgaaagatccccatctcgaatgactacatctttaacgggtgataaagtggctatagcattctgacaccacccctcgcagatgaccgttaccacactgtgagttcttcactcgatcgacacatataatgcattatgaccaatgacatggcattcgatagagatgagagttacgatccatcacaaatgaattgttctattgcagtagtatcggcaaaaactgcttatttttttacaccccttaatcttcaacaaaggaggaggttatatccttcccaactaactgggacgatccttgaatattgttgcaacattcatggcttctctctcgactggccaacagacggtcaggtctactacttgctgcacaatatgacaagctgcgtgtcggtcttgccatgtacagtagcacagtacaacaacagtacagtaccttctagagactggactactgcgactacctgatagcatgcatgcatgtcataaaattaatctccatgatacgaacttaattagctcatcatggagcctcagttcttagctagagtgtgcatgccgcccgaacgcagtacgtacgtctgtgtagcacatcacaacaatacattagtgacctagataggctagctagcaatgcaatgctggtattgtcgttgcagcatcatatcatctcctaattgaagacgtacgtacgtacgggattgtgttggtttcattcgtcatctgctaccagctgcagatttcatcaagacaatgcagttcagagagatcacaggggccagtcaaggcttgggtaaggccaccaccaggctggtctaagctgaatgttgatggctccttcagtaatagcagcggccaagcaggcatagggatgatcctcaggaattcagaaggataatccatatttacagctcgtcaggttatagcaaattgtgttgatgcgttggaatcggaactaatggcctgtaaagctggactggctttggctttacattggtctatacttccaatcgtccttgagtctgacagcatcttggctgtatccgtgattaatggagaaactgaggacaaatcaaggtttgcttacttgatacgagagctgcgtttcgctccagagaggagaaagggaagttaaaattcagaaagtgcatcgagatcacaataaaattagccttgaacttgcaaatagtgctcgattagcaaataggtcagatttctggtttggccatgagagcaactgtttctctgcacttattctggaggagtgtaatcactctcatattgattaatgaattcccttttccccgccaaaaaaaaaaacgatcacagctcgatctccctcccttctccgtccaatgctccgtaatacttcctctgttttaaaagaaaagtctaatattaagaaattcagaattgtatttttttttttacagagggagtacatatgttcccacctcttatgattttactatttgaaattatgtatcatgctctcattactgcgctaatgcatgagtggtgccgatcagctcctccgttgatagcacgttttgaatgagacaacagctatataaggattttatctagaggagtttctgacagttgcagtattttttaatcaaaagttctttaaaatagttagtttttcgttcagatcttaggaaactatagtcatataatttaaaaattaaactttaaattactttctcattagctatttcttataatataaaaccaataaataagccctaattatatgttgtctaactagcgccgccagctggaccacggatgaatcatcattcatcagtggactggacgatggatgaggcggcatcctatcgcccacacatgttttcaatatgtttgccccaagacaagctgcaaccccagcaaggaattgaattgcgtcttgatgccgtgttaattaattgttaatgcagatggggatgtggcgtcgccgctgctccctccattccataatttttgggtgttttaaataaagttaaagtattttttataactttaattattaataattttaaaaataataaaagtaaaggcaatagcacacatagatatgtcttagaaagttttataataaaaatatatttaattattatatatattataatagaaaaacatagtcaaacatggatatatttcagagactatgtcattgtgcaaaatatcaaaaattatgaaattgaatgaagtatttattactatcgtgttctatcataagtgcgtgagagatagactcaaagagacacgcatccatctgtatgccataaagatgttcgtatgcatgcagccaccggtgtacagggttacctaataaaaaagaggctcacgaggcgctatcttcggtttctatggaatgtctattaacttattaaaggaatagaaaaagaagcctccgcgttcgctttcatagtctagaaattctcacattaatcggagaaaaaaaatgagtccatatagaaatacaattttaaaatagctaaaatttggaattgaaaataaggaatataggaagagaagactagaatccatatcaatatacaatagaactaatggaaattcgaaattaaaaaaataataaaattaaaagtatatgttagagtccatacagaaatacaatttagaaataaagaaaattcgaaattaaaaaaaaggagtattgaaagaagaatacagagtccatatagaaatacaatttaaaaataactgaaattcagaattataaaaaaataaatattgaaagataagtttagagtcgatatagaaatacaatttagaaataatagaaattaggaattacaataaggaatattggaagaagagtacagagtcaatataggaatttagaagtaattaaaatttggaaaaaaataataagtagagtttagagaacacattgaaataccatttacaaataactaaaattagaaatttaaaaaggaacattggaacaatagtctgtataggaattcaatttagaagtaattgaaattccaaatttaaataacactgaaagatgagtttagagtccatatagaaacacaattagaaatatcaaaattcaaaattttaaaaaaagcaacattagaagaagagtttagagtccatataaaatacaatttataaataacagaaatttggaattgaaaaataagaaatattggtaaaggagtctagagatcatataggagtataatttagaaattttgaatttcaaataagaaatatagggataaaatttataaattatagaaattcataattaaaaaaataaaaaatgttggaagagaagtcaaaagtccatatagaaatgtaaattagaaataacaaaaaattgatattaaaaataattaataactatcatgtatatacaacacaatatgaagtttggttaagttagtgaaaaatttaaattatgttgctattttaagatattttaataataaaataagaaaaaatatatcgtattatatgagagaaaacatcaggatgctagccgtgcaatt

SEQ ID NO: 30271 - DNA, 710 bp, Oryza sativa
gaccaactctctcgcttcactttgtctcattttctctagaatctctagaaaaaggaataaaaacgaaaatactcggaattagagcctaattaagataggatgactaatgtatgcagcctaatgaggagtaattctataaaaataaagaactctatttcagaacgtagattgatttagatttaggtaatctatagatatagataagcaaagtaatatatttcaaccaaagtaggaatttgcaagatggagaacatcttgcagttgatttgatagaaattcatttttcttttcctgtctctataattttcgatgaatgagcctctggtaatctttttatctctattttatggcgcagacgcctgtccagtctataaacaagtactaatagagaaatgaaaactatactaaaggaaacgtaggatatctctcctaaaatctaaaaaaggacatattagggctatacggattcgaaccgtagaccttctcggtaaaacagatcaaacggattattatcgaaatgattcaaactgtttcaaagacccaacatgcattcttttgcattgggctcttttatcaactgatagaaagatcagttagtacaccatagtttttctttacggaaagataatgagatggctccctgcgctctgattgattatttgtattatgatctatctaagagcaataccaaagtgtttcaaaggaggtga

SEQ ID NO: 30272 - DNA, 607 bp, Oryza sativa
  unsure (1)..(607): unsure at all n locations
agcncatcatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgcattctactgcaacagttgtactggaatgatgaataccttgagcaggtagaaatagaaaaaaagaattttgctaaaatggaaaaaggctttctttctaaaagaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacacaggaaaactacaaacaaaaatagtgaaaattagctcgtaggaacccatcagatcgttatagacccaacgaattagtagttcccaaccgcgggtggagtgaaatccaacaaaaaaatcagtaactaaaagaataaaaaaaagcttttactgagtcatttaagttatagaagattcctgaacccaaggattcaaaataa

SEQ ID NO: 30273 - DNA, 677 bp, Oryza sativa
ggcttcggaatagtagaataattcggaatagggctcaagatctttgggaaaatctaagttaatgatcaacaagtttggataaagaatttaggaaagatattcttatactggcacaatacaaagagaagtagatgcgaaagctatcccttcggatccaacctttcccttaaagaatttaattggttagcataatataatatctaataaatggaaaatcaaatagtagataatctgttatgaaagagagaaaacattctttgaagaatcaagattggtaatcaacccttggctttgttactaactttcttgaccaaaactgcaagcgtgaacttggccagttcttaggtttccgaaatagtgtaatggaaaaagagtgcttcgaatcgactttgattggggttcgaaaaaggaataaaaaaaaagtaaattcaggaaagatttcctttttttaggagaccctcaaggggtcgtggaatgcttttcttctcctcttattccatatggaatacaatcaattaaaataagaaggataggggaatattcgactgttcgctccaaaaagaaggttaaatcatcctattgaaaaagaccaaaatagaaagaactttttcaaattcaattctttatttttcactggggttagctgatctagttcttaatattttacttactcaatt

SEQ ID NO: 30274 - DNA, 397 bp, Oryza sativa
aatatggtgatcgccccggctatagcggtaatcgccccacctatagttatagtacccaaattctatcttgaacttcctattttttaaacaaaaatacaacgttttttatttgaaaataaaaaaagaaaaataggagaaaaaaatatgacagaaaagaaaaataggagagaaaaaaaaacccgagagaagcaaaaattactttcgagggtttagttatggaagccctacccaacggaatgttccgtgttcgcctagagaatgacaccatcatactgggctatattttatgaaagatccggtctagttctatacgaatactgatgggggatagggtcaaaattgaagtaagtcgttatgattcaagcaaggggcgtataatttatagacttccccataa

SEQ ID NO: 30275 - DNA, 910 bp, Oryza sativa
ttttccagttagtccataaggatcagacacccatatcccagggccatacaaacccgttacatgaaatgcgccaaagccaaagcaagccacccctgcaagaaataaatgaattccaaagatcttgggcaaatccaaagaaggttttcccgtccgctcatcacagaatatttcgaggtcccaatatacccaatgccagatagctgccaagaaacacaagccagaaaacacaatatgcgcccctgccacgccttcataactccaaatacccggattcgttacagttcctcctgaaatactccaaccaccccacgaattggttattcctaaacgagtcatgaaaggaatgacgaacataccttgtctccacattggatccagaacaggatcagagggatcaaaaactgctaattcgtataaagccatcgagccagcccaaccagaaactagagctgtgtgcattatatgcaccgaaagcaatcgacccggatcattcaatacgacagtatgaacacgataccaaggcaaacccatggaaatactcctttagcaaagaaaaatagacacgatgtcactttattttatcgcattggcaaagactatccatatcctatgtacctaacccttctaggggattctgtgtcagaaagcgtgaatatttatttcattccattaaaaataagaagccaattctgttcgtaagaagaaagagaagcagatctattctatactcgataagtgccaatatgcaatgggcagcttggcttatttggaaaaaacgaagaatagatccctatctctttttgattagtattcgaatcacccattcttttttctttattcaatctgtcttatactacttatatgaataatctttcaatctatgtattatttcaatctacgtattaataga

SEQ ID NO: 30276 - DNA, 1393 bp, Oryza sativa
  unsure (1)..(1393): unsure at all n locations
tgaaatgaaagaaagggctccggtgtatagagagggcctcgccgtttaaaagggacccatagaaccgatggaacccactattttttagtattgtgcgaaataactaaaggaagtagaagagaaaattgtggttgggaaggttatagtagcaaaagccattggaactaatattttatatatgggaataattcgttttgttattaatgggaaaaaggatggctaaaagaagagaaatcattagttattcattaaggttaatttgattcaatgaccagagttccgtgaggatatatagctcggagacgacgggcaaaaatgcgttcatttgcctcaaactttagaggggctcatttaagacttaatcgaatgattactcaacaggtaagaagagcgtttgtttcctctcatcgagatagagtcaggcaaaagagggattttcggcgtttgtggatcagtcagataaacgcagcaacgcggatacataaagtattcgataattatagtaaattaatacgcaatctttacaagaaagaattgattcttaatcgtaaaatccttgcacaagtagctgtattaaatccaaataatctttacncgatttccaataaaataaagattatcaattaaagggataaaaaagtaatatacaggaataattaaaaaagaattcccggagaggtaactccgggaagatacaataaattaagatttattggtaggaatcaacgagcatgttgcaataaataaaaaaactattttttcttccccattgttctttcttataacaaacccaagaatctaaattggattactttctttatatatagtctggccctttcgaataaaacatcaacaatcggaacttaagttccgattggtgtttcttaaagtctggttggagtttcttaagtttcgattggaattgaacttttgtgttaatggaggaatatgtctattttttctgggtctaggacctgtaattattgaaattgactgggcttgaaattgtttctcattctcatagttacgaaatggtaagaaagataaaatacgagcctgttttatagcaagagtaattaatcgttgttgtttcaaggttaatctatttattcgtctcgataatatttttccttgttcactaataaatcgattaattaaactcatgtttctataatcaattcgatcccccgggccaatccgaggatgcctacgaaaaggttgtttgggtttgcgaaaaggttgtttgaatttacgaaaagtttgcttggatttacgaaaagtttgcttggatttatgaaaagtttgtttggatttatgaaagggttgtttagatgtatacatgatttattccttattttaaaattgaaaaaaaaatgatttgtttattttatta

SEQ ID NO: 30277 - DNA, 20083 bp, Oryza sativa
  unsure (1)..(20083): unsure at all n locations
tgttgtgcatgtgagacaagagatggttagcagtagaaaagaacacaaggatactttctctaatgcagaatcagcaaacaatcatttcttggatgctaacagaactttgcatacatgcatggagaaatctcttccaagctccattatatatatattgatccaagttctaactgacaattccctcttattagtttctgttgtaatgagaataagtatatcaaaatatcatggcctcctggaaattaaaagaaaaaaaaattaaaacaggggtaccataatgttgcaagagctaaattctacattaataaatgaggcatcttaatttgattggtgactaattaggacgtttgtttgcaacatactccctccgtcccaaaataaatcaactcctgtaattcgaactttgtcctaaaataaatcaacttctacctttctcatccactcttggttagcaaatcgaaaaattttattccttcaataccacttatctacctatcgaccaatactaatatgctattaataagggatattttggttatttatctacctctttaattttatattgggaagttaggagttgcttttttattggacagagggagtatactaatatgtttgattggttatgcctagctagcagcaggctagatatagatactagctagtagtacctactgaataactaccaaaggcatgtttagttcgcgaaaagaaaatttttagatgttatatcgaacgtttaaccagatattagaaggggtttttagacacgaatggaaaaattaatttcataactcgcctggaaaccgtgagacgaatcttttgagcctaattaatccgtcattagcacatataggttactgtagcaattatgactaattatggactaattagtctcaaaagattcgtctaacgatttcccctctaattgtgcaattaagtttttatttttatctatatttaatgctccatgtatgaatctaaagattcgatatgatgtttttgggaaaaacttgttggaaactaaacggagcctaatcattgtgcacatcgcataatatcactacatgatcgatactccggaatagtagtaagattattctttgttgccacaggaattaagttgagacctatagttagctcacaagatatgatcgattgacagggtacagttataacgacaaccggtagcttgcctgttgttaattggaggtttgttaagggaagaggtcctattctcgcaacccgtattattgatcacagcaaaaaaaaaagaaaaaaaagaagaagaagtacatattgtcatgcactaatgccgcagattcgcatgtccctagagtgcctatcattatttctggtgttatatggagtatatatgctaacaacactattgctatcattgacagcccccatcagtatgatcgaggagggtgtgtgatcagtgatcacactaacaaacaattttatgtgatgtattatctcaaacatgtacacctaactctcaaggcattcctgtgctatatagcttgaacatacaccaaattatatgcatgcatgctacaattcgaagacaaccaacaaaaagaaattatcatgtattcatgtgtaaagcgcgctagctatagctttatatctttgaatccatctatctcacacctaaaaacacatgatgactacatgatagtagaagagaagaaacaatagagcgtcgaggaaaccaaatatcactttccttggcacttaaattaattaactagctactttcctacttgcttaattaattagtagcaggtacaataggaggctataagccagctataaacatattttaaagagataaaggaagagagagaatagtaacgggctacagatctgtagtcaactgcagcatagactccaagacgtaatgtgtgtatgacaagtgggaccagataatagtatagtgagtaactattgtatgaattgactattacattggttataaatgatttagagttagcagtgggctatacaattaaatttgctctaagcgacgttaattagaaatcagaacgtcagggtcgacgtcgtacgtcgtggttttacccgacaagcatatcgataagcatctgcgtaatctgctaaagtaatggggaggcagaggctccgaatgatgcttagctacgctttcggccaaaaacgctgcgctttggccttagtttattgccggtcaaatctccccatgatcccctaaacccatcctcgatctcctccattatcgtcttcttgcccacacacgcagcagcttaattagtttataatctctctttcttctgttaatcttctataagggttttgagagagatcgagcagtgattcatgcatcggacatttcctcgtgcccactatctagggtttccgcgcagccagtactacactatagctagctatgtatagcgctagcctttgccggaatgccattgattggctggatgggctggatgtgttggaagaagcttcaaaggttttaaaaaatggtgaggcctacaggggttagggtttgattgatttcgtgggaagattccaacagaaaggtgcatgatcatggacgtttttcaggaatggggcttctcatttgtgtgaaacttaacattacacacatcagaacttcataagtgcatgcattgccatcaatatatatactatcaatcagtgcgttaacacacggtgcatttcgcatctacagcggtaatgcacaataaatcatgtgctcatcgatgagttgtaacttgtaactagagctactagcaatcttgcagttcttcaacatcttgacatcttgtacggttgtaccatggggttatacagcaaattaatggatcggatgggcaatgaaaaggaaaggtagctagtagctaggagaaggagatcataaccagcatgggggttgtcagcgacggcgtgatgattgctccggccgccggcgactcgccggtcgccgtcgccggtgaaggaaggagaggacgaaagggagaggcatcatcgatcggggttgggttgtcgtcaaaaggcgagcaaagagggacagcgcgccgacatgccaactgccccccaaccccgcgtcctcccgcaccacgccgcgacccgccgggtgcctacctctagtgacagacaagtggggcccacgtgatggtgcgggtcacttgtcagtgggtgggggattgaggtggcaggggagcgctgggtaggggatctcgtcgtcgatccctgtcctttgtcttctcttgtactgcagccttgtttgttcctgggttttccgttgtaccccctctgagtttctgtatttgcaatttcatatatgggtgtgtttagtacgtacaaaaattggaagtttggttgaaattagaacgatgtgacggaaaattaaaagtttgtgtgtgtagaaaaattttgatgtgatgaaaaaattgaaagttagaaaaaaaatttggaactaaactcggcctatatatacaagcagcatgatttgatttgattattatagttgtagtaatgtttatgcagtgtcatgcaccaatgcattgcccatctctagctcgaatggttaggcaaaatggctcaggtagtacttaaccgtcacactatttataatgcaaatgtttgattttttttttcaatcatacatatagaaaattaattgaaaatgaatacacgagaaatctatcggtataattttaaataaaatacttacatagtgatttaagattgtaaaacttgactacactactggttgaaccattactacatgagtaattaagtattaattattttaatcgtaaaaatagattaatatgatttttaaacaactctattatagaaacattttttataaaaaaatacagtgttctgcggctcgaaatgtgagcacgcaaaaaatgggaattctctcacatacgttgctcactaagatggtgtttgaaactggtgaagatgaagattaagttagcgcacgtaaaacgagaaaatcattagcacacgactaattaatttttaattattacaaacttgacaaatgtatatatttgatattttaaaacaacttctatatagaaagttttcgcacgaaacacactgtttatttatagtttaaaaaacatgctaacggaaaccatggtaaattctgaatcttttacgctgaccactgatgtagagagctgacaaaatttttaagcagcaagcactctgtcttagggcctgtttagttcccaaacaaaaattttcacgctgtcacattaaatgtttggacacatatatggagtattaaatgtagacaaaaaataattacatggttcgttaggaaattacgagatgaatcttttaagcctaattacgccatgatttgacaatatggtgctacagtaaacatttgctaatgacggattaattaggcttaataaattcgtctcgcagtttcctggcaggatctgtaatttgttttgttattagactatggctatgtttagttcccttcaaacttccaatttttccgtcacatcaaatgtttggatatatgcatggagcattaaatgtggacgaaaaaaacaattgtacagtttgcatgtaaattacgagacgaatcttttgagcttaattacgccatgatttgacaatgtggtgctacagtaaatatttgttaatgatggattaattagacttaatagattcgtctcgcagtttacaggcgaaatttgtactttgttttgttattagtttacgtttaatacttcaaatgtgtgtctgtatacgtcaattttttttaccaaaacaactaaacatggcctatgtttaatacttcaaatgtgtattcatatgtccaatgtgtcatgtagggattttttttttttttgccaaaatatgtttggttttatgggaccaaaggagtactgtggaattctccgcacccacgaggaccttaaaccaaaaaccgtccacacgcgcgcggcgcgcgccgaaccgaggacgaggcaacacagcaggtagcgcgcggtgggccccacccccaccccccgaccgtgcgcatgtttataggcagcatccgngcgggcaccaccacccaccaccacacccctcgtttgcgcaaactcgacgcgccacccgacagcgaccccgcagccgatccatcccgccgccgaagcagcagcaaccgccacggtgcgccgccgccgccggtaccgatgtcgacgagctccggcgccgactcgtccccgcccgtctcgggcctagactacgacgaacaccgacctcaccctcgcccttcccggctcctcctcctcctcctcctccaccggcgaccccgaacgcaagcgcgccgcccacgccgaccacgccgacgccaagccgccttccccaaagtacgtatagcttatgctctctttatggagattcctacgttcccgcgggtttctgacctggcgatcgatcgatgcgtgtgcgcagggcgcggccggtggggtggccgccggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagtaagcaacgcgtgtacacatctcaatcagttcttgccgattaattcaccgaaatcaaatgcaaaatctgatccgatcaatcaacacaggatgttcgtcgagtcctgcaagcggatccgtctcatgaagagctccgaggccgtcaacttatgtaagaacttgcgatccaatccactataataatccaataacattacattaccaactatactaattactgcaacgatcgatgagtgaatgacatttcgattctgaattttttgatgcagcgccaagacgatcatccagataatcgatcctaccacacgcaacgatgcaatgccgcaattgatctgtctgtctgtctgtctgtctgaattagttcgtctgaaagtgtgtgcaatggaagaggcttggctgtacaggtcctccatgcatatgtacctataccgtagtaggatcagtgatcgatgagccaaattggtgtgtgtactgtacaggccacaagaacgaaaatatcctctctctttaattcaggtgtgctccctgctgccggatcacggccggcccggtttggtttttggacgacggcggcgaggatcgatccaagggaggcgccgccacgccgccgcggcggtgtactttaattttcaagttgtcagctactttctgtaatttgtttcatgatggttcggtttcctgtgacagccagcacttttgttgtatgtcaaatgcaatgtatacatgatataccggttgttatcgttgttgttgctgttgttgactttgttctgtccattgatgcattgcaaggtcaaatataggagcacaataatctgtcatttctgtcaggcttttgatgtctccttttgcccatttctttcgatttggtggtgctgaatgttgttcttttggttggaaaattgcgagcttggttaggtagatggtggtgattgcggctgtggaaatcattggcagtgggaataaccaatccatttttgcgcatggacaaattcatccactgaagagagccagtgcagaatctgaacccaaaaagggaacaatccacgaatgcacgaactgatcattgaactaggcagctagcggttgcagtccataaccagcattttctcacggctgggaagaaatctactgcctctctaatctgaaatactggcctgttcacgtgaattgtgatctgttgatgcatgataatctgtggcccgatcaggccgcctgcaaattcagtttctgcacatattagttgatgctcaatcgctacaacgagtactgttgggttaaatctattgatgatgacggtattttatataggtccgacacagataactgctatcggtgacggtatctgacctgacacagataacttttcacatcactgaccaataatacgtgacgtagcctccctccgacacagatgatggttcctgcctcacacatatgtcctgttttgcactaatgagtgtacacagaatactgtataccaaattcaggtagtccacacactaccgcatagacaaccccattctgagcatgtttacacttgcggttgcccaaatatacatgtcagtactagcagtgacatcctgacagcatgtcagaccgcttgctctgcatgttactgtagttaaggaatcaaacttgcgatgcagcatatgcggaagtaaaattgccctggacggcaggacccctgtggtgatgatacatgcgctaagtatgtgtgcccatagtagatggtgtacaagaacccgtactgtttgggttatctgctgtcagttgagttggagaaattggatagataatacagcacgcgtgcatcccagagatgtggatgtgttaaaagaaaaaaaaactcgaagcttggctcgtcctagatggattcgagccacaaacgagtcaagctcaagcccaaactaaagctcgcgagctttgctgagacaagctcaaagtttataacgagctggcccaacctcatatatgctgtagataatagcccaccatagaaattaggaagcacactagcctaaggagaggaagaggcacacattcctgaaaaaatttccgtcgatttggcttccttccgtgtgatcactcatagctgttcgcctcatcgcctattccgtcgcccttccagccgcgttgtcttgttccgatggtgcgacctaacctacgcagcgtagctacgtctacgactgcgagccagagatacctatgcgcggctacgcgtcgacgacgtcgtgctctgcggcagccagcagccgattgcaagtctctccgtttagttccgggaggtatctaatttagaagaaattattagatgaaattgatattgatgccatagtgaatatgacttcgcatcagtaaacgttagaagaaaattttaaggtaagatatataactcatttaataagaattgtttttatgcattacatttattagaaatatcgttatattattatggttgtattaaaggaccttttttctagatttgctccagaccactaaattgaaatgaccgggcctggtaaacccaacgagttcaaatgaaactaaggatgatttacaaaatttaccagtgctatttgtgatttagcggaacgtgctaccggaactcccatcacgtgcaccctgatccctcgcagcactcacagctcgacacgtgtcccgcatcacgtgtcctccgcccgtccactgctttgcgccgacccagcaaaacagcgtgagacccgcacaccggatcacgcggcccacaaaaactaaccaccacatcctaatccagattagagagcgcgattagtctaaaccgcataataatttacagaaatgcccctcacctcccctttttattttattttttttctattttttttccgcagccacctccccttctcctctcttatcgcaccacgcgcactgttcacactccacagtatgttcgctgcgacgacgcagctccaaatcggaaccctaaccctagtagtcctcctcctcccgcgctcgatccgaggtcgtcatcccgctgattccgaggctctctactgcggcggcggcggcgatggaagagcataggcttggcggcgacggcgccggagccggaggcggggggaggccgccgatcccgggggcggcggggaggaagcttccggggctctcgcggcacgcctcgttcgtgagtaacccccgccctaatcttagctctttctcggcgttgtaaacttggttttggtgtggtttggttgggtgcttgctctgttcttcgctgggaaggcggcgaggtgtgatatatatatattttttttttggctgtggaggatttggggataatgtcggcatgatgtgatgggcgatggagtctaattcggggatgaggggagtgaggagaaggaatcttgggctctgaaattgccggtacatccttgttgtacttgggtagtacaccaacctggggcgagatgtttggatccgtgcggtttatgtggaagcagcgtattgggaaacattgccttgggttgtatgaaatggttggttttatcaaactgtacacagagtgtcctagaatgttttgcataaactatgttagtgctttgtactatcagtgtattttggcggcctgtattcttttttgcagaatttggtggtgaatttgatgttttaactttgctaactcattaggtatttcttccttgaaaaattgaggcaacaatttttcagggcactgtaaaagtgaggggaaaggggatcagactggtaattttctgtatgtgtcatgaaagtgtcttaattcttttggtactttttgctcttgtcctgactacatggacccataacatcattgaaaagaaataaattgaaaggtacttcgatgtctctgctcaacagtaattgcccatttaagttgtccacagtcaaaaacagcaaagctgttctaaatgatattctgtactccttccagtttcaaaattcttgaccttttagacataatctcacataccaaggagtgatttattagggtgcctaatccttgttttgcccatattaaatacggtcttgtcctaatagaaatcagaaactcgtgctgttccaagtggtttgggcctatcattagcgtctgtgcatgccgggttcgagttctattgaggctattttttttaaaaaaaaatcatagcgttatcttggtaatttttggctcgctcgcgcttgctttagcacacaacggttgctacatcatcactgtcatcacacccgctctcaacgagcaagcggtcgccgagagcacggcgccagcaagcagcccaagaagccaacaagcgattaattaggagatgagacaacggcccgcgtgtgatgtttaatgacatacacgacgctagaaacaatgcgttggatttttatgcatgcatgcaggagcaagcaggtccaagatactttgcttcaagatctaaaacgtcaactattttgatactggagggagtaaggggttggcaaaagtggtaattgacttgatatcattgccttgctgattttggtttcaatctcgtcattctttccggtattgtttagattataacagtggatcctttagatctacactgcacattgttttttcaatagaagctagatatggtgatacacatagtatgcttccataacaaaatatatgcacttgcctgtccatttgtagttatgtacttgtctgacactgcatgttgcttggtaatttctagtagatcacattatttgagcaaggagggaaccattataatgtcacacttaattcacatgggaggggacaagaatagttgtttcatagttacaactaattgcaccgcttttgggcatgtggtagggcaaacttaactatagttagtatttgctataaaaattttctcttcaatccttgcaattaaatcattttaattgggcatccacggacgagcctaggcagccattgggccatggatcagccagtgagtatgagtgatattcactttcggaagaaccgaatgtattccctctgtcccaaattataatagatatattttttacacaatctttaataacatactttgatcattaatttatttcatattatgtcatcaacaactataaaattattatcacatgaaaatgttttaaaatatgaatctaatgatataacatacataatacttggtgtagatattgttagtgtaattattagtcaaaagttaccgagtttgatttttctaaaaataagagtgctctacaatttgggacagagggagtatatgacagtgcaatttttgtttttgccttttgttggatcaacattgttaatatatgtatgagataatctggaaaccctttttgggtcatggtagtgcaacttcaaaatgaaagagcatacaacatagattctgtgcagtatggttaattatttttttgtcatgcttggcattggttttgcaggtgaggagtcctgcaaacagtacaaaatctggaactgagaaaacttttgaaaacatggatgctgttgcatatatgcctgttgtaaggtctggaggttgggctgatattgggtcaaggcacacaatggaggatgtctttatttgttctgataacctcatgaaagagtttggagttgaaagttttgaagatggtccgagcgcattttatggggtatgcttttattctactgtattcaaggcccagacttgtttcttgatgtatgcgatatatgttagccatttcatgactagactaacaataacaactttcctttatgagtaatttcatgcccctggcaggcattttatttatatatacccttcatatgattttaatgtcttaggtttttgatgggcatggtggaaagcacgctgctgactttgtgtgcagcaatttggcaaggtttatcgttgaggatgaggattttccaagggagatagagaaagctctgtcctcagcgttcttacagactgatgctgctttcgcagatgcttgttctgtgaactcctctcttgcttctggcacaactgctcttgctgctcttgtggttgggaggtattggcctaacttcttaaactgtaaagtgttgtactgactactgagttcctggcagcatatctgtttaactactatttgatgattgtcattacttattaatggtaggagccattccccacccccaccctgttatggccatgcagttcctgtttcgttgcctgtggccttgtgcaaattataagtcttcagtgcactcaattgtgcatgaacagacaggggcttcaaaacttatttctctcatgaatagacagcattgattcttgatctttgtttctttgcaatcgtgtgaagtgcatctatagcctttctattttgactatcttgtcggccacggttaatatcagcgtgctttagcctattgcatgctacagtattctctttcatgaaagcaattatatagtataaattttggtacccaaaaatgggactgtgtgcccccttttatagtccattatgtagttctcctttctgtctatttcagtctctgctttctgtcttgctatgatctctgagagaattatgcttccacttgggataaccaactttcttgtcttaaccgttttgccatttttcataggtcacttctggtagcaaatgctggtgattgtagagcagtactttgttgtcgtggaaaagccattgaaatgtccagggatcacaagccttcttgcaacagagagaaggttcgcattgaagcctctggtggttatgtttatgatggctacctgaatgggcagcttaatgttgcgcgggcaataggagactggcacatggaaggaatgaaggcatgtgatggtcttggacctcttagtgctgagcctgaggtgatgatcaggaatctcactgaggaggatgaattcctcatcatcggttgtgatgggatctgggacgtattccgcagccaaaatgcggtagactttgcacgccgaaagctccaggagcacaatgatcctgttacctgttgtaaagaacttgttgatgaggccatcaagaggaagagcggcgacaacctttctgttgttgtcatctgcttcaactctcggccgcctcctgtcctaacaactccaaggcctcgtgtacagaggagtatatctgcagaaggcctgagggagttgcaaagctttcttgatagcttggctgattgacatgaggcttcttccttgatagaagcctgacatactgtcgctagtgtacttccattgcttagcatggaatttttaggtttagtgcggctattccaaggcttaatgccagctatctcacaaattctctgagatagcagctgttgagtgattctggtgttgtaatgtattatgcggctaattctatctgcagtttaagtatttattggttcagggatatgctgtcttaaagagtctggaattatcagggaacatttctaagatatctgaaatggcgagtgatgttgtctattgactgtattgcaaattttgacatactatgggaacaaatgcatgtttatttactgtggttggagcacagtgattctgtagtgtctgcagtgtggtgctctgaacttgtatggtcagtcttgcacttgggtaagatcagttacacagtgactgtgccagaagaaactctagctccacagtccacactacagtcaatgtgacctcagatggttccaacagcatgttttttagtatgttctccccatgacatcaggtgcagtagaagctgaagctctgcatgtgcactctgccatccctgcttctgaatctgaagacggagaccagcaacgatgaggaggtgatgtcgaagacgtgcgaatccatctactactcccatcagcagctgttgtcggatgatgaagcctctcgccattatgaacgctctagccatcagcaatctgatcctgatatcactacctctgaaactggagtagtaggagaaaagaaaagctggagaacaaccaatcaatcattcatgtgtcctgcgatggaaatccagatcggcgaatggctctctgaagattgtttttcgattcagattttttttattgaactatacggagatcagtgatcaatccctctagcttcgctgaaacgaatccacctactctctctctctctctctctctctctctctctctatatatatatatatatatatatagcgataaatcactagtcacgctaaaatgaaatgaatacactcctaaaacatgctcaaagagactatggacaaaggataaatcctgatctcgctacgctagtgcatacataattttcgtgaacatcagaatttatattctaatagatagaattatgcaccgccacatcatctgtgcttcctgcttctctctgaatattagtggcatactggcatcgtaggatcaatcaggctctacccactccctcgctttatcgtgagaacttgcagcttttgctggcccataatcgcaaagagatcgatgctggcccattgcaaatggcagccggggcccctgcctcagtcactcagggcctaggtcactctacttcggctacagttggatgatctgttctctctttttacctttggagatttattatggtgttggtgtgggtcactgggtgctctgacactccaacatctatgctccatgttgggacatttcactttgtcctgtagctctagctagtaactaatctagatttgtagcttgtttccccgaaaaaaaagaaaaatgtagcttgtttaggacttccctaaagaacatcaagcaccctcaaaatgtgttttgagatttaggtaaaaaatggtagggttacattgggttcatgtcatctaagtaaattaaccatattcagatgctaagggctagtttggttctctacctaccaattcactaccaattcattggtagtgtaaaaacccatgtaaattttggcactatcaattactcctagttggagggtagaattctcaatttgtttggatttagattgctaccaaaaatgccaaatctaactagagtataaaagaaggtttggattgctaccaaactgagcttgggtatagccaacgatttggctccaattcaaacgtacatgattactattcaagctatcaaatgctactatttggtagggcaacaaaccaaaatgaccccaagtttgccttttaccaccgtcacccactcctctcacctgaggttatgtttgaaacacagtaattttgtacacaacaatctgattatgttagaaccgcaaccaagtgtttgcaattttgataatttcgctccccaccggcaagcacatatcgtgcctgaaatttccgttttttttctatttttttgtgaatttggtcaaagtttattcaaattcattcaaaatctattatatactaaaagtccattaaacttcctacaaacgctctcaagttgccacgtggcgctctaataaattagagaaaatcctagaaattctaagaaaaaagcaaaacatctacccttgattttcacttaaattagtgggtccaatattatacaccgttagataaaattgatcttaaaacaaaccaaataatatgggtcccacctctcctttttctcccgcgtgcataggtataggtcacgtacgtacatgcatgtggacctgttgttcgtacgcctccctccatttttttcctttttttcttcttttttccatttatacaatttgatatatatttgtttaaataataataatttagaaaaaaagaaaataccatcatataactctttataaacacaggtaactaaattagctatgcagactttgaaaataaaatttacaccatattatatgttaattagctctaaaatcaataatgtaagataatttactaaatactattattttcatataatgcactattttaaaataaagcttacacaatattatattgtgtacctatcaaataaacaatttaagatctatattaactaatatatacatgtacttaaacagatagacccattatttaaatcatcggatctattttttattactttggattattattctcaaataattcagtgttttaaaataaaatctacaccatcaccataatgttgtgtacccattaaattaacaatttaatatatatatatatatatatatatatatatatatatatatatatatacacacatatatattaactaagttacatttacactaaaaccggtggacccattatttaaatcatcggatctattgttaataatgtctaaagttctctttttggcccactccacaatgcacatctgcacctttgcctttcgcacatgtgacagagtgtcgtgtttgaggcatcttgggtgatcacgaccgctgcagtgctaccgttgttattaatagcatgaaaataaaattaaagatgtgatgtagcgagagaagaattaagtaccgtggaacacttaactctgtttaagctgaaatcgagagttgattaaataataattataatgtattgtgttatgttgtatttgcattttgtattatttgttcgtacagttgaaagaaatcattatgttataattgtgagcacaatattaacgaatatcaacagaactcttactaggataagagtgttataagggagtttaaggccctattttttccctgattccatcttttgaattttcgtttgcacgctccatgctttcaaagttactaaatggtgcttttcttaaacaactttttaacttttcagaagtcaattcattcgtttataatctcaaatagctatcacataaatcagataattcatcaatttcagttgtcatatcccctaaagtacatatttttttcatgcgagtcatggtgataagtaaattggtgatcaacgcataatcaaagtcataagataaatctgttagaacaactatgaccaattgtaaataggtgtcaaaattaattgctattaattaaacaactaatggcttgctagcaacatatttaatttttctctacatgtatataaacatggacgaagctaaaacgaatatgaacatacatcccatacatatatatattacatcttaatattctaattacatgtggtaagtccactaaaatttcttaaaatgccctcaagatgtcacgtggtgctctaataaattagagaaaatattagaaattctaagaaaaaaagcaaagtatctattacttgattttcacttgaatcgatgggtccaatattataaaccattagattaaattgatcttagaacaaactaaatactacgaggtcccacctctccacctttggtacgcacctacgtacgtgggtacctacgcttccccacccttttttttttatttttccctttcttctttttctccatgaatatgcttccctccctttcttactatatcatgcaccttcacgagacgatttaatctatttacttaagaaaaaaatatgattcaaaagtcgtaagtacttaatccatctcccactcaaaagcttgcgaatggacttttaagataccttaacaaaaaaaatagaacccttaaattattacaaaataacagtatccgaactttagtttgcccttaatctatgtgataatttttttaacaaacaataaaaatcttacctttcaataatatatgtgcccgcgcatacgcgctggccaccttcctagttcataaaaaaaattaaaaagaaccgaccaaaaataccgaaaattctgaaatttaggttcttttagcccccaccggcaaaaacctttgtttcaaaattgcaaaccctgccggaagctccccgttctaaaaaagatataagtttaaaccttaaagtaaggcgtgtgagaagcacaactctcattaccacctactcccttccctccgtaccataaaaaatcaacttatggagatgaacctagacaaatatttgtccaaattcatccttagaagttatctttttttggatggagggtgtatatgatttgcgtattcacggactaaccacgaaactttgaacggcgaaattgatatttctctcttctcaatcattgatctacactatggctagatgccacaccacaagctcttgagtgaacaccaagcattgacattttcccttgttgcaccatatgtgggactcaagtcactcaactccaagggacccatctccaccactaaaaactgccaactcccctgcatgacaccacacatcacggcccaagaaatttctccatcagccattgccatcacatcgctggccgttaactgcatccctgcaagcaaaagccatcccttctctctccattggattcttgcttctactactccacgaaggaccaaattaaatcaattcacacactgtctatctctctgaagcagcctggtactactagcagcgatatgattagatcctgggccttagtttgtcgatcgtctgaatttttttcacagtagctcagctgcaggcatttgcaacttcagtaaattaatggcagcagaggtagtagttactgtagttaactctgatggtttcgtcgacggcaacgacgtcgacgcaggaggacgaaaaggactagacctgggcaggcaggcaaccttgccgtgcccgccattgtcgaccatagtgggggtggtggcccagctagcaaaagccccatcttggatgcagtctcggatggctgctagcctgctacacgtagacaccaccacatcatcttcgccaactatgcgctgttgcaaactactcgctttcaaattacttatcgttttagctttgtcatatgttaaacattcataactttaaatattgatatatatatatatatatatataattcactgagaaatgttttcttaacgatgttaaactatatgagttctataaattaatggtcgaagttaaaaatgtttgattcgagataaatctaaaacgataagtagattgaaacggatggagtagtgccaagaattcagagataagccagtgctggtaaaatatgtgtataggtgttgtactgctactagttggttgagcacttctgagctttgcaattgcgccctggagctggagcagtatcttatcagaatcagcagcaatggcgccatcgctttccttagtggaaacatcaggtttttcaggtcacaggcatgtaaacaaagaacaatatatactttcttttccatggtttaaccatcaggcaagagtggcaagcggccatgcatgcgtctagtagcagctagtttgatcaaaagctcaaaagcaattctgctttgtgggggacgcgttgttcagagttcagagcagtgaaggtgatggaggagacctcaatggagggccggcctcctttggtccatgcgtccatgtctccatagggtaccatggctaacaccatattatatgagtgacagtggtatcatcaacaggacatcttatgttctcaaccctcaaacatcgagaaagagattagaggacatggaggtcttagctagcacgcatcataatgcaggtatgtgttagaattggtgttgagtatatgagttgtagtagattattattggagctcaaattgtattatttgtaagtttagggtagtaaacgaacttccatctaaaatttagggatgtatttgaactttttcctacaaacaaatatcatagttttgattgcatcatttgatatcttaacagatcaataactatacagtagggagactgtttgatccacaatttcacaacaacgtggagtaggaaaaaaaatcgatttagggcttcttgatacgaaaaaatgatggaatatgagaaacacgtgaatttggtaaagatggtgtttgattacttcatacgaacacaatacacgggatctagccaagtgtcttataagaaggatagagccgtaataatggcagccacaagaattttgaatggaatacttcatttgaacatataaaaaaagagagataaagagccaagttgtatttgacttatcaaagaaaatgtaaaacacgagcttttatcaaatgtatgtttgaaatactaaaaagcggaggaaagaaagaaatcctacatgaatttttgaaatatatccctacaacctaaaagggcttcatagtaatttttccaacaggttttcaatcctttgaaactcctaaaatttcattgtttccagagaagacctttaaatattgtatacataatattttttaaaaaagggttcatggaaggtattgtgaggtagagatacgtacattgaaaatgtcaagcttgaaaatacttattttagaagatttg

SEQ ID NO: 30278 - DNA, 9824 bp, Oryza sativa
  unsure (1)..(9824): unsure at all n locations
aatgatgaggacgagcaagatttggatcatgggagaataatcataaattctctctgccatggcattgaagctttgctatgatttgcatgcttggtttgatctttctggtgggccagattggccgtgcaaaggacatcatctccatgaatgcactggaaagttttgagctcttgtgagtaaataacttatttttagttctgacgaagaatcaaaagatttttgagacaaatgcttttggttacatatctaaggagcttcaataatcaatcagattacccagacattggtggagtattgtatagcacactatagctagtgcttggtctactcatctgcataagagcaagtttaatagtatagcgaactactaattctaaatcatctgtagccaatttaatagccaattcatacaatagttgtttactgtactattaatacctggtcccacccatcatacacacgttgcatcttgaagtctgtgctgcagcgggctacagatctatagcccgctgctcttctctctcatcttttatctttttagaatatgtttatagctggctaatagtctgctattgtacctgctctaacggtgcgattttggtgnatttgtttagctggcatctcatatgaaataattgtcattaattgtcaatatgtataattttctattacatagaagattatgcacatatacacacagcattacatgctcgtacatcttatgacacacacctgaatgcatccttaacacatgctcgaagagatagagtccaacaacaaatatgtaaactcattaatttttatgcaaagcacatctacatcagtagacaccgtaatttaaaatcctaacgagcccaccacttcatcaccttacactagaggagaagtgagcttttgtaccggttagtaacccctttttaccggttctagcaaccggagataaagtaaccgagactaaaatttttgatctttagcaccggttgaaataaccggtactaaatatgcatacgaaataaaaaatgagggttgtggaattcgatctaaagatctctcacctcagctctcacgcgcataaccattccaccaactctacacatctaactaggatagaaatactttcttttatctaaccctggagacatcttttgtatatttagtccggttggtgttaccaaccggtactaaaaatattttaccaatcggaagcaaagatcctccagcattaatctggggactaaagatatatttttagtaccggttggtaataccaaccggaattaaaggtgtttttgtgactttgacttttagaactggtacttaaaaatatctttagtaccggttcttaatttaactgagatatttatgttttgggtaacgtgataaaagatcagttctccattagtgatataaatggtgctttcctaacatgtgcaatttttcctgtctcctaagtttgtacttcctctgtttcacaatgtaagtcattctagcatttcccacattcatattgatgttaatgaatccatatagatatatatgtctagattcattaacatcaatataaatatgggaaatactagaatgacttatattgtgaaacggagggagtaaaaagcatgtcacgattttgtgttaaacatgttaagcgatcaaatccggcaacacaacacaatgaatattgctatggacaatgattttaaggttgggtgtacactcaacaactacaaatatcctatttttagtgtttggtgggttagagttcaaagatttaaggtaattggctattggggtagaagtggtatgacgtaagaggctacgaggaatggatttgttagaggaaaagaaagtcaagactgaagtattatatccagtttgagtatatacacatgttacctacctacgtatattgaatttcgccgtaagttttctgggaaaaaaactttcaaatataactacaactatactaattcctatgtttttcatgcgctttatccaaacaacaattcctgcagtttcctatgttttttaatccataggatttaagatgttaattagggcatttggggaagcaccagtacacgaatattggacacatgtaggtgagttttcattatattttagtgagattaggaatgtgccgccggcttttgtctcgtagggtatgtgtttggtgggaaaatatcctaggcacactccatgcataccaactagcaaatgtcacgaatttttttttaaaaaaatagacatttactaaattctcatattcaaatccattatattttagccataaaaaaattgaaaatctaacaattttaaggataaaaatatgtcggattttttgactttttttacggataaaatagtaatgaatttgaagataagattttacatgtaggtgtaatactattggaagtatgtgtccaattttttctagaattttttgtgcatttgctagttgatgtacacggaaaacttgtatgcataggatatgttactgtgttaggtggtgtatttgcgagggtgtgagtgtagcgctacgtgtatagtggtgtgtctgcgtgtgcgtctatcatgcaaacagaaaaaaaaaaagatgttatggcatttcaatcatgtatttgttttccttgtttctgtgtgcttcagaatcttgagttccaaaaaaaagcccaagagtcttctcatgattatgacaacaaatcaaataaaaatctaacttgatcaaactcgctaaacattaagaaaaaagtacggcgaattctgaaaattaaataaacctaacagcctctgaaatagaaagatattttagctcaaagatagggaacaacactccaaaaatatttttggaaggatcgatgagaggttcaactgaaatgcatacgagaaagagataaagagtgaatccacgtagacatgacaggaaaagcatatctctctgaagttctgtcacgaccgagaactgaacgctgaacagtcaccgtatagtgtctgggtgtgtttagtcggggaaaaaggaaattttttgctgtcacatcgaacgtttgactggatgtcggaaggggtttttggacacggatgaaaaaactaattttagaattcgcctggaaaccgcgagacgaatcttttgagactaattaagccgtcattagcacatgtgggttactgtagcacttatgctaatcacggactaattaggcttaaaagattcgtctcgcgatttcctctataactgtgtaattagtttttttatctatatttaatgcttcatgcatgtgtccaaagatttgatgtgatgtttttgagaaaaaaatttggggaactaagcgggcccctagacgacctagaaaagctttggctcttttccttttgtttttgcacaaccccaaggctggctgcgtgtgttgatttgatttaggaccaaacttcctgggagcaagctccaaaatggaggacgacatgaacaaactaggttagcttcgcctttaccactttacataattacatgtagatgagcatgcagctcactcagcagttgggggcctggggctagttttttttgcatgcataaaacaagcatgggtcatatgggtgagtgaagtgagtgagtgagcagcatgcaggtggtacagagattgtagaggaggggatcagacgttggtgggccgaatcactccgcacgaactgaaaattattccaccatcaaaagaccccagtcaactcatcatcgacgctctcaactctagatgggctccctttctcgtacgcttgtcggggccacgggacagtgacaccctctggagcaaaatttgtacggcatcgatctgtggagcaaactttggagttaccacgcatttcggccgttggtaatccgatgcaagtttgggtcttgctatttgctactccctctatcgtaaaatataactagtggtaaccttaaatattaaagacagaatattaaagacagggataaaaaaactttgttgccttttcaaaataggtgaggcttaagtttaggccagtcacaatggaggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccgcgccacgcctcctttccgcgtgaacattcctccttcccgcgcgagcgattccaccatctcccccgtccggcgcctacggagtacaccgcaaccggtcgccccaatccggcgcctagaccgtgacccacccgccatcttccgcaagaccgaatccccaacccacccaccatcttccgccgcccccgtccccgtccccggccatggatccgtcgccggccgtggatccgtcgccggccgtggatccgtcgccggctgctgaaacccggcggcgtgcaaccgggaaaggaggcaaacagcgcgggggcaagcaactaggattgaagaggccgccgccgatttctgtcccggccaccccgcctcctgctgcgacgtcttcatcccctgctgcgccgacggccatcccaccacgaccaccgcaatcttcgccgattttcgtccccgattcgccgaatccgtcaccggctgcgccgacctcctctcttgcttcggggacatcgacggcaaggccaccgcaaccacaaggaggaggatggggaccaacatcgaccatttccccaaactttgcatctttctttggaaaccaacaagacccaaattcatggtacatgtattttcttctttttctgtactttcaacctacggtaactctaattcatggatgagactactgccattgtgcagttcaatgctttttcttcatgttatatttcgtccagctgtgagttatggtttgaagattgctgtggttgtttcattgctgagtatgtgaaagatagatggatgaaagagagaattatattttagtctgtaatcttgctcatccagttgctcatgtatgaccttggttctagaatgttgccctgactgtatgcttaatgttcagagaagtgatgcctaaagcagtgagatcagtgggatcagattagctatcgacatataatattagctatctcagttgtgaaagagagatgggtgaaaaggcaccccttggattaattctgtagtatcaaattctgcaccttgtctgtccatatgttctgcttggttggtgggtgcagtgcatttgtaaaaaatagtttgcttctgatccttaatatatgtaacagggaatgaattttcacccatctcagttgtaaaggtactgtcttgctatgcaatatgtgtaaattgacaaacctgaaaatagtctgtttggaatttgcaaaagcaattcgatagtttggaatttccaaacctcagtcagcagtaggcaatccattttagttcttgctatgcacaaaaacagtacacctgatatgctcattttaatacaacttttttgtctctgttacagtttggtcaggggttatcctccaggagggtttgtcaattttattcaacaaaattgtccgccgcagccacaacagcaaggtgaaaattttcatttcgttggtcacaatatgggattcaacccaatatctccacagccaccaagtgcctacggaacaccaacaccccaagctacgaaccaaggcacttcaacaaacattatgattgatgaagaggacaacaatgatacagtagggcagcaaagaaaagatggactcatgaagaggaagagagactggtattcatcggatacttttacatttccatatgtctttgttttgactaatacttgacaggtcattaactgattcttgtaggccagtgcttggttgaatgcttctaaagactcaattcatgggaatgataagaaaggtgatacattttggaaggaagtcactgatgaatttaacaagaaagggaatggaaaacgtaggagggaaattaaccaactgaaggttcactggtcaaggttgaagtcagcgatctctgagttcaatgactattggagtacggttactcaaatgcatacaagcggatactccgacgacatgcttgagaaagaggcacagaggctgtatgcaaacaggtttggaaatccttttgagaagatccattggtggaagatactcaaagatgagcccaaatggtgtgctcagtttaatccagacaaagccaagagcgagatgcattctgttccagaacagcagtcacgtcttattggtagagaagcagcaaagtctgagcgcaatggaaagcgcaagaaagaaaatgttatggaaggcattgtcctcctaggggacaatgtccagaaaattataaaggtccacgaagaccggagggtggatcgtgaaaaggccaccgaagctcagattcagatatcaaatgcaacattgttggccgctaaggagcagaaggaagcaaagatgttcgatgtgtacaatactctattaagtaaggatacaagcaacatgtctgaagatcaaatggctagccaccagagggcaatacggaaattagaggagaagctatttgcggattaaggtgagttttataaactgaccactattttctgaaatgtatgaattctgaaatttatatacaattgtgtaaacatggaaaattagataatgtatgcatgatgcacaacatgtgcgtgcagcactatttaatggcagtttcacaagtgtgaaaactgaccactatagtactattgtggtgtgaaaactgaccactactattgtggtgtgaatgctactgtggtgtgaaaactgaccactatagtttcacattcctggatgcagccctcctctatatatatagatacagtcctcatctcttcctggcatacacacagccctcttctctaattcctggacgcagtcctcatctcttcctggcatagacgcagcccttctctcttcctgtttagttcaacaacattgaggtgatctgcctttctttgaagtttctatcttttttcactgctgtgaatgattatttctctgctgtgaatgattatttctccaatcttcctttgttcaccttctctctttctctgctgtgaagatgtctggaaatgaaaatcagattcctgtgtccttgttggacgagtttctcgctgaggatgagatcatggatgagataatggatgatgttctccatgaaatgatggtgttattgcagtcctccatcggagatcttgaaagagaggctgctgaccatcgtttgcatccaaggaagcacatcaagaggccacgagaggaagcacatcaaaatttggtgaatgattatttctctgaaaatcctctatatccttccaatatttttcgccgaagatttcgtatgtacaggccgctgtttttacgtattgtggacgcattaggccagtggtcagattactttactcagagggtagatgccgctggtaggcaagggcttagtccattacaaaagtgtactgcagcaattcgccaattggctactggtagtggtgctgatgaactagatgagtatttgaagattggagagactactgctatggatgctatgaaaaattttgtgaaaggaattagagaagtatttggtgaaagatatctcaggcgtcccactgtagaagatactgaacgactactcgagcttggtgagagacgcggttttcctggtatgttcggtagcattgactgtatgcattggcaatgggaaaggtgcccaactgcgtggaagggtcagttcactcgtggtgatcaaaaagtgccaacgctgattcttgaggcagtggcatcacatgatctttggatttggcatgcgttctttggagtagcaggttctaacaatgatatcaatgttttgagccgatctactgtgtttatcaatgagctgaaaggacaagctcctagagtgcagtacatggtaaatgggaatcaatacaacgaaggttattttcttgctgatggaatttaccctgaatggaaagtatttgctaagtcatatcgactccctatcactgagaaggagaagttgtatgcacaacatcaagaaggggcaagaaaggatatcgagagagcatttggtgttctacaacgtcgattctgcatcttaaaacgaccagcccgtctatatgaccgaggtgtactccgtgatgttgtcctaggttgcatcatacttcacaatatgatagttgaagatgagaaggaagcgcgacttattgaagaaaatctagatttaaatgagcctgctagttcatcaacggttcaggcaccagaattctctcctgaccagcatgttccattagaaagaattttagaaaaggatactagtatgagagatcgtttggctcatcgccgactcaagaatgatttggtggaacatatatggaataagtttggtggtggtgcacattcatctggtaattatgtttttattttgcattattagttatctatggtactaagatatgtacaagtttctctaaattgcactaaatctgtggttcatattggatatgtgtaaactatgaatgtagcctgactaaaaccatcattcatgctgaactggtttttgttttgtatatgcaggatgaaacaaggaactaggtttctgaacgcattacggactgaaggttgaggggcagaatgatccacccagttgcttctatcagatcactaaagtttcatttcactgttttattttggacacttgatgcttgtgtgcatccgatgaatgtttaatttggtcacctgatgcttgtgtgcatccgatgaatgtttaatttggtcacctgatgcttgtatgcagttatctatcttatttgttaatgttgctggtactgaggatttttagaagtgaaatgcacaagttgctgtgttttttgactgatccttgtgtgcacttgacgttgtatgtgacaaatgatggttcccagttgtgcacctgattcatgattcagttattcagtttaaattgacgttgtttgtgtgcaccttttgtcagttagccagttacggctggaagttgtgtaagtttgtgtgacgcctggctacaggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttagactagttaaagctataataaatacaaggggtagtagggatagtatggttaatttaggttgcgttcattctttatacttcccagcatgaatgcgtatagaaaacggagcggtctattagcgcatgattaattaactattagctaatttttttaaaaaagaattaatataattttgtaaagcaactttcgtatatatttttttaataaaataccgtttagcagtttgaaaagcgtgcgcacgaaaaacggcaggggagagttgggaaccagctggaacaaacacagtcttagtgtgtaaaagtcattttttgtaagtactaggtttgctatatttcaaatgaaatttaaactccaaaagttgttgtattttgggtcggatgaaatatttacaagttgtatattaatattttaatactttttttactctagtgtagatagtatcaagatttatggtgtgttcgggaggagg

SEQ ID NO: 30279 - DNA, 12833 bp, Oryza sativa
atcagtattattacatgattaattaagtattaacttttttaaaaaatggattattatgattttttttaaaacaactttcgtatagaacttttttgcaaaatacatactgtttagcaatttgaaaagcgtgcgtgtggaaaacgggagagttgggttaggaaaattggggaaagaacccagtcttatggacacacctaactctacttctgtcctatttaattgtgcctgacgtttatctcgactccacgcgatcacctcatcgttatcgaagtcactcctcttcaccaactccgacgagattcctatgcccaactctcctcccctaactttggcaacttgctttgctggatatctgttgtcgtccctgatcaaccgcttgtttcttgtttttccccaccacatccgccatccatcacccctccttcgtccctacgggtttgatgatgacatcatggttttctcctacttcaatcatccctctaaagctactctcaccgtaaatctactccatctcaccgcctctaaccctaactatctaatcgagtgagatctcaccatctctatccctctagagttcaggtgtcatcctcatcgtcaatgagacctcaccatctccatccctcttctttttttttcctacgcccccgctctagaggtcaaagacaatgctcggggcactgaagatgtacaaaaaagcatgtgagtcttttttatattaccacttatcgatgttgagtatatcagcttaaaagctacatccttctcctattgagttggagtagccttttattgttttcattctagcttatcactcatagccaaaattttaaattttaaaaattaaatttagacagttaatttcgagttattttatcgaagtttttagcatctacttttaaaatcgctagaaatcttaactaattaaaatattcgtaattttccgttcgccacaagacggatgaaggcgccttcgtccgtcggcggtgcgccttcgcagcccccaaatcccaatcgctcttagaattggatacagggaaatactttctaaaatcggcgcaaccaaaactcaaccactctgtcacaaaaaatcaaccacaatcatcataaaatcacaaaatacatcacaaaacttcacaaaaatatacataaaaaaagaagaacaacaacatacatcacaaaacatcacttgcctgctgccggatccaccctcggccatcgccaccgcggccctcggccgttgccaccgccgcactcggccgtcgccatcgccacccgatccatccgcggtagccgccgacgccaccaccgctgccggagggagaagagaggcggcggagggagccgccgctccttatccggccacggacgccgccaccgtcactggatctgctgcgggaggaagacgagaggggacggagggagccgccgcagctagatctgcctgtggccaccgccggcggatctgccacgggaggaaggctagagggagtggagggagcccaccgccacaaccctcggatccgcctgcggccgccgccaactctccgccatcgccgctgtatccaccgcggaagggaggcgagacagggcggagggagcggccgccggctagggaggtgagatggggcggagagagctgctgtcgccgtccccgccgctcgcgggaaggggggaagggcacactacaaccactcggggggagggggtggagggcgctaccaccgctgctcggtgggggaggtcgccaccgccgtcgtcggttttcgattgatcgagagagagagaggatcgggggcgggaagggtggaaaagaattttaggattagggtttttgctgcagacatttatattggttgtgatcaatctagaccgtccattcgatcgaacggctccagcttctcgcgcatcgggccaccggactattgggcctccgcattattgggcctacaaatgggccgcaattaaaataaatgttttctctctcagtaattttaagcaactttctattttcaaaaatagcaccattttaattatttatgactgcttattaatttaattccaactaaattgaataaactagaacattggctagatttttctcatgatatggatttatttttcgactaaaaatgtaattatttatttgtcatgatatagaatttaaatttagactaaaattaaataattttaatttttaattctatatggactctattcttcttccaatattcctatttttttattgttctaattagtttctatatgaactctaaactcttctttcaatatttttattttaaattttaattatttttctaaattgtattcctatatgcactctaggctcttttggagaatattctagactcctcatccaatattatttattttataatttatactttatattaagtcgtattatttatatagacagattaatctatccagtgtagggtttttttttgcaaaaagatttgttttatgtagatatccgattggacaacgtgattttttttaaaaaaaacaaaatgaaagagtcctggtctacaatgagttctccttatttttttatattttactccaattaatatgagaatttctatttgagacttttctagcaagcaaaaataccaaagcagtgtgaaaataacttcggttaaaaacaaatatttttagtgttattacaccgtagcgaagcacatgcattttgctagtacaaatataaactttttacccatagttatttggttccttttttttgcctcatcgcagggagagaacgacgaggccgttagttttgtgatctaacggcgacgatgcaattatgataactagtatggtggcccgcgcagattgcgcggctagcatcattatattttctctcatataatagcatatatgttttctcattatattattaaaatatattacaatgacaacataattttaaattttgcaataactttacgaaactactaatgtgtaatattcatattgtattttatatacatgttagttattaattatttttaatatcaaattttagttatttgtgaattatatatattcctatatggactttagaatcgtattttaatatttctttttttaattctaaatgtttattatttctaattgtatttctatgtggactctaaacttatctttaaatattctttaatttttaatttcaaatttcacttacttctaaactgtattcctatattggctttaaactcttcttcccatgtttttcttaatttcaaattttagttatttgtaaaatatatttttatatggactctaaacactacttttcattttattatgtttattccgaattttagttagttttaaattcttatatggactctatactctacttctaatattccttatttttaattctgaatttctatttttttcttaattgtatttctataaggactctaaacactacttttcattttattatgtttaatccgaattttagttagttttaaattcatatatggactctatactctacttctaatattccttatttttaattccgaatttctttttttttcgtaattgtatttctacatggactctatactctacttctaatatttcttatttttaattccgaatttcagttatttcctaattgtatttctatatggactctagtctcctcttctaatatttcttatttttttaattccgaattttaactatttctaaattgtatttctatatgaactctagtctcatcttctaatattccttattttttaattctgaattccaactatttctaaattatatttctatataaattcatctttcaatattctttaatttttaatttcaaatttctgttaattttaaattgtatttctatattgactttaaactcttcttcccatgtttttcttaatttggaattttagttatttgtaaattgtatttttatacggactctaaactctacttttatttttattatgtttattctgaattttagttagttttaaattcctatatggactctatactctacttctaatattccttattttttaattccgaatttttattttttttcttaattgtatttttatatggactctatactctacttctaatattccttatttttaattccgaatttctattatttcctaattgtatttctatatgaactctatactctacttctaatatcccttattttttaattccgaatttcaattctttttgactgaaattgcgaatttcagttatttcctaattgtatttctatatggactctagtctcctcttctaatattccttatttttttattccgaatttcagctatttctaaattgtatttctatatggactctgctttttttctttttctccgattaatgcgagaatttctaggtcatgagagcgaacatggaggctcctttttattccgaattttagttagttttaaattcctatatggactctatactctacttctaatattccttattttttaattccgaatttctattttttcttaattgtatttctatatgatctctatactctacttctaatattccttatttttaattctgaatttctattatttcctaattgtatttctatatggactctatactctacttctaatattccttatttttaattccgaatttcagttattttctaattgtatttctatatggactctagtctcctcttctaatattccttattttttaattccgaatttcaattatttctaaattgtatttctatatggactctagtctcctcttctaatattccttatttttttaattccgaatttcagctatttctaaattgtatttctatatgaactctgttttttttctttttctccgattaatatgagaatttctaggccatgagaacgaacgtggaggctcctttttctattcctttaataatataatagatttttttaagaaaaatgctcgtgttatacgtgatctgagatacacttgatacgtaagtggtgtgtggtttaaattctgagatcccgtgttgaattttcaacacgctcgtaagttcttctaaaaaaatatttgaagtgacgtctctctccaaacctttttttttttggtggggtttagacaggatctgaaccggacctgtacaagttgaacctgatgagacgagatactatgcatgcatataaacattacacgatcctaatcccaccaaggagaaaaaaccgatccttggcgaggcagatcctgacatatccttgtcctcccgaccaccacagttgatcgtagccaccctggcgtgcgtgcatagccagtttagccacacgaaactgtagctctctcgacccaaattccccgaacccacctactagctactcctgcactgcaacagcaaatgcaaggagaaaagcaccgagccagccgatgagactcggtgaccgtgccccggcgccgaccgccgcgtgtgcgtgttcgcccaggcaaaagacacagcgcaattgcgcgcactctctttcgcaggccgcgccgccgccgccgcttcgctttgcaattgcatgcgcccttttgccgacgccgcctagcttatcattatccttcctcgtcggccgcggttttcaccgtcctctctcagctcccctcgtgttttcaccgagcgacgcactcgtaaaaatacatcaaagaacgccgcggtaaaagctacgcaccccgtacgtacgtaaaaaagtgggtggtaaaaaaaaaggatgggttggtgtactggtctctgcgtacgtgaaaagactagctatcgatgcgtgtatctctgtgcgtgcgcgaacggaagaggggagcagcagcgagaggctttagctagtctcgcctttttctttttcccggctttatataaggctcactcgctcacactcactcacttgtgtctagtttacaccgatcagtagtagtgctactaccactttgggtcggatcgagcttgttgttgcctgcaaatctgcaaataatcttagctccttcagctaaagagcaagcaacggctactagcttccctcaacgccctcgtcgcttgcctcaccgtcaccgtcgtcactcgtcattcaccaacactcgtcaggtacgcttctcgcagcttgtagtatggatatgtgctgcagtgtttagcttctactggtgtgatgattaatttcttgggcttcttccgatcctgtgacgaagtcgcttgtgataatttggggcttattcagctcagacgaccagatgcaaagcctgaaagtctgtcgtctgctaagcctgtagccgtagcacgtcgtcttctcgtgagcctctggttggatggaaccttggagaggagatggaagtatggtagtagtgtcgtaccagtacttgtgcctgctgctgctcgctgcacattgagctgcgtggcgtatgcgccgcgcattttgctgcctttgcaaaatgctcgccgatgcatatgcatatggtctcgttctcctcttctttcgctcgctgctcttttgaggagagagacacaagcgaggccggctttcttttgcccccaaagctgcgtggccatggcgtgcagccaaacgcttcacatctctcttttctctctctttggcactgtcgagataccagtcacgcatcacggccatgtacgaacacgtctcctcctctgcagcaaacctgctcttctttctctctctatctatccaacgctatcaaactgtagccgtaggcctctggcgaggcattaaatgcaagcgaggcattaaaacgcaggcacagctcatgattgcgtcgcttgttggtttcctcctcgtcgtgttccaagcttcgacctgcaagctcggacggacgacttgccttcttgccgtcgcaaaagggtgccctaaaaactgatcctcggtcctttccatgtcacccacgacgaagaacaacattgctcgcacagcgtaggagtagctaccattccttgtcctgtcatggaacatcaccgaggaaaaaacgagtaatttatgtctactacagaatcttggctggctgatttctatagctacctggacagcgcattttcgagtactagtataggagtatagtactctatgattttgtggatagtagctttttgcatgtttgggtgtgtttagttcacgttaaaattgaaaatttggttgaaattaaaatgatgtgatggaaaatttaaaagtttatgtatgtacgaaagttttgatgtggttaaaaaattgaaagtttgaaaaaaaattttggactaaacaaggcctttgtatctttattttacaaactttgtgctgttggagtagtactagactactagtaggagtaactttgtattgataatactaggagatgaacgtacttgtaggtaatggtactaacagactacgaaagattccaacagcatctatatatgaaaaaggggaacaaaggagaattctgaaaaaagaaaagcacgcaactcctctctttgatttttttgcttttgtccatccatgcatcagccaacggttaaaaaaccccgtcgttgcatcatgggtccgcagcaccaaaagcccctcatcctcctcccccttttgcagagcatttcttcccttttcccccagcaacgagggtaaaagcaagctagtatcctactatggtctactccagccaggctaccactgccatcctgcatgtctcccgtccgtcgatcgtgccatcatccgcctgcagcgtcacgcgagtcgggttcgccgtgacgacgacgacgacgagagatcataatagtagatggaagactaccaccagcggtagcatagctataatagtaacttcttcatcatttacagttaatttaatagtcaatagtcaattcatataatagttatctataaatatatactatttctacctgttatacacatattgtgtcttgtaatccgtactatagcctattgcttatctctctttcttcactgtgtttatagctggcttatagtttaagaacggtggtgaaatgctagaaaagttactataggactaatctcgcctttgctccaaaaaagaggggcagaaagaccggggcgtgctcgtgctggaccatccgccgctctcgcgcgggaccaaaccaaccaaccagccgcgcgcgcgcgcgcgagcccggcagccgagctagctagccacgcccaccaattccaccgtgcacgcgcgcgcatgcgtgcatgctcgcgagaacggtcgggtcgggccctcggcgtgggatcgagttgtttggttgcctttcccgtgctcgatagatagcgccggacgacgacgacgacgtctttctggtctttttgggtgcacacacgcacccgtttgcacgtcgcgtcgctgtccctcgctgccacttcggctaaaagtcgtgcgacgacggggatcatatccgtgtgtgtttgcgttcggttcgacacgtgacacggctgttgtgtttgattgtctcgtatgtactatatttttcacctccctgaagaaaaaaaatgggaaaactgagattagtaggggaaggagttttttttttaatcttgtgggtggcctttgtgcatgcgatgcgattcgcaccgaatcttgtctggtcaggtagcggcgtcacgtacccatgttacgtcctttccagcttcaacgccgccatgattgcactcagtcgcagcagccgcgcgtgctcggctgcgccgtcaataatggcctcgtatctcctccacccacaaggccacacacagcccagtagtaggccagtagtccaccggggtcaactcctccttcgagtgcaacctctgccagtgccagccatcaaaccaagacccccccgaattagccccaaatgatctctttttcgtgtcaccttttccctttttttttcgtcctgcgatcaggctagagtacgtacgagtactagtactagtgtaccaggcaacgagagccatcgatggcacgcagcgctagtccactcgattacggttgctcgccgtacgtctcggcgcgacgcggccgtggtccctgcgtcgcgcgcgcgtcgcgtcgcgcacgccacgccggcgctcgcatgcgatcatgcgcgagctcgtcgcaccggcttggccttttgccgcgcgccacggcttttctgacccccaaaataaaagaaaaaacggctgcagccagcggcggccggtcagccagccggccagctacacggtgcgcgtacgtacggggggaaacacgcactgtgtggggggaaggaaaaaaactcgttgagcagactgggtggctctcggttcaaaattgtctccattgatctaatttttaaaaacttttaaagtaaaaatatttatttttaactaaagttgcttacacgctactctcttcggtctaataatacttgcccttttatataagggtaaagtcaaactttagaatctttgattatgaatctttttaaaatatttgtccttcaaatatgatgattacatgtatagattagtcttaaaaaataatttaataagatcatatatttgttaatacttttatacatgttataatgaaaaataatggtcaaaattattttttggagatcgtatccttgtccaaaacgacaagtattatcaatccggagggaatactaacttagctcattaaacaaagaaaaatataccccctacatccataaaagttacacatattatttatattatttttgtcaccaagaccaaggaaaatttaaatcatcttggatgttacaaaatcatagagtgaatgcaagcatgtaaccaatgagtgtttagatgcctccttgggttctaatcaaatatttaatttgtctccttatttaagtcttgaatgcataaagactgcagatagaaataacttatttgggaaaaactcaaatgtgaaatatatttaacttttgtggttgaagggagtaataaactataaaaacagtactactagctagcgtgtgatgatatctagatttccgtttacaattataaacgattctaaaatacttttataatattaaggaagtagcaaaacgataaatcatagtgagtattatttaatatatttgacaataaactagaagtagtaggggagaaataaacaatacaaaagtcgataagtgtaaaataaactaatagaatactatgccttgggattacagatatcttatgtttataataaattaaaataatataatctcttatatttatatatcgagggagtacgatcatttagcgtattgtgctgtacgctagaaatttcttacgtctggttcgtagaaccatttgtgggtgtgatcttaagcgagggtacctgcgtacgtaggtagaagatggggacggggatatggttgagagaacgggagtggtgaatgccgtcctgaatccacggagcagcgtatggagtcacgatttgttacggtgagctctcgctctcgtcatggcggaggtggatcgatccatccattttcacgccggtcgtggtcatccatcaatgctcatgtatcgtgccagcgagattgcaggtgatgtcttcatcatctaatcggaaattcagcaacctggggagaaaaaaaaatcaacaaatcgctgagcactgtacctaatttccgggacgattccgtacgagccccctaacagtagtgtacttactggagtactaagtgcaatgagctaatgccatgtttgccattactacttgcaagcagtcaatctttagggcagatgagacgatctgatccgtccgaagaaaagagagggggagagggacccagccgtgttgtggtgtgatgatggcgccttttgagcacgcaaaagaggagtcctagaccgacctgccaatgccgtgcccgtggcagccggcaggtagtgggttggcactgcctgaccccccgacccgactcccctgcctcctgctgccgctagctgcgacctgcaccggcgcatgccgcagcacaacagcagcagcggctcacagtcacagcttgtgtgtgcgtacgtacaacccgagcacgcgcacagtgccgcaccgcagcacgcggcacagcagcggcattaacgccacatgctctcataaacgtatgagtatttcttcgcactttttgcaggcttgcgatgcagcgacgacggagaacgcggcgccgcgcggcgaagggcgagacgaggcccggggttgggtgcgcgtggtggtggtgccatgcacgggctgatcgggttggatggatggtcccccgtccgtagccgtaagggtggcccgcgtgtggcaggtggcgcatgcagcagcgggcgcagcggctgctgcttgctctgcttgttcccctccccaagcgccgtgttgcctctgaccgcgccacgcgaatgctccgctttgtccctcgacgccacgccacgcgagtagcgccacgcaccgcccaccaccccatccatccatccatcgggccgtgcgccgtggttggcggcgttttttcttggtaggttttgtattgtacgcacgcactggtagtggacggctagtagcctagaactggtgtaagtcgttaacccgtaaaacctacttaacctgtttggattcgtggccgaccaattacacccctacctaaaactaagatcggtgctgctgctgcttttgcccgtgcgcgcacgagtaaaaaatgggtttgggccatgagggaacgagggggtgtgtgtgttgtgttcttctattctgcaatggtggagcgccttcttgtcgggggcacgcacgcttccaaagttgtaccgcacgggcaccgaggggcagggcagggcaggttctctcggctttgggacatttcttgctgcgtcgctggtggtgtagcagtggtggtagtgggagtagtggcgttcaaggccaaaggatgttgcgtttcgatttctctagtgcttgggccatgctgcatgaggcttaaactaaactttgatcacactttggatgcatgttcctgcacaacaccaaaaataaaaaaaaaataaaaatcctccaaaaatagcgcttggtaggatgtccgtcatgccagcaatacgcagttgaatcagacttaagtgcctgtcagcattgaacaaagttttgtaatgtcaaaagttccattattatacacacaatctgcctctcaatgatatttacaagtactactagtactagtactcccatggtaacataacaccacgcgctagcggccagccacacgaacatgtgatacacttctcaataaaaatccccatccattctcccttccttccatccccttcgataatccacccccatccgttggaaacctcagctgcactaccctctcgtgtttctcgcgccccaattaatccacgggccacaacgttttacctaccgtctccccccacctacaagaaatcatttctacgacgcctgctacctttggtaaaaaaaacggagcatattttgcttcttccctgttcaatcttaccaccggcaggcaaggcgaggtctatttatttatttaccgcgcgaggcggccactactactactaggaccaaacagggtcaaagcagctgcagtagttgcatcagtgacgaagggttctaatgcctttctgtcccgcctcgcattaattctttggcttggttggatgcgagagaaaaaagaggagagattttggtagaattgtaagatttttgttactactaccactcgttttcttggcttggtttggtttggtgtttgatcacgcggtggtgacattataagggcgcggttgcgcaggtgttcgaccagcgggtggcgaggtcagcggcaaggtggtggtggtgcgcac

SEQ ID NO: 30280 - DNA, 22302 bp, Oryza sativa
catatgtactttgagcatggaagaaaggtgagagcggttttcttggtttccgtggcgcgtcgttgcctgactttgcaggtgaagatcacgccggaggtgagctcccgaagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacggtgcgcgcattatttgcccacagcccggcgctccattcttctccggccatgtcttaaccgtcatcgcgtctctggctccgcagggagagggagtacagggtcgccatcaagttcgccgcgcgcgccgacctccaccacctccggcagttcatcgccgggcgccaggccgacgcgccgcaggaggctctccaggtgctcgacatcgtgctccgtgagcttgccaaccgcaggtacgcacacgcattgctcgtcgtcttgtgttcttgcaagggaaaagaaaggaaaaaaactaatactgattggccccaatggtaggtatgtctcgatagggcggtcgttctactcgccggacataaggaagccgcagcggctcggcgatggcctacagtcatggtgtgggttctaccagagcatccggccgactcagatggggttgtcgcttaacattggtgagatgctcgcgaatatttggtgccctcatgcatgtatctttcctggttgtcatgtgcttgctgcttacatggtggatgatgttgatgccagatatgtcatctaccgcgttcatcgagccgctaccagtgatcgaattcgtggcccaaatactagggaaggatgtcatatcgaggccattgtcggatgcaaacagaatcaaggtaaatttatgcttgcggggaaggaatagtctagccttgttactgtagtggaatgtaagatgtgttgtttggatgcttttggttacctgatagatggcttaattgtgatgctttgcatgattatctgattaacctgtggaattcgccaattccatgcagatcaagaaagccttgcggggcgtgaaagttccagtcactcaccggggaaatgtgaggcgttagtatcgcatttcagggctgacaacacaaccaactcatgaactgatgtatgttatagtgtaattcatttctcgtcatgtactttcaattgtcaaatgtcttgtaccgaactttcccgaaagtagaagcatgcatgttaagcactccctcttgcttctaaatctgagtatggcagaccaaatagaccaaattaactatcaatatctatttcatatacgttagctactaggcattgtgttaagctatggaactgattttgtttgttttaacagtttcccaatcgatgaccaaatgaacatgaaatctgtcgtagagtatttcaaggaaatgtatggcttcaccattcagcatccccatcttccctgccttcaggtgggaaaccaaaagaaggcaaactatctaccaatggaggttggtattaatctcatcaagtcacaaatttcattagctggtcaattatgtaacattcaaccttggtaaaagacatcatcattttgagatatttcttaccaggcctgtaagattgttgagggtcagagatatacaaagaggttgaatgaaaagcagatcacatcattactcaaggttacttgccgtaggcctagagaacaggagatggatattctacaggtctagttttttctcctaatcggattataacattttgaaatatatggattacatgtttgtcaggagtaaatgtttcaagtattttgtcttactaaattggatgataaatccaaacaccaaatcagtgcattagaatttagaagatacgcatgctaatgtacgttaattgttctatgctgaagtctttgttttcattacccacttccaagtggtccaagcattccatgcaattgatgttcaatagctacccacccaataagtgctactagggtttctcttcacttgatcagcactcttgttataatggttcaagactaaaaaaatttctttccagacagttcaacaaaatggatatgagcaagacccttatgcaaaagaatttggaatcaacattagtgagaagctaacctcagttgaagctcgggtccttcctgcaccttgggtatgatttgcctttgttaatctcagtagttggctaactgctctcagctaataatttgggtatgaaattttgtggctttcagctgaaatatcatgatactgggaaggaaaaggagtgcttgccacaagttggtcagtggaacatggtgaacaaggttagattccccgttttccgcagctgtatacaacagacgtccttttatatatcatgatgatggcctgatcctgctagttttccactaattaagcattttttttttgcagaaagtgataaatgggtgcaaggtgaatcattgggcttgtataaatttctcaaggagtgtgcaagaaactactgctcggggattctgccaggagttggcacaaatgtgtcagatatccggcatggtatataactcttaacttcatctaatggttttgcataatattggtgcttttataatgttatttgttggctgcatcttttcagttttatctctgctcttcttgcaggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgagtgtcggtttggtaattgcatcgcaatttttccttggaatcctcatattgtgtgaaatgcttaagatgtaacttaatatttgcaggtgatataaaacgtatatgtgaaactgacttggggttgatatcacaatgttgcttaaccaaacatgttttcaagatcagcaagcagtacctggcaaatgtctcacttaaaatcaatgttaaggtaccaaatacttataaaccaagcagttaatacttagcttgtctacacaaatgtagtgtaatgcagtaagcagacttgcagcattgctaatgccttgcatttcggagttgtgatacagatgggaggaagaaacaccgtgctgctggatgcaataagttggaggattcctttggtcagtgacataccaactattatatttggtgcagatgtcacgcatcctgaaaccggggaggactctagcccatccattgctgctgtaaggctgagcatttctatggttacatggccatcattttttttttaacctcttaccctctctaataagctgcatgcaggttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcaggtcttttttgaggaacaatttgttcttccaaccaaaattaattgatgaagcctcctattaaatagtttagggttacctcctaccgattaacttatttttggttctggtcttgttgtgtagggagctcttaatatccttcaggaaggccactgggcaaaagccattgagaataattttctacaggtatgctactgcaaatactgtttataaactaacgtttgtagagtacagtagttagatatttgtggaatcaatttaatcctatgtatcttcaacaagtactgaacctagtgtttttgttcgctatttgaagtatgaaagttgctgttataggcttctatttgtatatctgctaatagtatcggtactgcttctcttctagggatggtgtcagtgaaggccaattctaccaagttctcctctatgagttggatgctatccgcaaggttagatgcatttgtattttctttactcagatattttgtccactttattaggttgcctgacgaaatgttttcttttaggcatgtgcatctctagaaccaaattatcagcctcctgtaacattcgtggttgtccaaaagcgtcaccatacaagactcttcgcaaacaatcacaaagacagaagtagcacggacaaaagtggaaacattttgcctggtaattactattcatcacctcttaaggcatttcattggatctactgcagatgataatgcaaccaacatattgcaaaaatattttttttattttaactaaaaccctcagtttgttggtagaactgtttcagtgatttgatacttgttttcctattcatgatatcacattcacaactgtttttcttggattattaaggtatcactttgggtgaactaacttttatatttactgttattcacttgatttctgtaattgctcatgtgtttgctaaaaaacaggaactgttgttgattcaaagatctgccacccatcagagtttgatttctacctctgtagccatgctggaattcaggtaagaatattgtagtggtccttttgtaaggctgacatatactgaacttgtcgttactctggtccccatgtcttctgtgattaagtatttgaggagacttcatattgtcttttcaaccacaagcagtgtagtacttcctccgtcccaaaatgtaagcatttttgaggttggtacgggtattaagaaagtaggtgagaatgattgaagaaggtgtgtgattgattgaaaagagaaagtaggtgaaaaagaatgattgtgattggttgagaggagaaggtaggtagaaaaatagcttcattttgagacaaattactgtgctagaaatagctacattttgagacagaggtagtagtatcacagtagctagttactgtagtacctagcaaagggcacatctgcacatgctagaacaaacaaacttactataccatggtcaaatttttaatcatgtgattgtacattatagtacttggatcagcaaatattctgtctgtagtagcgctggaatataattccccaagtttgtcctccatgtactgaaatgactgatgtgtgtgagttttccagggaacaagtaggccagctcactaccacgtcctttgggatgagaacaatttcactgcagacgaaatgcagacattgacaaacaacctttgctacacgtacggcattactgaatcttgttaagtttatcctttgcactctgagcttctctctatagaaattgtctgacttggtacatttgctgatgcagttatgcacggtgcacacgctctgtttctgttggtacgttcttctgaaatgatctgaacatttttccatcattttctttgtattcatgtgttattattagttggacacgaattctgaaggtgaatcttgcatttcttttttcctggtccaacagttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcagagcaagcatttggatcctgagcgacctcttttgaccactctgtaaagtactaagtaacgcatgtataatagttgttgtatcagtctgaaaaaaaggaagtgcactcagtgcttgtttttccagttctaggatgattttctcttcatggttaagatctggtaagagactcaatacacgaatccattatcaggataacaccaacaattttcacttatagaacatattcgaaaatttctgagaataggctaataattctcaaaataaaaataaaaataacctgcaggatgagcatcattcgttgctgccattaaggacagtaactaaggatataatgctgaatatacgaatctagttaagacggcctgaagcaggtccacagaacccgacttaaaatcattgttagttcagattccgggccacattgtatttttactgtgacttgcagatgaaccttcttccataaataaatattgcattcacttcaaagtgatgttttatgtgttagtgagttttgagtggatatgctgaatacatcaacaagagcaaactgaaaatccaagtatagcatttttaacaagctgacaaatgacagaatcatgctgcgatgataatgttcgtccatccattgttaagaagttatggttgcacattagatataatcatctgcactgataggcataggcaacaacagaaaaaaaaatactactggcattggtgtctaaccttgttttttcatctgcagaaccgtgttccatttcctggcaagagtaaaaaaaatccagctctgctacaagcctgaaacaagctagctgaagttcagtagtcctcaaattaactaactgtacaagcctgatcactcgaatgtctgttcagacaaggttcttcaaaattgctaatgaaacggcttccagtgattgatcatgcttctgttggtccagtcaaactaatggatgcttcaacaattcctttgtccaagcattatatgcttcaacaactcctcagtaccccttcacctcaatcaagctacaccctgcattcttcttgacagtagggtgtgccatcttgccccgtacccttatcacatcctcccatctacttgctgttgcatatacattagacatgagcaaattcacatcagtaatttgggaatcttgctcacagattcgtttggttaaccgttcactcatctcaacattcccatgagccttgcaagcagtgaggagtgcaccaaacagtggcatagcatccttgttaattggaacgtcaccgatcaacctctcagcttcatctagtagaccagcacgacctaggaggttcacaaggcagctatagtgttcaactcttggttctatctgataaacctccctcattgcatggaactgcttccggccttcatcaaccaagccaccatggcagcatgcacttagcaccccaataaacgtaacaccgtcgggcttaactttacttctctgcatatcttgaaacagttcaagagctctaccagcctgaccatttgtggccagcccacagatgatggcagtccaagctgtggcatctctgccttgcattcgccagaagacctctagagacttctcaatgtgcccacatttagaatacatgtcaatcaatgcggtgcctaggactgcatcgatcttcattttcctttgttcagcatactggtgaatccattcaccttgatcaagagcgccaagattggcacagcatgtcaggagagtgacaacagtgaacctgtctggctcaacccgttgcatctgcatatctcggaacaatgtcagcgcctcctcgaagcatccgtgttgcacacacgcattgatcattgcagtccacagaattagatccttctctttgcactggttgaagagcactctggccttgtccagctgcccagcaaggccatatcccgacacaagtatggtccaagaaattatgttcctcgcaggcatttgctcgaacaatttcaccgcctcttccaagcaatcattcttcgtgtacatgtccagcagagcatttgcaactggcagattgaaaccgaagacgttatccatgtacacatgaatcctccttcccaagctcaggtcccttgctctagagcacgccgtcaccgccgtcaccaacgtcaccctgtcaggtgtgacaccgcttctctccatctgttcagacaaagcaactgccgccgagtaccacccgcacctgatgtagcacctgaccatcatgttccacagcaccagcgccctactcggcatttcgtcgaacaccttccgcgcgatgtccacgcgccccagcatcgtgtacatctccatcagcgagctcccggtgtaggcgtcccaccggaacccggtcttgacagcggccgcgtgcgccttgcgcccctcgaccgacagcttgaggaccccgacggccctgagcacgaacgggtaggtgaagctgtccgccacgagtccccgcgcgcggaggtcgtagtacaccgccatgacgcgcgcgaagctcccccgcctcgccagcgtcctgatcagcacgttgcactcccagagcggcatcccgtggcccctcctcgccgccgccattgccatcgcgcggggtgggtggcggcgacgcgacgcggccaagacgtggggggggaatcttttcctatatagagagcggaaagtcacagcctcacgggagagaagggtaggtgtttgtgtgtgtgcctctctctcgagtctcgagatggtggggaagcgagtggcggtggtggtgggagggagcgtggcggggctggcatgcgcgcacgcggtggcggaggcggggtgggaggcggtggtggtggagaaggcggcggcgccgggggccgggaacggcacgggcgccgggctggggctcgacgcgcagtccatggagacgctcgcccgctggatccccgggcgcctcgacgccgccacgctgccgctcgccgtcgacctggtaagctaagctcccccctgtaaatccgccggcctcctcctcctcccttccccttgccttgacccacccgtgagcgcggcgcgcgcgcagaacagggcgacggacggcgagacgaaggcggggaggacgctgacgagggacgaggggttcggcttcagggcggcgcactggggcgacctgcaccggcggctgcacgaggcgctgccggccggcgtgaccgtgctctggggccaccagttcgtgtcgttcgagatggcgccggaaggggacggagatggcggggtcgtggtgacggcccgcgtgctgcgcaccggggagacggtggaggtcgccggggatttgctcgtcgcggcggatggctgcacgtcggcgatccgccggcgattcctccccgaactcaagctgaggtcagccagaggttctagactactgaattgtttactggtagtagtattattgtttagtcgcatgattttttttttcaatttagctgctccctccgattttgaataacactcgcaccttctccacctcctcgagttgggtactactactaattatcgtgccatataattttcttacaactctaattgggaatataaaaatatgaaacatacttagcagagtgaatccaagcccggcctgagacccacgtgcccacgctcgactcacgccgcaaagtctattggacaaaaccccatgtcggcatgcccgatgggttcgcgttgccagccacctcctagtcccgtgtgctgccacgtcgctagccatcaccgcaccgccagccgtcgcttgcgcccttgcacctccacgtcatgtggccaagctcccttcccgtgcaccaccgccgccgcctagtgtagacactggagaagagtagaagactgagggagtgagagatagcagtgaggagtataaggtttgtgatttggggatttctatgctagggtttcatttagtgaatatatatattgcatacaaaggggtcaaatggactattaggccatgtgaggagataaaactatttaaggcctgaaaaatatatatgggctaaaaaattttcaggtcgggcatggtttacccacaggaaaaacccgcgcgcgcctactaagttcgcgggtatcggatcgggcgtgcccacaggcaaaaaaaaaaaaagttatccgcggatacccaaacctatgagcaatactgccattcctaagattttgggtgtgtttgagagaagagatttttttaaaaaagtatataaaatgggatgagccattatcatatgattaattaagtattaattttttaaaacttaaaaaataggttaatatatttttttttaaaaaataactttttaaaattatcttttttaaaaaaacgtatgatttagtggttcggaaaacgtaacgagggatttcttctctctttcatcctaaggaacagccttagtgatattaaggatttacgattgcctttcatctctttcaacgtgtgttttcgggcgcattcgtggacgatagtgtggtgcatgagtcgtgatggtgtgtgcgtgtgtttttcttccattaatgaaaggaaaatattagctgagtttttcagtatttcaatataatatcatgtcaaaatgggcaaacttagctaagattgttttcgattttctgattatttttcaataatgtaggtactctggatactgtgcatggcgtggcgtcttcgatttctccgggaaggaggggtgcaccaccatggtcgacatccggagggcctacccagagctcggcaactgcctctacttcgacctggcatacaagacgcacgctgtgctctacgagctgcccaagaaccggctcaactggctctggtacatcaatggcgatgaaccagagctcatggtaattgtcaatcgatgagaaataaatcagtgtgtttatccctccttttccgatgtgatttggttccgtttggtgttgcaggggagctcggtgacgatgaaggtgaacgaggccacggtgagcgagatgaaggaggaagccgagcgcgtgtggtgccccgagctggcgcggctgatcggcgagacggcggagccgttcgtgaacgtgatctacgacgccgagccgctgcccgggctgtcgtgggcgggagggcgggtggcgctggtcggcgacgcggcgcacccgaccaccccgcacgggctgaggagcaccaacatgtccatcctcgacgcccgcgtgctcggctgctgcctcgcgaggtggggcggcgatggcaacgccgagccgacgtcgacgccgcggcgggcgctggccgagtacgaggcagcgcggcggccggtcgtggcggcgcaggtgctgcacgcgcgcaggctcggacggctcaagcagggcctgggcatgggcagcgccggggacggggaggggttcgacgcgaggacggcgacggaggaggagatttcgcagctgcggcagagcagcatgccgtatttcagtggcgcgccaaccattgagtgatctaataaatgtatttttgtgaatttttatataaagaaagaaatggctatctctatcataggttttctttaccgaaatttcaaatttttagctcctgccctgtttggaataaatgaaatctgtactattttcaataagaagtttgttgtaaatttcaccaaaaaccgttaatttaattttatttttcttctcataggaaccgttcatttccgaaaatgctcaggcccgggcaaccggcgggaggtggagcaggatcatgcgcacgttcccctggccccaccacatgtctcaagaaaatgtttcacccagtgtactcacaatgttttactatatatagatctgatattaaaatattcttttacaacaaattacccacatattttggaaaccctttattaagggaattcgtttcattttttatttgcagtggcatatgtatagatctaatgttatagtgaactgaaacattctttcgctatttgctgaaacattgtttttatataaggtgaaacaacgcccgatttaaacgaatgaaatattttcgatctacttagtgaaacaattccgatatacttggtagagcatcgtgcaactgtcaacgtttgatgtctcgactacggtatttggacagtatggggatcgtcggtgctagggtatacgcgagactgaggtaaaagagatggagacgatgatttttatacaggttcgggcccctgagctatcaggtaatagccctacatcctgttggccggagccaatgttgctttttattcaccataatcacaccagtacaatatgtggggtggcctatctaactgttgtcgacatggcggtctgaaggtctgactaatagtcgacaacagggtagccttcctcctcgagctcgcgcccgacggaatcagagacagtgctagatccctacggccggcctcttgaggtacccgatagggtcgatccaggcgtatctctgatgtcgatatccggcggcttgtcttggcgtatgtaggcctctatgttgaatgtgttggaagttgattgtctcgtggtgggtgttgatcgtctcatggtgggggtcgatcgtgttgatcgtgttgatcctccatggtgggtgtgtgtccccctgtcctcctagggggcttatatttatatccataggtgtccccttgtccaagtagaactagggaaaccaatatgaatacaatccgagtagtccttgtcgtttccatatagaactctggttgtctttccttatccggaactccctcctatatccgtaggctgtttccgtataggacatggtatgtggtgggtcctgccgagatttagtcaactactattaggtatgtggtatccataaccctgacagtagcccccgacttcaatgcaaatgaacgaattcatattctcaattgcgcgcagactttggagtaactattatcgagctcatgtgaacgttttcggtgagttcagatataacgttagacttcctttgtcagcttcgtgcgggcaccgaaagggtttgtctaagtcaatctttgatgttgaccgagaaagtacagagcgtacgactaagtttcccgtcttgctgtaatcgagaatttggattaaagtcaagaaattttatctcggcgggtacatcatttcttcattccgcattccttgtcgagatccagcaatcgttctcgagcgatcgagaaggcgtagagtctgcgacagagccttgtcaacattggtcgtactcgccttagtcgatcttggtgtagaaccatagagacatggagccttcgtcaatgtcgaatataattttcctgaaatcaatactcagaaaagaatattagatagaaatagcccccaagcgaatgctcaaagggtgacatattataatatgacagactaatgaattgaatgtacagaccagtgttttgtatatgagtgtcttctctcttaccgactccgatcagtcagtttgtagagtcatacactctccctagcccccagccttgtcatcggagaatcattctcggaggataaggctcttggacccttgacctgccttggttgaataagcactgatcctagcccccagccgtaaagttggaaaagtcaatttccgattacacggcttagttaatacgcacggcgagaactcttacacgaccagatcttacatggtcttttgtcattacagatcttacatgggcctccacttacatggcactccagcaaccggtggatctctcctccctttcccttccttatctggctacattcccaaattcttgtcccatcgacctagccgaaacctcccctctccccctccacagcttcctctgcctccttgccctcgtcggcgccgcctgcggtgaggctccacgcctccatctcggccgtgtccgttagttctctttttccctacctccgcgagttcagctgttcgccgtagctccccctgctacgtcccgagctccgccgcctccgattaaactgtttgcgccatctggcggcggccagcagagtcctccctcagctccgcgggtttagattactgcgcattgatatgtggacttctctgcttgcttcctgaggttagttatgtataatttttccctaatgattgaaaaatctttgggacgaaaatttccaaaatttggccgaaaattccaatatgatatttggaagttttgaccaaaattttggaagttttcgttcaggggtatttctgtcattatgataaaaatctaacggaggctaactagacaatgatggtatattatagaagttaagaaaattgtgatgacatatgagaatttgacaaacccagtgacatattgtagaacatggataaaatcagtgacacataatggattctttctatttgttcccttaactacctatctactatggtgcgacatgtttagaaaaagttaaatcttatactataattccatttcttacacattaaattatatatacttataatataattttcaaattatatagtgcactattcacattttatatgagaaatatggaaaagtgatttattatctatttaattatgagagaaaaatattagtccaaattaacataaacatatagaaaataaaaaaacaacaaaagaattacggaattactccgcacactaactctctctccctccattttctttttccctctaacagttagtgatcgctagatccagcaataaacaacccagatctagcatctccgttttttgtaaggttggttcatgcctccctaagtctttgcaagcccaacaatcccaacctcaacgacgacgatgacaatagtgtgcatggcgataggggaggagaaaagacatggctataactatagggtgcagctacgcatgcaaaggcggagaggagaaacggtggtggctcatagagaaagagcgctggtggtggtgcgtggagctgtagttagtggtcgcgggtggtctgagaagtttgttgtcgacacaatctctaactgagtttgttaatgtttttctgatatatgggccaccagtcatcataaaaaatagcatagtaaggccctgtttagatacctggcaaaattttacgccctatcatatcgaatgtttggacatatgtatggagcattaaatatagaaaaaactaattatacagattacatgtaaattgcgagacgaatcttctaagcctaattgtgtcatgatttgacaatatggtgctacagtaaacatttgctaatgacagattaattaggcttaataaattcgtctcgcggtttacaggtggattctataatttgttttattattagactgtgtttaatactttaaatgtgtgtccgtatatccgatgtaatacgccaaaactttacatctggatctaaacacagcctaaaaatattgagatatacgtggaatatcagtatatgccactcaattcgcggccctatgatccaattcgtgtgtaactttggaacctgccacgggagagcgaattccttcgtttcactccatccatccgtctgcccatccgttttacgctcgtccgcgaccgccgccgccgccgccaccttctaccaccgtacccgagctcgtccgccgccgtctccattagcgtcgtccaccagctcggccgccgtccccgagctcgcgtcgtcctggtgagcctctttctgattcatctctctctctcccaccccaccgggacaatttctgtctgcaatttgctcacgttcgttcgttaaccctagcttctcttctagatctggaagaagctatttcagagccttaaccttaatacaagtaacagtttattgtttgtttcccccaaaatttgggggttcccaagttggatccgccccctgcttcgtcgcaagagaaattctccttttcatttgagtttgtagagcttttcaatggagtatacatcaagtgaggatgatgagctggttgaaggttacatggatgttgaggatgatacaggcaccagcaatactgatcaaggaacaggtctgatgccttctgagatgcgtagcatccttccccgtccgtcgtctgttggcaacggtcggctgatggctgctgatgggttgggcacaaacgatgacccatgcctaggcatggagtttgagtccgatggagctgcacgggcattctacaatgcgtatgcgctgcgccttgggttcggcatccgcgtcgcccggtcgcgcagcgagcggaggaagggtgttgagctacttatcatgaagcgttttgtgtgcctgaaagagggacatcacaagaagaaggatgccgagcctagcgacaagaaaaagaggaagcggctctcgataagggatggctgtccagcgatgatggaagtggtgaggaggggtccggaaaaatgggtcatcacaaagttggtcctggagcatactcatgtgattcttagcccagacagggtgcgggaggtccagctccgtcgcctctctggaaagtgcgcagagcatgataatcaattgcaggagctgcgccggaatgtgtttggagatacagatgcgcaaggccttttcaactacttgaagagaatgcagtcggagaactctggttttttctactccatacaagttgacagtaagaactgtgttagcaatgcagtttgggctgatgctagagccagaatgtcatacacatactttggggatgctgtttattttgacactacttatagtaaaaatgagaatatgttaccctttgcagctttcacgggtgtgaatcaccatggtgatactgttccttttggttgtgcacttgttttggataggacagaatcttcatatacctggctatttgagacatggctgacagcagtgggtagacggttgccgttttcctttacaactgatgaaggcaaagcaattgcatcagcagttgcaaaagtatttcctcagtgtttccatcgtctttgtagatggcgaattttgtctagatgcaagaagaagttgtctgacgactacgtgagatttcccaatctccatgatgagctcagaagatgcatcaacgagtgttatactgaggttgcttttgatatgttctggggtactattcttgacaaatatggcctgagggagaacagttggttgcgatcaatatttgaagcaagacacagatgggttcctgcatacctgacaacaagctccttctttgcagaattgacattgacccagagaggagaaacaatcggtaggttttttaggaataacttcagcacaagagttcctctcgatgaatttaccactaaatttgaccaacacatagacaatttgtatgtacatgaaactcagaaagatcttggttcatctcatccggaacagatcctgaaaaccaatatagccttggaaaaacaagcaaggagcatctacaccaatgccgtgtttgaaatattccaaacggagttgtttgaagcattgcagcattatgctgttaaggttcatcaggatggaccttactccaagtactatgttgacagagatgatcctccaacaaggcacactgttttctacaatgttgccgagaagaaggcttggtgcgattgctgcaggtacgctttctcagcaatattgtgcaggcatgtgcttggagttttcatcttagctggaatcatggtgcttccggagacatgcatcgcgaagcgatggacaaagagggcaaagactgggccagaattaattgggcataatcttgagaatggaaattgctacatggattcttcaacttcaaggtataatgatctcattcatgatgctatcaaatgtgcagagaagggagctgtatcagcagataacttcagagttgcaaaggaaatactccgcaaagccttcatggaaatcaagtgtcttggagaaaaactgactgacgatgacctgcagcaggttgacagtagatagcagtggttatcttgtgaagcatttgagagattgttccagatatcttttactaaaggatggaaatgaggcgtaattttgctgtgccaccatgagtaaaagcatttgagagattgttccaggtatcttttattaaaggatggaaatgagatgtaattttgctgtgccaccatgggcaagcctaccctgtactgacaatgaccaattaacatatttaaccactgtaaatctaatcctgatgtatgctgttagcctgtctgtagaatgctaatctgacttgtgggagtcaggactgtaaatgttgactcgtttgcctgtgttcctcttgctgctattcatgtcatgatatcacaactcacaaaaagttatgttggactcgccatgcttgtagggttttttcttcataaaaagagttacagacatcgtttcttgtttattttgaaaattgatccatttggagtaagcctttgttgttaaatatacaaagtttattgcgttctttaatgagaattcgaaattcggatgaattccttcatgcaaaatcttgacataaaccaacacattagacctttcgtcttgtttgttcgtaataagctttctggtagtatctgctaccttccgattctatggctacaaaacaaaatttacaaagcccctatcatgtttaaacacgacaaaaagaaaatctcctggctcaaattttaacacgccgcagaattcacgaaaattcaaaaaccaataaaaaatcgcaaaaatccaacgggaaaaaggagacgcaggaggaaagggagagagagagagaacaaacggcatcaatggcggccacatccctcctctcccgcctcctcatcctcccaccaccggcgccggccgccgccgcctctctccggcagcggaaacccgccgcagcgcactccctatcctccaggggggcggaggccccgcctcgcggtacaggcggtagcccccgcggcggcggaggaggagaagggcgggctgccggcggcggaggcggaaaggctggcggagttcctgcgggaggacctcccccacctgttcgacgacgtcggcgtcgaccgctcggcgtacgacgaccgcgtccgcttccgcgaccccatcacccgccacgacaccatcgacggctacctcctcaacatccgcctcctcaagctcctcttccgtcccgacttctacctccaccacgtcgagcaggttgagctgctaccccgcactgcatttcccaatttcaatcgtaacagatttgcagcgcattttgcgaagaactcgtgactggatgggtggtggggtttttagacagggccgtacgagatcaccacgaggtggaccatggtgatgaagttcgttctactgccgtggaagccggagctggtcttcactggcctctcgatcatgggcgtcaaccctcagaatctcaagttctgtagccacgtggttagcattcttgcttgacactgcagcttttggaacatttgtttcttcgaattaatgtacgttaagattttcttttattgttcatgaaatgaattagtggtattttaatcccctgaatcatatgtatggatcacgtcttacagagtctactatatgttagaaccataggtctcctgcttgcgacattcgagacctctgagatgaagcatatatattaagcatatgcagcttagaagttaaagtcttaaaagagtacggtttcttttatcaagagcattagtaagcagtcagtctggagtaagatttcgagagatgagatcagggagttcctgacaaagctttcagacaagctttagttgcatacttatgtttagctatgtcaaataactttttattgttgcaattctccaccggatacagttcctcctataatgcaatgcttcatagtcctaattcaatttgatactaaattttagcttttcaggaagcttgtgggactatttattgatgggccggcaaaacaatacttagcttccatagtccacacttgataaagtttcaatactcttaataattgcacttgctgtgatgtgccgtagagttcctggttctaacttatttgttttttcccccccgtttagtgtgcatttttgtaaatagaagattaaggatactatgcttcccagcagagtgttggagagattttgtacatacagagaactccaacacactaaataagtttacccaagtaatcattaaatattattataccttcccaatatgctgaagtgcaggatatttgggactcaatacagaataatgaatatttttcttttgaaggactgggggatgtcttcaagcaggtcatttgtcatgactctacatttttcttataatttgtcaaacaaatgtttgagctagatcttttgattctgcacagctacggatttacaagacccctgatatagaaacaccaaagtaccttatcctgaaaaggacggcaaactatgaggtattaactttaggaattcattttatatctgttctgaagtaacagcactgccatattctcatgatccatgcttcatatgaattaaccatactgataagtatccgaattattttacttgatttttgccagtgtataatctttgctaatgtgatctctatagtagtcagaactcagaacatctaatttatagctgttacttctctgcagaatgtttaagatgaaatcatgaacataaattcttttttgcagattaggagttatccaccattcttaatagttgaagcaaaaggagataaactaaccggatcatcaggttttaataatgtaactgggtgagttatttttctgttacagtagatatttaaccctgtaatcctagtactgattacttataagcgcttgtaaatgtaggtatatttttggcaagaatgcttcttcagaaacgattgcaatgactacacctgtcttcactcaggcttctgatgacaaactaatcgatgtatccatccagatagttttgccgatgaacaaagacttggacaggtctatcttgtgcaatgcaggatttcagtaactgacagtccggtttaaggcattgattttggacagctgtgcaaaattaaactaaaagtagtcttatgatttatttctattactaatagtagtaatcttgttcaatcagcttaccagctccaaacacggaagctgtcaacttgcgaaaggtagaaggtggcattgctgcagtgaaaaaattcagtgggagaccaaaaggagaaattgtgatccacaaagaaaaggagctgcgctcccaattactcaaagatgtgttgaagcctcaacatggttgtttgcttgcacgctacaatgatcctagaacacagagctttataatggtatgtttccttttgggctgtcccttatttgttaagctgacatgtgatttttttgatgtacttcactataatgatcctaagactaactaatgaggtttattttatgattaagtgttggaaagtgatattttatcatcatgcttcctttcccaaaattcagttcattcttttttcagttttacatttcaagttcctttttttcagttttacattcattgttatcttttttaattcgaaaactctcttatgttcttccttatcaaaagaggaatgaggtgctgatatggtaaacgacttcacgctgagtagtagtcttcactgtctacaacacatttctgcaacatatagacacttagcattggagctttcggagcatcatagcaaggtaaagtaattgttcataaagcattttgcgtggtttggtagtattttaaagctgcatgttatttcctctaaaaaagctttgtattctacatgtaaaaaaaatgtagaaacaatttatgtatctaaatgtatcgtgcaacttagttattcccatagatccgtcatgccttttgtcatccatgttttaattttttgcattatgctcatttagcttttgcattatgcaggtgaaaaaaattaggaagatgcatggatgaaatgataggagaatgtaaataccgaaaaggtcactatattacatggtaattctagtccatatgaaaaatgtttgtgtataacaaaagtgaaatgaacaaaatgaaactgtttagaacaaaaggaataacccccacctagccaccctcattcccagtgacatgcctggctgtaacacgtctcttctgtctttcttcctcttccccacatctccaagtaacataagatgataagaacatacagaataggccagggtttgaagatccgtcagttaagatccttactaggattctttcatgtcacaccaagtgaccaaacaacacatcttaaagcattgcctccaactttgacccccccccctttttttttgcggggacaactttgacaccctttgttggaacaaccggttacttcagaccacttgggttagtgttgagttggagtacttcgaactatctatggagtattaggagttaaaatttggatattcgtagacgaagaataaccaaccctgtcttcccattctgttcagtaatagaataaaaaatgacaagagccttattttccctaaaatccctgaaaaaaagaagaaattctacctctttctataagatttaatgaaaattgagaaatcttttaataaaattgctattgat

SEQ ID NO: 30281 - DNA, 19432 bp, Oryza sativa
  unsure (1)..(19432): unsure at all n locations
nnnnnnnnnnnnnnnnnnnnnnnnnnnnnnnnnnnnnnnnnnnnnnnnnnnnnnnnnnnnnnnnnnnnnnnnnnnnngcacaaaaaaacctctcaggccttattcctgattctattggcaaccttgcccaactaaccgagtttcatctagatgggaacaacttcaatgggagcataccttcaaacttagggcagtggagacaattagagaagcttgatttgtcccacaattcattcggtgaaagcctgccaagtgaggtcttcaacatttcttccctgtcacaaagtttggacttgtcccacaatttgtttactgggcccataccactagaaattggcaacctcataaatcttggaagcatcagtatttcaaacaatcgcttgaccggggaaataccgtccactctagggaattgcgtgcttttggaataccttcacatggaagggaaccttcttactggaagcattccacaatctttcatgaacttaaaaagcatcaaggagctggatctctctcgtaacagcttgtcaggaaaagttccagagttcctcactctcttaagttctttgcagaaactcaacctttcattcaatgactttgaagggccaataccatcaaatggtgtctttggtaatgctagcagggctatcttggacggaaactacagattgtgtgtgaatgatccagggtatagcctgcccctttgccgtgaatcaggatcacaaagtaaacacaagtctactattttgaaaatagtaattccaatcgcagtgtctgttgtaattttattgttatgtttaatggctgttctcatcaagagaagaaaacaaaaaccatctttgcagcaatccagtgtgaacatgagaaagatatcatatgaagatattgccaatgcaacagatgggttctctcccacaaatttggttggtttgggatcctttggggctgtttacaagggcatgttgccgtttgagaccaatccagttgctattaaggttttcgatcttaacaagtacggagcacccacaagcttcaatgcggagtgcgaggcattaagatatattcgccatcgaaatcttgtcaaaatcattactttatgctctacgattgatccaaatggctatgattttaaagcacttgtctttcagtatatgccaaatggaagtctggaaatgtggctacatccagaggaccatggacatggtaaaaagagattcctaactttgggtgaaaggattagcttagccttggacattgcatacgctttagattatcttcacaaccagtgtgtatccccactaatacattgtgacatcaaaccaagcaatgttcttttggatcttgaaatgactgcatatgtcagtgactttgggttggcaagatttatgggtgctaattcaacagcagcgcctggtaactctacaagtttggctgacttaaaaggatccattggatatattgcaccaggtgagagaaattggaaacttatactgatttattgacctgtatgcttcagccatcttattaacttatccaatgttacatggattgtagttttcctccattcgccattcttatgttttcaaatgaaaatgcagagtacggaatgggtgggcaaatatcaacgaagggtgatgtctacagctatggagtgttgttgttagagatattaactggaaagcgtccaactgatgaaaaattcaatgatggtttgagcctccacgatcgtgtggatgctgcatttccccacagagtaactgagattttagaccccaacatgctacacaatgatttggatggtggaaactccgaactgatgcaaagttgtgtcctcccattggttaaggtggccctcatgtgctccatggcatcaccaaaagaccggttagggatggcacaagtttctactgaactacagtccatcaagcaagcattccttgagctttccagtggaggaaaagtagtgtgaataactccccggtggtgtgcaaagctatgttgctttgcaactactgtgtaaggctacttctattaccataactaagcctatatataaacaggggcagacacagcagggggtcaaatagggctcaggcacacctactgccgccaggccccctggaaaccataccttattcaggaaccaagtccacactaatacaagccaatctcatggcttcacggtacagtattgcgtataggctgcagccactcgttcaagggaggcaagcagacacatgtcaacacagatttagcagccattgatgctagtattggtcatcaacagatctaacccaattaaaccatttttgctaacttttcttagctcagcccatgacagtataaatcaacaacaaaagctttgataatgttcatgacttagtggtactacgtattttaatgataatcttatattggtcttttaaactagcacctcctaaaattttgttctgcgttctccactgtatataaataacctcatgaatctattatgtgtttaggaattaggacagcaccaaatgcaatgttagcaggctgtcgacacacccaagatatggttacaattccacggtagttagtcagcggcacaactcacaccacacaacaggcataataacgcgcatagagcaaaacgggcacacagctgcgcccgcccaagtgcgttagtgcgtgctgcgcgctactactttcagaggcatttccacaaacacgccacgcgcgttcgaagtccatacacgaaatccagcacacacaggcatacgcaaaaaattcagaaaagcagtagcacgctgaccttggagaagacggcgccggcctggcaaacctgccgccttccgccgcgcctgcgccgcccatcgtctcgtcttcctccgccgctccgcggcggcgcgacagggtcgacgccgtcgaagagttggagaaagagagaaagggagggtgacaaaacaaggttgggtcgggccttgttgatgttgggctgtgggcaggccgtcctcatagatgtattccattctctctcttaattaactttctagtagcaagttttttttcctctcaaaaaaatctcatgtaaattccaaacttttttttcattttattttttaaaaattacatatttttttcatttaagggaagacatacacatgcgcatatacgcatgaatgtgcgctttaacacatcctataagaaacactcttaatatagttacaattttattgaaagcattttcgtggtgtgatatttatgagcagcatgatttgaaccagatgaaccaccacatatcggtctttcctagtttcaaataattttattcgtatgagcagatagttcatctttattcaacagtttcagatacgtttggagcaaatttacatagactcgaatacaaacttttgggcatgaatttctagctatgtgctatttttttaataatgaaaatagattatatctccagtctttggcaatggacacacatcaacaagtttcagaagaatttaaaatagatgtgatctatgtgctacttaggccctgtttgggagagtttgtcccagctgcagcttttcctaaaagctgcttctgctagaagctgccccaaacagtctaagattctgaaaaatgaactaaaaagccagaagatataaaagctaggtttcagagcttttccagattctcagaagctggctaccaaacagctgcttctcaaaatttaaagctcccccaaataaacccttagattggcttgctatgtcctggggcctggccaacgatacattccacgtcgacctacggaagcaaaagcaattcagtttataataatgctgctataaatttagaggggaaaagtgaaggaatatttacatatacttttatgggtacaaacggacgattttcctaccatgttttttcgaggattcttaattatcaactttaaaaatagtaccaagtcatggtactatttataacctaggaaaagttctatgattaatatttagacaaataagttcgatacatcttattagttatatgtatataggattatatcttgtgcacccaagatggttaaagtgtcgtacttgaaaagaaagatggttaaaaggctcttcttttttctacatgtaactacattttctggtggaatacacttgcctgtcggcatgtattggttgccatgcacggacgagattggaggattgtgagccccgttgggaccactaccatatccatctccatgttctacaaagcaattatgtaaattttaaaccaagttgaatttcgtgtattagaatatgttatatttttccttaactaatagctaaccgatgttatatgtagatatttcctctggttctaatatgcagtacagttgagtagttttacagcttttatacaccttttctatttccattccatgtttattaccctttccaaaatgctactactttcaaaaataaaattgtctcatattttaaagaaaactcttacatatttttctagattgataaactattttttctacaagtagctaaattttcaagtgaaatacacttgcctataggtatgtacgggttgttgtacacgtaagagattggaggctcgtgaaccccgccgggtccaccacctccggctccacttccatatccacctccaccttttacaaaatcaacatctttaaataaatttatgcagtaaatttttaaacatggttttgttttgagtattaatatattatttttttcctttacccaataggcagcatatgttcatatatgactatttcctcttatccgaaatgcattgcaagtagtttcagaacgtctatacactattttaccttttatttcaagtttatccttttcataaataaatgtcccatatttctatagtaaaatataaatgaaagacaataaaataatctaatataccattttaaacttctattagtaatgttaaaaaccaataacttcatctgaaaccagagtacaaatcagaggaaatgttccaccggcgtgcgtcctcaccagcgaaagggccaccgccgccggccaccggcggcgcccactgcggagggaagaagggcggcggcggcggcggcgagagcgcgagcgaaagcgacgacggcagcagcagtagtaggaccgacatggccgacgccgctggcgctcgtagcccgaagcgaagccgacgagctgctcccatggccgcagatggagctcgctctactacacttgatcaatcgctctctgaaatctgaagctggtagatcactcggctgtagttctcacgtccaaggctttgccccccatatatatacaagataaacgcaacgacgcggttttgctatgacaatgcagcttctctacttgctacttgctagccagctaggagtgggcagtccatcagtcaatagagtagtatacagttcgaactgtagtgtcaaatcctgctcaatcagccacaggttctgattataatgtatactaatattatgcttgttttgagaggacgaacaagtggattgattctgcgtctgaccactgaaagattaggcctgaagtttccctaaggtataccaaacagaatctgcttgggatttgtaaaagaaaatgagccaaagagccttccaagttccaacataaaaagctctccacaataacgacggtgacaaaaatcaaggaggaagtcaagacctgagcttcaggtacaatagcaggctataagtcagctgcaaacatattttaaggagataaatgagaaaagagaagagcagcggactacatatttgtagccagctgtaacacgaactccaagacacagtgtgtacgataggtgggatcaggtattaatagtgtagtgtgtaactattgtataaatgagctattagattggctatagatgaattgtagccagtagttggctatactcctaaacttgctcttagccagagcgaaacgtctctcgaagctaggggtagtagtgaattagggcccgtgggcgctttcacaacccacttcagcctttaaatatttttagctaaaaaatgtattaatttttagtacaactctttttgaactcagcccttgcattttgccacccctgctcatagctcatccttggttttactttttgtgcggttctcctttttacttatacaaaatttttactcctactttattcaatgaaattaggacatctagtactggttcgttaaaaaaacaagaagttccccaacatcttaggctactccaaccatgagatgaacaattcttcatggttactgatcaggccacggaggatgatgcactgtcactctccctggcaactctgatgaagacatcctccagcgttgtgtcagccaagccccaggcaagaacgttcatcctgagcttcgcatgctccatggcccggaaaacttgagagatcctcacctcctgcttcgccatctcgaacttctgcgtcccggagatgtggtacacaatgttcatggtaggggagatggactggaccagtctcctcatctcctccgcctcgcctgtcgcggttgttactgtgaggacatatgagcctccatattttgctttcagctggaaaggcgagattttgggggttcaagttactaagttagcatttgggatcaatggccatatatgaaatatgtgatcagtttacatgtgtagatgtacctctttagagttcccgatgcattgcaagctgccgtttgcgataattcctatccgatcgcatagaaattcagcttcttccatcgaatgcgctggaaataggtgaaagtatgatgtgataatatgatgtggtgcaaaagatttccatggtgattaactggactaaggttatactgttgtatcagagttgaaagcaaagtgcagtacttgtgagaattatggccctgtcctgcttggcagacttgacagcattccacaagtctttccttgatgctgggtccaaccctgagcttggttcatccatataaactacctgcagaatgttaaaaaatgcatgatttatacatgcaagaatgttcaaaatttccctgaatttgacatatatgaattgtaccttagggtcaccaattagagagattgcaacactgagacgacgtttcatgccaccactgtatttgcttacaagcttatcggcaatgccaccagcaaacaggcgcacacttttcaaagatttctcaatggcctataaaataagaaatatgagatcttagatgattgcttcagaacttgtattttataataatttctcgtgaaatcataaccacataagaacagaataactactgggaaaatgtttgttgaaccagtatttataataatctgtgctaaagcgccttggacgataatgtgtcttggatcttatgtgcagatgataagctcatctttcacttgtaaatagtgtttgaagtcgaatccatcatgttcatccatggaaaaaaatcaccatatattacttcttccgacattattgactttattgggtcaaacttttaaaactttgactatcaatagctctcaagatatttagtttgaaaacataaaaatcatatgggtagaattttacttataaattataattgcttttacaatattatagtttcgttagatattatcgctatattccaaaataaaaatagtagctaaagttgtgcactaagactggataaaatcaacaaaattatatatttaaatacagaggtagtacgttatttaccaaatggtcacatattacctgagataatggtgcaccccgcaaattcttaagtctaccatagaacaacagatgctcgcgaccagtcagtgtttcccatagcaagctgcaacaagaaaataaaagaagggggaaatttaatttaagttcaccaatactaaattgccttaaaggctgtcctaaactaaacaaaactgtaattcagaaacatcagagtgagattagattactcatgctgtggacaaacaccgattcctgcataaatcttgttcatctcgaattgtatgtccattccttcaatgtacgccgtgccagacgtaggtttagtaaatccagtcaactgttgtcaggataagaattaacccccttaaccaataatgtcatgtgaccaaatgaaacatcagttatatttgtaagtaatctatatagggatcatttgtgacaaacagaaaatctggatcatttcttactacctagacatgttttcagatttttagaaatgtatatgcctgttcctggccttgaaagtggcctgtactttacatactagagatttatggctatctaaatatattatttatttcttttattattaagatctaaaattaaatcatacttaccatgttaataagagtggtttttccagcgccatttggtccaagaacaccaaaacattgcccacgtggcatagaaagagatagccctctgacagcaattttttttgcattcccatcttttccatggtacactttcttaaggttgtcacagatgatcgagtagctattctttgattcttgtaagatctgttcaaccgtttctctctgagaaatcatgatagaacaaaattaatactcatgatgctctgtgcaaatacatacatgcaggactaatttcaacatattatgcttgtttaaactatcttatgtatttgtattccatacagcattgaagtttggtaaaaagaaaaaaggaaggtaaaaataagataaagtgagactccaagtatccaagctaacttttgacgtgccatactataaaggataaactgacatataagctgcttctagcctatgattagaaagcttaacataaatggtcagaaagaccaggagtcttaccagctagcaccacaagttggtgggctagccggtctgggttcgagacttacccctgcttaataccatcaatatgaatatccttcctttcatatccatcattttctttagaaattacaggaatatacagaacaaaagagcatacctctttgataacatctgtcttctcattgtcagcagaagctttgaactcttgaagctggatggtctgctgagtagcttgaaaacgattcttatcaatgtgcgagtgaaatagtactgctgcttttcttattcccttttggaaggaaccgaagtgatccaaatagaatgccaataaaaggaacagaaaccattctagtaccattatggtcaaaacacttctcattccatttttgggatcattcaagtcaacccacttcatcccggaagagttcatataattcccgagcaatgcagattgtgcaaactcatagataatgcgatacaatgaaaatgcagggaaaagctccaaaagtgtaatccagcttccttgagacgaacaaatacaaaatttccacaaaattattggaaaatagtgatagacactgacatgagaaaaacactaaaatcatagatattggctgcataaaaatatcccacatatttatctttactaattagacaccaccattttaatcctacattcatcgggtataaagaaccatctgttatatgcaaaggaaaacatgcattttttttagataatgaaacaaaatacagctttgattcaaaaagacagtatgtttttattgattattaagtagattcaactgaaaaaaaatgatttctattaaaggaaaactaagaaagttaccatgacgacagctcatagcctcatacacagccaaataaaaagaaagatcctatggccactatagcaagactagcaagagaaaaacataagcacaattgtaataatggaagggacaaaatggatacagcgaacaaagaattacggtatcattgtaaaagataaacttgtacatacttgagaggaaaacatcttcaacataggacctgaataagaattctcctaaaaggccagaaccaattatgtagaagtatcctgtcactgaggcacaatatgccaaataatcaaagtaaatttcataatctgacaaaatggatatactgagattacttatatatcaaagcataccagtagctgtgctcacactagaaaagcatgacgcagtaagaaatgcgaacgaaatttgtaaattcatataggcgaagtaatacacaaactgcacactgtagtcgttcagtcgaaagaatcttaaacctgaaaacagataaaggtacaagcataagcaacttgcctccaatttataatttttccatgaggtttcttttttcttgtatcaaaccaggaactaagaaaaataggtgaaatatcagaattctgagaccaaaatcactgaatacatcctagataaaaaagattgtcttaccaagaacagaaccaaataatgtgaaggacatcacatagagcagcgaaagaagaaaaaaatagcagtacgagatagtccaatatgaaaaatcaccaagaccatgcatcttcatcataatccttagcttcttttgcttctcgtatacaatgttggtcaaaattacctagagtattaattcattaaacattacaaattaagcttgcagctcagttatttgcttgtaaaagtgtcacaaaaagtcacacatgattcaaataaactggtgcaatattcataccgggaaaagaagttccatagtccatacataaggaagttgccctattaatgaggatatatcaattggcctcattggtcgagctgctctgggcatgtctttgacaaaatcaaatgagatcttgaggccactggcccttaggtgaaggtatgcatttgaagcctgcaatgtttaaactatatgaaatgcagagcagtgatgaagcataagaaatcatcaaatagctagtaaacagaatagtacacaaatgagtggtaaaatacagatttgagaatggtatgcgtgcaacactgataaggttatatatgcgatgatatatggacaaatattcatgaacaattagggaggatataatgaatgtaaattatcgacatgtccaacttttcaacttggaaaaaaggataccatattgattagtcgtgaaacttgaaccaatctaggtgcttgccatgctccttgattaaaagtgagtgagatgtcttgttcataagcatcaaacttttttgttgagttatacgagatgaacacgttaaagttgccttgatcagaacttaagaagtcataagctgcaaacaatgaattcaatgttaatgagtggcagatttgaagaactgattgagggcacattggagattacctgcagcgatttcattggtcttcttcttattatttccttggtagtaacctctatagagttcatcgttgatgagccacaaactgtcacgccagagcattaatccttgggtacattgcacatctattccatgtccaagtaaacattagaataactaagttgtaataacattgctagttttgaaaacagagaaaatgtctgtaaatgaatttattcacttttccatgttcattagaaccttaatagaccagtattgagaatagttgacaccattggtacggcacatttttctactaaacaatgtgcaacccaacttttgtatcttacatgtagaaaaacttacgtttagtctcggttgtattgccactttgatatgtaaaagaaagtgtctggtttggggtgcatgtcttctgaagaaaggagctgacttcaaaggaattgaaatccaactcatcatctgcctctgcctgcaattatagatacatcacaaaatgcctcaacacttttccatcttctaaacatacgcagcactaatacatactattctttaaaaaaaaagatcaaccagaacaaaggtcacactgaaatcaaggacactaaccagaacataatcagacaaagcggaaatgtcagacggtagtttcgccgaagaattatgagcagggaacatattgtccatcacccctgcatgcagatcaagctatcaaagactgaaagactgttcaccgtcagagtaaaactacaagtcaacatatgcatgtcaatagagatcggagatgtaaaccattttcagtcttaaaaaaggagaaattttatagtccttaaaaagtatccggatgtacctagattttacattttagtacctcgagatacctactacttagagatatcaagttttacatttgaaaatatgtttatatccagactcataatgctactcgttagtatcctattttatactaggtaaacactcctttaggacgatcttgtaaacacttgtaaccctcattttcttcttaataaaatttggtcggccaatccttcggccgacccggtaattttatactaggtagcaatattttaggacgaagatagtacttcccgatacatttttaaggatggtaaatttttttttaaaaaaaataaaacaacgggacaagagcacaaccttgtaactgcaccaaaagaaaagaaaaaggagcatacttgctacaaacgatcggttgccgccggtgacaaggaaggcggcggcgcaggacccggcggctctgcacgaggcggcgtcggggagatcgccggcggacgagaggaggtccccgtccccgacggcgcggcgctccggcggcgggatctgcagaaggggcggccacttgggggcacgcggcagcgcgcaccgcgtcgggcagtccaacccccccgtggcgttcgccgccacggcaacgccgccgccgcacccgccgcagtcgatggaggcggcggcggcgaactcccgcagcatctcgacgttgatggcgatctggaggcccccgatggccgagaagaggagcagcgggaagaggacgatgcagcagttcgtcttccccgcccgcctctgcacacaagaacagcaaaatcgagctccatgggtgactaatcttgacgaagaaaaacaatcttggtatgaacaaacatagcaaaatgggtgggaaatcgaatcttggaatcagaaaaaaaaacaaaaaatcgtgcagcatcggaatcaccgcattgaacataacgagaactaatcccctgaacatgcgacttcttttcacccaaatccgcgagcagaaaaaaaaccaccactaaacaagaagcatttcttcactgattctaagtttctgactactgaatcatccaagcaagataacgaagaagccacaaaaatgttctttcaaagaaaggcataattctgctgataaaaactctacggctcgacgaaatcgagcccgaaaaacgaagagcaagatcgatcgagaggccatcaggccatcacctggatgacgaggcttttcctgaagagggcattggtctgcgcgaggcagctggctgccatggcgctcgcagctcgcagctcgcctcctccaacctcggagaagccgaagcaacaagagaagagacgcagacgctacactctcaaaccggcctgagtgtgagtggagcgaggcggcaacgttaatacgggggaaaagctttgcctcagcgaaatgacggttttgccctcggagagaggcggcaacgttaatacgggggcaagctttgcctcaccgtaatgacggttttgcccttgggagtgaaggaaagtggccgcaagtgggtcgtcgtcaactcgtcatcagtcgtcgcgagtcaaaggggaaatgacgatcacgagttttttttttcttggtatgaaaagaaagaggaaatgtgttgcaaatttgggtgacctgaattaatacgcggtctcattgttgggtgggtatttgctttttttatttgggggaataaagatggttttggcatagctatctatctacagcattgaatgtgtgaggacttgagaatgtgatttgaaagacattattggctaggcctgtgtgagatgtgatttgtaaaccattattgattttaaatttcaaaattaatttattgtttttaattttatgtttttaacctcacacatttaaacaatgaagaatactggtataaaagttttgccaaaattatttttttcaatgttcgatcaaataatttgtggctgagttcgtttgctgcagttgggaactaatctcccgtgtacacaaaacggagaaactcattagcacatgattaattcactactatacaaaagatttttcattgcagaactggtcgcgtttaggaaaatatgacctatttttacgtgcggtccatttaagaggaccacatggaaaaatcgatttttccgtgtggtctttggacagcatattttcacgtaccgacctattaagagaactactcggaaaaatacccaccctctctttccctcctacccactttctctcctctcctctttttctcatctcctctattactgtctccactttcgctcctgccctctgctctcctcccctccccttccttccctccccgacgacggtagtggcggcggcgtggcgacggcacgcgggatctggcgggtggtggccaagccccacaaggatccagcggccagctgccctcccccgcgggatcccgctcccctcccctccccttccttccctccccagatccagcagaggggagggcgttggcggcggtgcggcaggaagggagcgcggaggtcggcgggagggcgaatccgtcggccggcggcgcagaggccgccgccgccgatgatgagagcgggagcggcgtcctcagccgccgctgacaatgaggaagacaatgaggaggacgacgatgacgaggaggaggaagaggcgatggcgccgccaccggattcgtttttttgaaaaaaaaatttccggatttttgtttttccgtgcgggcaacataagcacctgcacgcaaaaatcgcgattttcgcagaccgttggattcgtgcgggccgcccacccacacgggaaagccggtctcgtagtagtgattaagaattagcttttttcgaaaaatagattaatataattttttaaaacaactttaataaaaaaatttatttagccgtttgaaaagcatgcatgagttggaaaaggaaacaaacaaacacaacctcatttgtcttccaggcgtacttttcacattggcacgttgatcccatatgaatcaagagcataaattccaggttgcaaatttagcatccgaattgcttatttcatttcattcatcaaaatatcttcacaaaataggatggaagaaataaaaatctacacgacgcacgcgtgtcactctctgcaaattatcttcatgtcgccacgggcatgtcgtactgcctgtatccatctcttcaccagcctagcgccgccggcacggcggcgcgggggcggccggacggcgcgacgatgttgccggcggcgtcgtagttgatgacgccggagaactcggggagctggcacttgccgcccatgaggatgttcttctgccagacgcacgacggcggcccgcccagcccgtcgtccgccagctcgccgccggcgccgacgccgacgacgccgggctgcacctggtggatgctgacgatcaccggctccgtcctccgccggctcacgctcgccagcgcgcgccgcagccgctccggcgccgcgtgcgacgcgcacagcgccagcgccagcgcgcacacggccaggaacgccgccgccgccgcgccgagcttcccgcacgccgccgccgcggccaccgccggcgtcgcagcgtgcaggacgaggtggtggcgcgccattgctagctagctaattgcaattttctcgtgtgcgagagatcgttcaggctcgcgtcgttggtggtgtgtcttcctgtgatttggagctcgctagatttttatactaggtgaggactagctagagtttttttttttaaaaaaaaatgttcccgcgctttttgtggagttgttttacttgcttgcaaggagcagcagtgcatggagttggtaagggtagtttgctagctcaaacttgcctaactcaacctgaaccatttcacttttcaagtcttgtggattgccaaggtgaggtgacactgtacatatctgtaagctgcaagcctgctcctactagaaattgatgtaggtcttgtttagattcaaaaatttttggcaaaaaaatataacatcaaatgtttggacacatgtatagggcattaaatatggggaaaaaaactaattgcacagtttgcatgtaaattgcgagacgaatcttttgagcctaattacgccatgatttaaaaatatgatgctacattaaacatttgttaatgacggattaattagacttaataaatttgtctcgtagtttacagacgaaatttgtaatttattttgttattagtctacgattaatatttttaatgtgtgtccggatccttcaaaaactttaaacacacccttagtactgtagcttttttgtggcagatgtaagttaagggtgcaggatggctattgttttgcttcactgggagtgagcgttaactgttttgttgttttcacatcatcaatactccatataggaggaaaaagtgatccatatctctatatggtcttgctcaagtactgtggaagtgagccacatatagcagttcatatgtatatgagcagaccataagaataaaaaagtaataatattctcttctaagttcccatcatatgctggtgggtcccatattaaagtttacacatcataaaagttgaaataacaagagctcactgcttggtaaatacagcactgcttgtgatgagataaaaggaaaccttattgatcttaaagaagatgatataaatactccaagactacctctagcctctctacctaggatgcacttaacctatatttattgaaaaattaagaatgaaaaaagaacgacatgataacgaatatcgagctacaagcctacaaccacaagcgattttcatcctcataccacaccgaagcaacactcggactgcttcgtgattattgcccaatagtgaacaaatagaaaatacctcaaggtgttgccatttttgctgttatctctcaagcaatccaatcctagttcttgttcgacaagaagaattgtgatgtttgacatgcatttttcatttccatgagtgtgaggatctagatatatcatatatcatggttttggttttctttattcatgattactctatctacaacacaagtctctgcataagttcatcatattgccgttttgccattccattccattccaaacaagaaaaatactagtgaccaaggctgttttccagttcatacggcgcataataaatcaattggagtgacaaatgctaattcaaacttcaaagcacataactattttacgtgcaattggttcgtcgtatcccctgcttcttatcacttaactttcaatttggggcaaaactctctttcaagatcctgagggcttctccaatcccgtcctgcgaaaagcaacatgaaaaaaagttagctacagagttccttcaaagaaaaataagcatggttagcattcgtaatctgttagtgaagaacacgcctcagaagaaagtttgttagcgattctggttgcctgagctttaatttcaggtgataatgccgatttgatagctccaatcagcatatctgcagcactgttgatgcttgaggcattgtcagtatccggaattagatgttgtcttcctaggggctcaggtgccactcctagccagtgtagcctttctgcccagtaaaactgatccagcaggaaaggacatgaaatctgcatgacaggattgtgtgagcaatctgaaaccatctaataacataattttataacagccatgtaatatgttgagtatagaatatagaacattatttgaatatttgcctgtcaccctggaccactccataggttgtttctaagtgatgtcaaaaacaagagtagaaagaacaacattgaaccacccgagtgatcaaacaatacaaaatatatcggtgcaaagctgctgtatttatcacctgagggatgccggcaaaaagtgctgcagctgtagatccactgttatggaagtattggataattagaaattctgtagagtaatgggaaaaaattttcaatcatatgctgggccacagtgagaaaatgtaaatttattttacctgccagcatggtgaatagcaactgcacatttaggaaacagccaactgtatggtattgatctgaaaaggtagtcatgtcattggccagtgcatgtacaggtttccagcaagaataaagagatttgtgatattactcacccagaaaagcaaaagagtcgaccattaaaaaggagattgctgtcacaatgaagagcagatgcctgatactcacttgattctgctactgaaggagcaaaatattgtattgcagaatctaatggctggtatccagatgagaaaaggataaatctgtaatctgttttctctatgacagctttaagcaccatcagaaatgcttttggatttctaagaaaacccatgctgcaggaggttgatgtcatgataagtataccaagaaaggcctaattcaaatttttgctaatgaaatagaagaaatttgactcctaaagttatgaaaataagcacaaaataagaacagtgagcttgtcaacagcagattcaaaatgcgcatttgtgagcggtcgatacttctaagggcatgagcgagatgtcaacttcatcaagggtgattctcgtatcttagtaaggtacaaatcagataacacttatggagaaatcatacagctctaaagtctaacaaaccaaatgttaaatatataaacatatcaaggacactgcactggctaagagaaatgtcgttgtgaaatagaaaaacagacataaattcgttagaataagaaactcacctaccaatggaacttaatcctataaatataggtaaggacgaataagaatttcccatggtaaagtgttctaggccagcatgatttacacagagagcaccaccagaattactggcatttccacacagtaactccttgcatttattacaagaaaattgccaagccataggaagaaaccaaaaaccacaaacatgagcgctgaatggccaatatcctgtcatgatgttacacaataaatatcaaactttggtttcatgtgaatgaatcctatattattatatagttcattcccactaagtatagttaatgctatttctctcttatctcatgaagctacatcatcccaattatttctactctttggatgatagatctatggtacaaacacttctttcttctctcataaaaccatacaatctcaattatttttaggctcaaaattcataagtatcaattacataaaatatgttcaccttgcattatatttgcaaccatgtgtaaattatatagaacataggaagtcattttgttttggcttagaaaatatattacagcttatttgtatatattttcctgcagcaaatacggcggggtattcatctagttaagtataaacatcctgtaaggatttaaggtagatacaaagacctcagc

SEQ ID NO: 30282 - DNA, 21941 bp, Oryza sativa
ttagactatcatttctccatgatccccaactttccatgaacaatgcccacatccagtgggtaatgtctgtccagcaaacctgacatgtttcccagcatcagttttcccggtgcaatgcagaagatgcattagaaggcaacataaggcggcatattgtccacatatatcaaagcaatacatttgataatgtgatgctaaggacaggaaacctgatgattgcggcttcaaaggatcaaatgaagatcctgattaaactttaggaattgcaataggcaggatactgctctattgtttagtattccataacaacggttactagatatcacacacacaatgtgaacttttggtaaatgctagaattgtaaaatattatcattatataagccttagcagcaagttgaaggtgtaatgctagaacataggaaaacgaaccaaccaaaagtgaaaaaaaaaagaattcaaggaggtaaaatacactagcattacattgctactagaagagcaaattttgtaccatgttcaggggagcttcttgaaagtacttgtatagaagaggaagactttgtttaaattggcgttcaaatgatgcaggtgcactacaagtaaatgaattaaagtcataacgaagacaattgaaaatatggggaaaatcctcataaaataaataaaaactggagttgaaatcagtaaagccccaagttacctgtatggaacaaaatagggagcagcaatgatgcacttaacttggaacaattctgcaagatgccaaccttcctgaattgtgagaaagatccaaattacgtatataaccacatataggacagactaacaggtatagtcctggagctgttctagtgccaaatatggatagtgcagagcaaggttctagaattatctccgattcttgcaacttaatggagtattatgaccatagaaggcatttaatagatacaccatagattattcctagataagactgactgactgactgagattgtactggaaatgttcgggtgcatcctcaaacaatgaaattccatattttcaacatgaattggtgtggcaggactgtattattacctccaatattttgaagaatgaattaagctacataaggactaactgaaagttgaaccaggagctccacaactcaacttatagcaagctttgttaatgggatcctcaccaacgcaaagaagttgatcacaatgaaatcaccatgagtgctcatgtcatttccaaaaacattttcgacggcagacaagcactctctcctgtgctccacttgaatggtctttttcctctgcgaaaaggagtcatgctcaacatttgattgaacagaatcacctatcaaaaatgcttacatgataaaccatatttgcaaaaagagaaatcacgaacatgaaattggacagacttcacggcacttacatgagatgctctcgagctgttcggcagcaaggacaggtgggcttgacacaggcatatatctaacattacagtctgctagatgtgtcgacaagctctgcatcaaattcactatgtgaaactgtgatcccagtaaagctaagccagctaggcaagtttatattgagttttagtttctacaagaatcaaacctgatgtgctgaatgtgtgatgaacactacaccatactgtcgttggtcctgcgcaaaagctgcagcaagtgcctaagaaaaagggaaaaaatatatccaaaattaggcgtatagactctaaatgggttcatcccgagctgtaaactgttcgctgtctgttcggtgacatccccatccgcaagaaaatcaagtgggattgcatcttgcgctcgaatccccacggacaaagagacgaaaaaaaatacgaagagagggaagagcgcgtacagctatggggaagacgtcgccgcgggtgccgaaggccatgaacacggcacgaggccgccggcctccgccgccgccgtccatcgcctcgttgagccgccgcaccgaaggtcggggtctctgcggcggcggcggcggctgtggcctgtgggcctttccaggtgaaaatatgggctctaaccactttccgtttgggcccagatactttcggcccagtacgtgcgcgtcctaataagctttcgcgtcgtctcctcgactctcgttcgagtgctcgtcacaggcggctccacttctccgctggtgcggcggcgacggcgacggcgacggtgccccgcgcgccggagaaggccccgcgccgcatctacgtccgatggcctcctaccaggtttgttccgtggcgctgtttctctgtacgcatgtttgcaatggcggcggcggcggcgggggtgtggcggtggaggttggtgttcgccacgcgtgcgcgtggtgtgttcgtggaaatgcccatgagggtgtcacgcgcctgcacggctgcacttggacattccagcggcaaatcaccatgttagtttctaggatttaactaggaaaacgataatgatgcaattagcagaactgcagaaacgcgtcgctggattgccgtacctttgtggattacgggggacctgaactttgggggcaaacaggggtggggaactggggattatattgctgtttcgcattgcatctgtatggtcaattgcacagggggttggattagttggcaattttggaaaaccataggctcaacaactcaacaggttcttatatcttctctttttgtcatgttttcaggatctggttaaacaacataggctatacaatatgaataatatcgtacagactaataaagtttatcccaggaacaagaatgccattacaccataccattttatggaatctcaatctaattaagaacgatagttaaaaacagcagcatacaagctcagataggaatcttaattgcaggttatggaaaaaaacagaataattggcttggtggaccaatattatttttttaataccaaatggaattcgttacaactctcaaagtgtattaaaagtagttgtacaaacatccaaattacagctgaaactattggtactattaggtggggaacaaaagttggagctagaatttttcatgcattcacctctatctgtttttgtttttatttcttcctcataaagaacaagattgcacgtcccattatgatcatttcaacaaaaagatttctgcaattgtcagtactatttaccatcgcagctagctccttgttctcattgtaactcaagaaatgactgtcttattgtgcccatttcggcagaaacctgtgacattcctaatcggtcttttggtgatatggacgaacacaacagacccagcttaaccattggtatgatgcaactctgcattatttcagtatgatattttcctccatttaggtcactctgcagcataatgggatccaaaatctcatctagtttgtgtggaaatgctgactccacgagttcatgaaggcttaagccatccttcaatttgtcatcacttggacgcttcccagttaatatctctaataagagcactccatagctgtaggcatcgcccttggttgagataggtccacccattccgtactctacatatgtatttaaaaacagaagtattcatttaataataaggaaaatcacttgaatatagtattggataagtaaatcaagtgggaaaaccttatataaattagaagaaaaatagatagtgaatggttcgtctcacctggtgcaatatatccgatggatcctttcaaatcagccaaactagttgaattggcgcatgctgcagttgtagtgcacatgaatcttgccaatccaaaatcactgacatatgccgtcatctgtagatctaacagcacattgcttggcttaaggtcacaatgtattagtggagatgcagactggttgtgaagataatctaaagcatatgctatatccagagctatgctaatccgatcacccaaagttaagacttgtttctgattatgatcatagactttctgatgcagccatgtttctaggcttccattaggcatatattgaaagatgattgctttgaattcttctcctttgggatccaaggttgaacataaggtgatgactttgacaagattgcgatgtcggatgtttttcaaggcttcacactctgcaataaagcttgaaggtcctccatgcctattgagattgaaaactttaatagctactagatcaacctcaagctccaaggtgcccttgtaaacatctccaaaggatcctgaaccaaccaagttttcagtagagaaccctttcgttgcttggacaatgtctttatatgaaattatcttcgtatccatgctaatgtctgtcaatattggcttttcttctcttcttttcaagcagacagtgagtaaacagatcagtgaaattacaagaacaatggcagcaattggaaccactatcattaaaataatggacttatgctttgttcttctgtctaatgcaggacaatgaggcagccctaactctggggtgttggcacataaaccgtcatttccttgaagggacaccctgctagcatttctgaaaatgccggttgatggaacaggtccatcaaaatcattaaaagatagattaagatccttcaaataattcatggatgcaaaaaaatctggaatgctccctgataagttgtttgaagagagatccaactccttgatgcttcttaaattcatgagaaaatgtggaatgcttcctacaaggagattttcttccatgtgaagggactctagaagcacacactttccgagagtggatggaatgttgctagtgaggcggttgttggaaatgctaaggctgccaagatttatgagacctccaatctccagtggtataggcccagcaaaggaattatgcgacaagtccaagctttgtgacagtgaagaaatattaaatacctcgcttggtatgcttccaccaaatgaattgtgagaaagattcaacttctctaaatgtctccattgccctaaacttgctggtatagtcccactgaagttgtttccatccaaatataactcggttagttttacaaggttgccaatggaatcaggaacatggccagagagattattttgtgcaaagcttagaaccagtaagttgcttagatttcctacggaaggagggattgtaccagtgaacaaattttgatccatatacagcacttcgaggctcctaaggtttccaatctccaagggaattgtcccagaaagtttgttttgcttgagccagagccacttgagctccgagggaagattaccaactgagcttggcaagtgtccttgcagtccattcccatccaagcagagtctttgcagctgagtgcagtttgcaagggatgagaggaagctccagtcacccgcctcaagctggttatatgcgagatcaagttgttgcaagtgtgacaaggaaccaaaggatggcagtattccagtgagcccaatatcaacaagatgaattatttctagcttagaagcattaacaagagaagctgggattggtccactcaaacgtgtttttgataggatcaatctctgaaggtttggaagcttgtagccaatatctggtggcagtcgtcctatgagtgagttgttggccaattctagatatttcagagatgatatattgaaaatagactggggtacctgacccgacaagttgttgattgagagtattagcatctcgagagttgggattctacttaggctctcagggatgcttcccacaaggttatttgctgcaagggaaacaccaacaagagaggaaaggttccctattgaggcaggtatctcactagtgaggttattctctgctagactgaggtattgaataggtgcagcaactgctgtaacaggtggtatggaaccaattaatttgttcctgtcgaggtaaatggctgtcagagaggacgtgttgaagagagctcgtggcagcgctcctgtaagtttattttgtgtcaggctaagaaattggagagatgagctattcgccaagaactcggggattccttcagagaggccatttcctcccagatcaacatacgtgagagatgagccactgcccaacaaccacggtatgttacccaccaaagtattggtggcaaggttcagaattttcagctcacgaagtgtgccaaacccactaggaatgcttccttgcagcttgttgtttgacaggtctatgagctggatatgaacgagttgggctaggcttgcagggatctcaccttggagggagttgttccacaagctcaggacttcgagacggctacaggaagataactcggctgggatgcggccatcgagcgaattgacactcaggttgaggtgtcgtagttgttccaggcggctaagctcagctggtatacgcccgtgaaagctattgttcgacagatcaagcctctcaatggagctcaagttggctatgcacggaggtataaggccatcgagctgacaggagctgaggtctagcacggtcacgcggcctggcatcgtcgtactgcaggtcacgccatgccagtggcagaagtcgagagaggtgatcctccatgactctagggctctggctggatcagagaccagagacctgaaggaaaggagagcctgccgatcaatgtcattgccgtcgccatgacctgctgatgatgacgatggccatgaacatgtcaaggcaaggaggactagaaacagtgcaggactagttgggctgatcatactactggtgtggctgcagctacttgtgcttgtgatgtaagcttcaggaagcatgcgtgcttcttttatatggctaagcaccttgctcacttgactggctggcaacttgttcagatcaacggtatcatctgctgggattcataaaccagcattgtggattggttttgaatgtttcgatcaaagttaggtacgtaccccatcttccctacaaatgttttccgaataaattacgctcttcagtctcggatggcaggctgggcacttgggcagctcaaagattagtactactcgacagaagaatggataccaatgggctatcaagacatcaaggggagtacatttgctgtgcggccgaaactgctgtttgctcaatgacgctgcttccgatcgagcggccgacgccgttgataagccgcttgtattgaccggtgtcagtaggaaggaggccagggagcatgggggagagaggaaagtttgtattcgccgcgtcccagcgccactgacatcgagacgataagaacctagggaagaaagagacagaaaatttagaggattggaagtttctctgctaccttcccggtagagaaaaaagaacaaagttaagttaacacgctatgtttactgaaggtaactgtatgtatgaaaatttagagcagttacagtcgaaattaaggcccgctaggagagctagagattatgagaagctggtgcatattataatttgtaaattctataacttcatagaaatggaccgatgctctgcctcccaatctggttgtgagggtattggggatccacatatccgtgtgatacctatagttactttgaacatggcttatatttttacatattcataataaattttgaatagatgaatggtcaaatgtttccaaagtcaaccgtgttaaatatttgtgactaaagagagtaaaaaatatatatatgtgcgctgagttaggttggaccattaccactcctatcttcaggccgtcgaacataccgcgcaattcatgtttgacaccttctttgtcttcaaataattaagagcttgtttggtttggttccaaaacttgccctagcaaaacacgggcaacttcagtagtatcttttgtgtgttttggttgaagccaatatgtgctaattaaaccaatataagctaggaacccttgtcctaccgtaattttgatagagccaaaacttacccaagctttgacactatcagtatttagtactgctatacgtacgatgcagttgtataactcatattgagtactgctatacgtacgattcagttgtacaactcatgtacaactagagatatgtaaccatatatcaatcaaaagagaacatgttcttatgcactatagtcgtttacaaccgttgatcaaattcagtagtacgtgagttgtgtcgtatgtatagctattttcatcaatatttgatagggtaacaatccaaacatgacttattaagttcataactatttatcttcaaacttgatgtcatgttttcattttcaaaataaaattcataaaaattggcatgttatgaaaatgtattggctatttggctattaataaaacttccgtttctatactgcctcaatttccaatgcgataggtcgcatcgacgatatataagtggtagtataggatttaggatgatccgcagatcattaaagaaccatgcacgtgacttgtttgggattattcgtggcgcccgccggccgacgatgtgtataccgacggctggaactcaccggacggagctgaacatctcccgtccgagtccacaggtttcaattaattgtactactttagccgtacgcccacatcgatctatgcggtacgacgctgttaactttttaatatatgtttgatcatttgtcttattaaaacgattacgtaattattatattttatcgtgatttaatttatcatcgaatgttcattaagcatgacttaaatttattttatgtttatacaaaatatttaaataaaacaaagagtaaatttcacctagggcctaatttattggccaaagtttctcaatgaacgaggtctaactctaccttttcacttaacaccaagaacgattaccttgttttacagtttggaccgggttttaatactttgtgccaggcttgagcctagtgaactcagttcagggaagaggaggtattgagggagactagtgcacagggaggaggaagatagtgccgtggaggtggagggggttcacatcctctaccttaatggcactatcattacaggcattgacgtgtggggtaataggagggtgggaccacattatagtgattgtaatggtagtgacattatattagaggatcctcacccaggtggaggcggacttgctcaactcctctgtctccaccctcgccaccggcggctcccggccgcgtctcccgagcggaacggcacagcggcggcgtgctcttctccggctccgacatggcatggcggcgcgctcttcagctccggtgtggtactggctgaatgaatcagttttgtttgtttctgaatatgtgtgcattgtgcaagtaagatggagctgtaagttttgccactaaacacgagcaaaggggttccaagttccatatgtacatgtacctgatgaggtacaacgaattatcgggacaacataacacttgtgatattttttttccagtgccttctctttagtggtacttacctacaatacacagagataataaatgctactccaacttggtgagacttttggaatcctctcccatcctgccacgagctgagaaggagcactgcatgcaccccgttgccggcaccgcggtcgagctggagaagagcatgccactgccgtgccacgccagagccgaagaagagcacgcggccgctgcgccatgcctcaccggagctagagacactattagaaaaagcattttttatgtgaggatctttttttccgcaggcagacataacccttggagccaaatgaccgcctacaaaaatataaatcaaggtgaagttcgctgtccacgcaggcggaccacttaagcggtgcctgcgaaaatctattttcacaggcgaaccttatgttgtccgcctgcaaaaatcgcacctaccaaaaaaaatcttaagtctacccttatatattctcctcccacccctccccaccactcatttcctctcaactctctctatctctctctccctcaacactcagtctcctctcatgtcctctccctcaacactgtggcggtgcggtggggacggccactgcggcggcgcggacagcggcggggcgcggcgtcgcgcgcggggcggccggcagcgtctcccctccctcccttcctcacagatctggccggaggagggagggggaggccagcgggggcggcagcgacgacaacggcgcggggcggcggcggcggcgggggttcccctcccccctccctcccagatctggccgtagaagggaggggagaggctggagggggtggcggcgacgacgacgcgcgggacggtggcagcggctcccctcccccctcccttccagatctggccggaggagggagaggggaggccggcggcggcggcgaggacatcgtggggtagcggcgatgacggcgcggggcaacggcggctcctagcgcggctcctctcccctcccatcccagatctggccagggagggcggcggcggcgaggcgcgtcccgcgatttttttttgttcgttcattgcattttcccaggcgggccattgccccgactgcgaaaatcgattgtgctgcaggcggtcctccctcccgtctggaaaaattagttttgcctgcctgcaaaaatatttttttagtagtgagaagagcacacggctgccgcgtcgtgccacgccgccgctgcatcgtgccgctccgtaggcgcgggagccaccggcggcgagggtggagaccttggcgttgagcaagtctgccaccacctccacgtctccacgacactaccttcctcctccccgtgcgctaatttctcttcctgaactgagttcactaggctcaagccaacgtggtggcacaaagtcttaaaacccggtccaaacttcaaaacaagttaattataccttacaaatttgctatcaatctgtcgacagaattttagttagatatttgtcgatttatagaccgtatgatttgcgtgaagatttgtgctaatacggtcgataaaaaacacatgcgtgtgcatagcgggggatcggttcgaggatcactggttgccctgttagccgtataccaagtagcagttaagctaaattggttgaagttatggtgttaataaactaaaatatacgttataaatgtaaatacactgtattatcgggaaggctaaatggctgtcgaatgtttttttgatagctaaatcattcatgtttcaatatatttagaactgttgtatgatacgttgtagtaaaatgtttcatgaggtgatttgattgtgtttcagcttttttaaaagattgaaatattttcaatctacttgatgaaacagcgttcgattggcttcaaaatctgtatgatgaaagcctaaaaaatcatgcgaatcctatatagactttttctcgatgtactcggatttgtttcatgtttcaatatattcagaatcgttgttttataagttgtagcaaaatatttcatggggtgatttgattgtgttttagtttttttaaaagattgaaacattttcgatctacttggtaaaacactgcatgatggaagcctaaaaatcatgcgaatcccatatagacagccccaataaactatgcaatatatctactagatatcactataaaattacagtcctatataactaaaattatatttgtaaattcagttgatatgatatgtgagtgcactgtaattttgatagaaatattacgtaagtaaatatgtatttttaattttcttttatagtttattggatataaatctaatagtaaaaaaaatctcgctgattttttttagaaatcacccaacaaatgtaccagggcaacaagagatcctcgaatccatcccccgctatgcacaagcatgtgttttttatccgccgtattagtataaatctccacgcaaatcatactgtctaaaaatcaacaaatatctaacttaaagatatgtcgctagactgatagcaaattcgaagtgaaaaggtagagttaggtttggttcagggcggaactttggtcaataaatcaggtccaaagtgaaatttcctctaaaacaaataatcaaccggttgacttcatcgttgcctttaaatatgtgggtaggttagttttggactaattaagaatcaggcaagcaagcacgtacgttcgtacgcagacaatttaaggttcaccggaagcggatttaagcaagaagtgtaaccgatcgaccggccggcggtagatcgccgtcgatcgaccatagtcggagtttctcgatcttcttcttctctgcgcgcgaggcggacaagcagcttagtttgtgcaggctgcaggcagccatggaagctgctcgtcgtgttcgctcctccgagctacgagcggccatagtcgtggcggtcctcctcctcctgctgctgctgctccagctgcatgctatttctgcctcagccgctactaacaccagttcttcaggaggatatggttctggtggtgagtatttaagcagtgtacgatatcaatatattggcattgcctttcgcccatgattaattgctctggtatgctgtactgtaggagtattatattgcacgggcgtgtatatgatatatctgctactgagtaaatcaaaggcaaattaaatatatattttgctaatatttcaaacgattttatttgtgaaaaataaagcattttaattaattgtggtatagtcggttagatgtcatgtttgtagggttcattcagaatacatgattgaaaatacgtagaaatataattgtaaaacagataattgaaaaaaaaaatgtgggatagttgattggatggagtaaaggaaaaaacataagaataaaaaaatgggtgccctgtaacaaatcatgacagtacatgctagtgacgtgaatacattaatgaaatcaaaattgtcctttgtgccttgattagttgcttgatagcctgattttgcctctcgttcccacgtgaagaaagagaaaaaagaggtcagcgtgcatggatagattttgtcctatagtatttcccttgtatcgctaatgtagcaaaattttccagagcttttcccgtgacccgattcctactatccgaatgaagctgtacagtgactcaatccataggaattagaacccttcatttttcccatgttcttactccatttcaaatgagcccttagtaacttgttcatttctcttcagaacaagacaagccaggtagacatgacgacgatctttccctatcatatactcctagctatacgcacccatattaaccctaattgtgtaacatagatttttttaaaaaattatattaatctctactattataaaaattgaagatgtttttgctaaaattttgatacgtcattcatgtttaaaccgtttttttaaattcattgatcatattttgtatggaatcggacacggacattttgttgaacggacgaggactttttgaaactgtgagacaccaataatggaaaccatgcaaggcaccggtgggaaacccaatcatactcaaactcatgcatggcctggcagccacatcagtgatcgatttagaacgagtgaagttcgtagtagtaattaaggatattaaaataaaaatcaatgtaaaactgagcacatgcatggttaactaaaatttgcaatctccatttctatctttatcttctttactattataaaaataaattgaagatattttcatcgatactacatcgtctatatttgatcagtttttaagtttattcgcttttaaaaatacacaaagagtcgtataagaaattcttttaaaaaactcatatgccaacttgagatgagagtcagagtcctaattgctttagaattcttgccacgttataagaaagtaacatgcatgatatagccattaaggattttagattaaatatgaatactatcaaaataaaaatcgcatatactttttagacaaaacaatctagcaataatacgattaaaatagccttcacccgttgcaacgcacgggcatttttctagttaagaaaaaattaaaaaaaatcctaactatcaaatatatttagctggtagtatatcctacaaatagaaatcaatctctttaatcagtgtattatacaaaggtcattaattaagatgttgagttacattcaaattctacatgaaactttagcagtatacactacgatatttttttccaaaggataaaacaaacaaaccaccatacaaacatatacatttagatattgttgcccaagtttgttacagaagctattgaagaaagcatgagtacatgctactcttccatgcatggttggaaagtaattttattattacatactgtatatgccaaatcattgatataataaacagattgaaatccgagtatcttgacagaataaacattctaaggaaaatcaaaatcccaagatacatatgccgccaaaggttattgaagtcgacgtagtctaaataaaacatgttacacgcacgaatggatgggttaattgataactaagtttgacataatgatatgcatatgacattatttggtgttcataggacctgtacttatcttactaatgctaattggtggctattattatattctataaatttcctcgcgtgaatgtcttactcctattagagagctaagaattctcatgttaattcaaaactattgaaatttgttataaaagaaaatacctgtcaagtttatataactttaatttgtacgtgtaacttgtaactttttgcaggtggtgggtgcggacatcctgttctagtgtctccgataccaagataggcacaacagcctagctagctgcacacaccggctagttcagtcagttgtaataaaaaaaacaatacctaaataagtgatggaactatgaactaccgatcgatatgaattatgtatgtgcggatgagaataaggaaaactgcataaggccggcgtgcgcatttctggatgatgtagcacccatgcatgtgtactcgatcatgcttttaggccccatttgaatcgtaggatgaaaaaacagaggaatatgaaaaacacaggattctggcaagaatacaattgtaaaacagaggattacaaaacataggaaaaacaaagaaataaccatttgattggaccacaggaaaaacgcaggaatcagatgagagagatagactcagaggaaatgttccaagaggtttagacctcttgctaactttcctccaaaatgtacataggattacccattccataggaattttaaaggattggataggattcaatcctttgtttcaaaggccctcataggatttttttttccatagaattaaaatcctctaaaattcctacattttttttctacaaatcaaaatcaaaggggcccttagttaatgaaaaatcctatggtagggagggggccttaccctcccgtctatctaaaaaataaacattgtgcatgactcgaacaacatatatgggtgtttttttgagctgaatagctgagtggatgaataaattaatgatttgagataattatttaaggatacaaatgaacgaattaactataaggttgaaaaatagatttcaaacaatgttataagaaattcagggtctgtttagataccaccccaaaactttacaccctatcacatcgaatgtttacattcatgatgtattaaatatagactaaaaaaataactaattgtacaaattgtgactactttgcaagacgaatcttttaagcccaattgctccataatttgacaatgtggtgctatagtatatatttgctaatgatggattaattaggcttaataaatctgtctcgcagtttacggacggaaattgtaattagttttttattagtgcctaaacacggggcttctaatgggcgattgggtagcgatcgatccccctccctccctccacctggtttcttttttttggcaccgtattactttcctattttagtaaatttatgcacctaaagtttatacacctcaagtttacacatctaaagtttagagaccaaaaatttatatgtcaaaagtttatatatccgattcaaatttgaatttgaattcaaatatttttcatatatagtatttctatacatctaaagtttatacacctaaagtttatagagctaaagtttataagtcaaaagtttatatacccgtttcaaatttgaatttgaattatatctgattcaaatttgagtttgaattcaaatattttctatatatagtatttctatacatctaaagtttatacacctaaagtttatagacctaaagtttataagtcaaaagtttacatacccgtttcaaatttgaatttgaattatacccgcctgaacaccctatgtgacaatctatataatacccggtgtgacatgccaaaattttacacccctgaatctaaacacaccctcagatacagaaattgtgtaataccaccatgtttggtggagcttcttgaaagtaactgtatagaagcggaatactttgtttaaatttgtgttcaagtgatactggtgcactaaaaacaaagtaaagaaaaatcgggcaataatatcctcatccccaagttattaccggtatagaacaaaatagggagcagcaagccagcaatgatgctaaatagaactgttccgtaacatgcggggagagaatccccatccgctagaaaatcgatttggattgcattttgcgctcggatcttacggacaaagagtccaaaataaaacgaagagagggtagcccgcagtccgcaccacttcgtcgggtctctggctgactgggctctctgcggcgtccgtggactgtgggccttttccattccgctttagagcccagctacttttggccgaggcccgatccagtccagcacgcgcgcctcctcgccctcgcgtttcttctcgttcgagcgctcgccacaagcggctccacttctccgctggtgcggcgacggcgacggcgacggcgacggaggcccttgcgccggagaagcccatgccgcatctacgtccgacagcctgcgaccaggtttgtttcgtgcgttgtttctctgtacgcgtgtttgcaatggcgtcggcgtcggcggtttggttgtggtgggtgttcgccacgcgtgcgcgcggtgtgttcgtggaaatgcccataagaatgccatgagcctgcacttgcacatgcaatcggaaaatcgccggtgttagtttcaacgatttagctaggagaatgattatgacgcaattagctggagcgcatcatcggattgccatacttttttgtggattatggggatctgaactttgggttttgttcatggttccatcatgcaaataggggtgtattattctactactctttgacatggcatctgtatggtcaattgcacagggggagtaggagtggattagttttcatcgaatcatccgttgatcggaaaaccttgctcagcaatgtttcttatatattttatttttttctttcgtttgggtttttagggtctggttaaacaacagatgccatacaatatgtataatatcgtttagaccaataaagtttatcatgcatacaaaattttatggaatctcaatctaattaggaatgatagttaaaaacatcagcaaacaagcttagataggaaatttaatggcaggttatggcaaaaacagaatagttggatttggacaatttaataccaaacgtaattcattacaattataaagcatatccagggctatacaactccgatcacccaaacttaagacttgtttctgattatgaccatagactttttgatgcagccatgtttctaggcgtccattaggcatatattgcaagatgattgctttgtattctaaaccttttggatccaaggtggaacataaggtgatgactttaataagattgcgatgtcggatgtttttcaaggcttcacactctgcaataaagcttgttggtcctccgtgcctattgagattgaagaccttaatagctactagatcaacctcaaactccagggtgcccttgtaaacatctccaaaggatcctgaaccaaccaagttttcagaagagaacccttttgttgctttgacaatatctttgtatgaaattatcgtcatatccatgttattgtctgtcgatatttgatttcttctcttcttttcagcggacagtgagcaaacatatcagtgaaattactacaacaattgcagcaactggaaccactatcattgaataatgaactaatactttgttcttgtgtctaaatgcaggacaatgaggaagccctaactctggggttgggccgtcccttggtagggccccaccctaacggcccaatgagagatacccaagcccgcagcagctgcagcaccgttcgctccgagagtggctgcgcgggagacggcgcgctacgagcgtgagaaaacgaagggttggtttggtttgtggtctaaataggccttaccaaattttaccaatgctaaattttggcaagttttagcatgactaattttggtaaggcaaagttgtgtttggattgaagccaaaatagcctaagttcactattgaaatggcctattttcttaggcatgccaaaatttggcttcaaaccaaatagacacactattgaaattgccaaatattgatatccctaatttaggcctaagccaaaccagcccgaagaagccgggcccactactgcccgaggttcgcacgcgggagggagtggagcgatgtggacgcaaggagaatcgagcacgtcggcccgaattcgcccggagcgcagcaattcgccatcatctttaatttaccccgatgctataatattattatgaagtattcaaattactccggatcttcactaatagttgcatataatgttataatttataatataaacatgtaagtgtaacttacgtgcccttacccttatgatatgttatttccgatggtttattcaactaatttcattttttttattttatagtgtctcggtagagtaccgatatcatttttgtttctagctctaatgtttcaattgtttccgagaaaaagatctacttgggaaacgatttttagatctggtttacaacccctttaaatgattcttagatccggcttacaacctctttactaccggttgtagcaacccagttagcaagtgaaaaacatatgtggggtgtgagaatcgaactcaagaactctcaccttagtcctcacgcgtataaccatcccacctactacacacaattgacttgaatagatatgctttccttttgaactaaccctcgagacatctttattaccggttggtaacacaaatccgaactaaagcgatctttagtctgggttggtgttaccaaccggtactaaagatgcattgttagtactggttggtaataccaactgtgactaaagatgtttatagggatttagatttttagaaccggtattaaagatactttagtaccggattttaatctaaccgagatatttttgattttgggtatcacgtcgaaagatcaattctctggtagtgaatacggtaaaagaaatatagtttcagggtatggtacgccgagaattggtggtgtacattgatgatattgttattatccctcagctcgaggaacaacatctcctgaatctgaggaaagcattcgcagtataagtttcaaatgaatcctttgaaatgcgcttttgttgtttcggctggtaactttctcgtattcccgtcagaaggggatcgagaaaattaaatataaactaatggtttgcggcatatttttatgcgggtcttagcaaaaaaaggattgagttatttcgagaaatatattaaaccaactccaatccttttaccaattaacatattagaagatttcacaaaaccattacgcttagttttcgacttttcgggatgtggagaagattggagtagagaaggcttccttctgggctttttgatttgagtgtcagggcttttcaacgactagaaagctctctatgacggcggctaagtcgaggagtaggcaggcaagagtgctttttttgggctcaacctgtataggtactgtgtaaggttagctctattgggcgccgcacttacttattgtaaagcatgcgccagaatgcccagacataaactatatatgataatatggtttttaacaaacttgtctctctttatattctaagaattgtccgtccttgtcattttacttcttacgtgggatttatagacaaaagttagcccggattactaaagagctttgttgcgggaaaaggagggatttgctgagttcaaaagcaagagtacgggagtatttttctggccattttcgtccctaaagacgcatttgcgcatggcggccgaaacagctgtgtatagtacgtactgcacacagttgctgcctccgatcgaggggccgacgacgtcgtcgtcgtcgatagctagcgcagcctgtattagccgcggccaatgggaggccggccggcgagcatgggggagagaggaaagcttgtattcaccgcgtgctcgtgctactggcatcgaggcgataagaacctatcaggaagaaagagacaaataaggaaaactacaggatcgacgtacgactgtgtcgatcgagtctcagctttgcttctctttatgtactgtatgttcttttctgcaagatcgacttggaatgaaacacctagcgtcgtaattacattacatgagtatacagtgtgccgttcgttcattggtaaaacatacagctcgattcaaaaaccagtgactaaataagaagctgcaggattcgacagtacaagctatagctagaagaagcaccaaactgtctcatttccaatgtgatagcctgcatccatggtacgtggtactccttcagttataaaatataagcatgtctaggattaaaaataacataaacaatttctgaaacattgattctgatacatagaaatacatacattttagaatctaagcagttcaaatttcaaaatttgatcactatggtaactagaaaggagattctgtctcaactttaatatttaataaataaactaggtagaaatcttatattttaaaatagagtaaccaccaaccggtcatttattttttatattaccaccactacacaaaacatcaaataggtatcggcactatatataggccttttcctatttccgcgggttgaaatcgtaaaaaaaacagcacctttaatcaattataagtaccggttctaaatcaatgagccgaccggcaatcagatgagccaaccggcaggccccaccacaacaaggcgatgaggagataaggtttgatctcgcgtctctctcgtctcgctctcttctctccgtctccctcccttctctctctctctatctatctatctatctatctatctctctcgctgctggcggctggccgatggaggcggcagcggcgaccatcccctccgccagatccggcgggaggggaagcgacagtggggtcggcggtaggcggggcggtgtcagcggtgggcgggggcagcaggctcatcgggggtaggtggcagtaggcggagggctcgccagcgggaggcggtgatctaccgcagggaggagccctcccctccgccagatctggcgggaagggtggcggcggtcggcgggctcgccgacgggagacggcgcgacgggaggtggcgcgacagctcgaagatgaccaaccatgcgacggcgatgatggtggatctaaagaggtgtgtgtcgacgtttgatgtctcgactacggtatttggacagtacgaggatcgttggtgctaggatatacgcgagactgagataaaaaagatggagacagggatttttatacaggttcgggcccctgagttgtcaggtaataaccctacatcttgttggccgaagccggtattgctcttattcaccataatcacaccagtacaatatgtgggtagcctatctaactgttgtcgacatggcggtctgaaggtctgactc

SEQ ID NO: 30283 - DNA, 5027 bp, Oryza sativa
ggcgtatgtaaacttctatgttgtggcttctatgtcgattgtgttgggtgttgatcctgtcgattgtctcgttgtgggtgtccccctgtcctcctaggggggcttgtatttatacccataggtgtccccttatcaaagtagaactagggaaaccaatatggatacaatccgagtagtccttgtcgttttcatgtagaactctagttgtctttccttatccggaactccctccatatctgaagtcgatttccgtataggacatggcatgtggtgggtcctgccgagatgtaatcaactactattaggtatgtggtatccataaccatgacagtagcccccgacttcgatgcaaatgaacgaattcctattctcaaccgcgcacaggcattggagtaactgttatcaagctcatgtgactgttctcggtgagtttagagataacgttagacttcctttgtcagccccgtgcaggcaccgaaagggtttgtctaagtcaatctctgatgtcaaccgaaaaagtacagagcgtacgactaagtctcccgtcttgctgtagtcgagaatttggattgaagtcaagaaattttatctcggcgggtacaccatctcttcattccgtattccttgtcgagatccagcaaccgttcccgagcgatcgagaaggcgtagagtctgcgacggagccttgtcgacattggtcgtacttgccttagtcgatcttggtgtagaaccatagagacatggagtcttcatcaatgtcgaataggattttcctgaaatcaatactcagaaaagaatatcaaatagaaatagcccccgagcgaatgctcaaagcgtgacatgttataatatgtatggtaaattgaaaatgaattaaatttaccgaccaatgttttgtgtaagagtgtcttctcagttcacgactttggtcagtcgtttgagttgtacactctctctagcccccagccttgtcgtcggagaatcgttctcggaggagaaggctcttggacccttgacctgccttggttgaataagcattgatcctagcccccagccgtgaagttggaaaagtcaattttccgattacacggcttggttaatacgcacggcgaaaactcttacacaaccagatcttacatggtctttcgtctctgaaggatccgacaaggccttatcggctctgggcgtccccagtcgaagatcccttaggttcctcggaggccttgtcaagacggcgtaaagggacagcaggataggtttcaacgctaggtgtcgtcgtggtaagggatctctgggtaaaacacttggcgatattgtgtacctgctaccaactttattgaagtagaggtagtgggagaaatcggtacatcgctggtcgaggaacaggcagtagccgcaacttgaccactgaaagtggaagtagtcggagaaacgctacatcgctggtcgaggaccaggcaatagccgtaactcgaccactgaaagtggaagtagtcggagaaacgctacatcgctggtcgaggaccaggcagtagccgtaactcgaccactgaaagtggaagtagtcggaggagtaaccgtaactcgaccactgaaagtggaagtagtcggaggaacactgcatcgctggtcgaggaccaggcagtagccgtaactcgaccacttgaagcaaatgtacgagagatcactacgatcaactggttgagaaccggtgagtaggtgtccctcgatcacttggagtcgtggtaagaggaccgctacgctgctgtagtcgtaccttgaccatctgaagtaaaggtgcgagagattgctacgtactagtgcgagaaccagtgagcgagcagaattatctctcgaacaccgatggaaggtgcggtgcgagagattgctgcgtactggtgcgagaaccagtgagcgagcagaattatctctcgaacaccaatggaagttgcggtgtgagagattgctgcgtactggtgtgagaaccagtgagggagcggaattatctctcgaacaccgatggaagttgcagtgtgagagattgctgcatactggagcgagaaccagcgtgcgagtagagttatctctcggacaccgatggaagttctatctcaaccttaatatttaataaataaactaggtagaaatcttatattttaaaatagagtaatcatcaaccggtcattcatttttgatattaccaccactacacaaaacatcaaataggtatcggcactatatataggccttttcctatttccgcgggttgaaatcgaaaaaaaaacagcacctttaatcaattataagtaccggttctaaataataactgacacctattctataggtgttggtttgacacccacagaaatcgagccgagccggcaatcagatgagccgaccggcgggccccaccacaacaaggcgatgaggagataaggtttgatctcgcgtctctctcgtctcgctctcttctctccgtctccctcccttctctctctctatctatctatctatctatctatctatctatctctctatctctctcgctgctggcggctggccgatggaggcggcagcggcgaccgcgccctccgatcccctccgccagatccggcgggaggggaagcggcagtggggtcggcggtaggcggggcggtgtcagcggtgggcgggggcagcaggctcatcggtggtaggtggcagtaggcagagggctcgccagcgggaggcggtgatctaccgcagggaggagccctcccctccgccagatctggcgggaagggtggcggcagtcagcgggctcgccgacgggagacggcgcgacgggaggtggcgcgacagctcaaagatgaccaaccatgtgacggcgatgatggtggatctaaagaggtgtgtgtcgacgtttgatgtctcgactacggtatttggacagtattgggatcgttggtgctagaatatacgcgagactgaggtaaaaaaagatggagacagggatttttatacaggttcgggcccctgagttgtcaggtaataaccctacatcttgttggccgaagccggtattgctcttattcaccataatcacaccaatacaatatgtgggtagcctatctaactgttgtcgacatggcggtctgaaggtctgactcgtagtcgacaacagggtagccttcctcctcgaatccgtgtccggcgagatcagagatagcgctttcgtatctcctgacggtatccggagataccgtaggggaatagccatgcctatccctgaaatcgatatccggcggcgtgtcttggcgtatgtagacttctatgttgtggcttctatgtcgattgtgttgggtgttgatcctgttgattgtctcgttgtggatgtccccctgtcctcctagggggccttgtatttatacccataggtgtccccttatccaagtagaactagggaaaccaatatggatacaatccgagtagttcttgtcgtttccatgtagaactctagttgtctttccttatccggaactccctccatatctgaagtcggtttccgtataggacatggtatgtggtgggtcctgccgagatttaatcaactactattaggtatgtggtatccataaccatgacagtgtgattctttttttattgcataaatttgagtgccaaaatttgtgttgtgggatgaatggacagtgatatgtggatgaatccatctgtggatggatgatgatattctttttgttttgttcattcttgttcttgttgtggtgtggatggatgcggatgtgtgaggaggaactgctcggctcaatcgagccgacgcatcgagccgttttttttttattcgtcgaacctaaaaggtgtcggaccggcacctatttaattttcaaatcagtaccgtctctcttgtgccggttgagaaaactggcacctaaaagggttttctaaccggcaccaatttatgttttttaagtagtgcactcgccggcgagctagctagcctggcaagtggtgtaccagctgaagctctccggccaaagcgcaacctcgccgtaatccgaatctacagcttaattaatttgcttgtctctatgttccacattataagttattttgaatttaaataaattcatatatagattcatatatgtgtttatatattatccaaattcatatgtatgttagcgaatctagataagtactagagaaaccaaaatgtcttataacatagaaatgagagagacctatatactatctctagtttctaagctagctggccagctacctaatctcttcatatcaaaatattattttctagtatttaaaatttattataaaatatagtaaattttgtacatgcattctctttttaactaatcataacagtcctcacataattttttagttttttttgtcttttcaactaatcatattttattattttattatttctattttttaataaacgtgtctaattttaaaaggttttatattttaggatggaagctctagctgcctacgaggctacgacgactgaactgacttcatcgctggttttaaatacggccaaagttttggacatgatcaagccacggccaagctctcaccgatcaccagatcgatcgattcagttctcaccttctcagaagagagaggagctagcacgaggcctggtcgatcgaccatggctgctgctgctgctcgttggcctcgcttcttcgtgctacgacctgctgtagcgctcctgctgttgctgcttcttctgccgctgcatgctaccgctgcttcccccaccactgaaagcagcgccggcaacgacactgttgctcgacctgatccttgtgagtagtaacgatcgatataatttattttcttatacttctatatatataaaagattcgcgagtacaagatagattttcatccctcaaggaacatctacttgtttaatttcttgtatttcacctaaataattaccaaaagattgaaaataaaatgacaaggtcgatagattactccatgattaaacat

SEQ ID NO: 30284 - DNA, 1831 bp, Oryza sativa
taatacatgttaccttgtattctaataaaccaccaagctaggggattctcaagaaataaattttttcttggctgctacacccgccaaggaaaatcttcgaaaaacttgatatatattaatccgtacatggtctttgttttaattttttatttaaaaataatcaatggatgcacctctgctcagtgctcaccctgtatcgtggacgtaggttgtcctgacggcgaaagacgacgtgcaccaagatttgacggaactcatcctactcctcccccctccccgttgccacacatgccaagtaataagctccttactgatcttaattatatatcttgactgtcagattatacagatgaccacattatcttgaatttttaggagctgcagcatgtactgtacatggaactaaatttgtttaacttttgttgcttcataggacctggagtacgtggacgccaatattggagcagacccaagaacctgacaagagggagccggctatagttacttcgatcggttttacttaacaataaaatggaaaacgtacctgcagccctgcaggagcatggagtatttccataccacgaagcagatctatacgtgtcataatgggtgttgcaaaaatctttttcttcagtttgtatgtgtgtgtatcttacgaggaattaatggattctaatctttaaggatgttcactcatgcatttttttaaaaaatccactacaaatagtcctgaaaaattatgataatgtaaaatatagtgacatctatcggtacaaaagaagtcaattttaaattcgatctatacattgagaagaaaaaaaaaagataaattcagatgtgaacaatacgctaatattcaatcatacattgaatttgtctttatatatatgtatatatatatcttcacatgtagtttggacctaagattttgtgaaagtggtatatttatatatgttgtatgactgttatccagtttttcaagaatttttgtaactgtctagatgggttttaaacaaacgatgggacatcctttgagatatcaaaataatgtccccaccctgcacccttgctcactcctttctcaattgtagcacctaagcttgttttctcttcttttacttcacatatatcactactgaaaaataggggaaaaacaacactatatgagtcgccaagtccacaaccgatacctatcgacgtttgatatcacgactacggtatttggacagtatggagatagtcggtaccatggtatatgcgagattgaggtaaaagagatggagacatgaatttttatacaggttcgggccccttatctgacaggtaatagccctacatcatgttggccgaagccgatatgctctttattaatctggaccacacaagtacaatatttgggataacctatctgactgtcgtcgacttggcggcatggataatcagctcatagtcaatgacagagtagtcttcctcctcaaatataaacccgtcgagatcagaaatggcgctagattcctcttgccaaccttcacaggcaccggatggggtatatctaggctaatctctaatatcgagatctggcggcgtgtgttggcttgtgtatatgttgtgtcttgttgatcttgtggcttgtcccctctcctcctaggggggcttgtatttatacccataggtgcccccttgtccaagtaaaactagggagaccaatatggatacaatccgattagtccttatcttttccatatagaactctactcatcattccttatctggaactcctatacacgaggtttgtttccgtataagacatggtatatggtgggccctgccg

SEQ ID NO: 30285 - DNA, 1300 bp, Oryza sativa
gacggcgcacgacgcccgcgccgtgaggtcgctccgcgcccgcatgaacgccgacgtcgagcaggtgctccgccgcgccagggccgtaaaggggaggctccaggcgctcgaccgcgccaacgccgccagccgcaagctccccggccgcggccctggctcctccaccgaccgcacccgctcctccatcgtctccggcctcggcaccaagctcaaggacctcatggacgacttccaggtgaggaaaaaaaacagcagctaaaaattatggctaaaacttttatatctttgagtgtattgttagtggtttaaaagttaatgctggaaaatagactacaatgtaaaaaactaaaatcaacttcaaatttcagttttaatattggtttcgatcagttttaatagtggctgttgcgatcaggtttccaccatattggtttgcacatttcttttcacaagggggacgatcgaaaagattttagaaattgaggaaatttcggaatcaaacaagttaaagctttaacaaatttatgttgaacttcaaaaatgcttgattaaaaaaataaatatttcagagatcataatgtcctatcgcggactataggacaataatctctaaaattattgaaattaatatccgaaacattaaacctgaccgtgataactgataaaccaataagaaaacgatgaaaaacaatgcaatacgtgcaggggctgaggagtcggatggcggaggagtacaaggagacggtggcgcggcgatactacacggtgacgggggagaaagccgaggagagcacggtggaagccctcatctcgtcgggggagagcgagacgttcctgcagaaggcgatccaggaacaagggcgcggccaggtgctcgacaccatctccgagatccaggagcggcacgacgccgtgaaggagatcgagcgcggcctgctcgacctccaccaggtgttcctcgacatggcggcgctcgtcgaggcccagggccaccagctcaacgacatcgagagccacgtcgcgcgcgccaactccttcgtccgccgcggcgccgtcgagctcgagacggcgcgggagtaccagcggagcagccgcaagtgggcatgcatcgccatcctcgccggtgttgtgctcgtcgtcatcatcgtccttcccatcatcgtcaacctccacctcttgaccattagatagactccctttctttcaggaaactattctaatccctctcgagtgatgtcctctcattacatcaaatagttgtaaaagatttgatgaaatagattagtatgtgatatatgat

SEQ ID NO: 30286 - DNA, 541 bp, Oryza sativa
attgtctgcttgcccccgcatcgtcctccctcacgggcgacatgggaggcggaaaccgccggcatcgccgctccccccttcctctctctgccgcctcgccgccgctggcaaagccgcgcggccacaagaacggcggcggcggggcttcgtcgccttcgtctgcctctcccgtcggcggtgggggcccgcgcgagacagcgaaggctacccagatccgggctgccgcggccggatctggcggggaggccgccggcggagggtcggcctgaggtggcggcggcagttggtggtggtggcggcggggattgaagatggcgggctggcgacggcagttggtggcggctggtggcgggggtgacggcgttgggaatggtgagggggcgccagcggcggggatggaggtggcggcgaggctgatgacggcgggtggatctggcggcgaggctagcgacggcggccggatccaggcgtgctgcaggccgatctgccccccccccccccctccccgcatggcgacggcatcggggcggctgcgttggag

SEQ ID NO: 30287 - DNA, 16965 bp, Oryza sativa
tgagtggtggtggagcatcggtacatcatccgtggattcgcaggtggcgagcgacgggtgaaaacctagcccggccttggccagaccgacaacgatggttatttccccctcctgagggcgttgtcgtgctgtctcacccctcaagggcagttgccgggcgaaagtccagtcttggctcctttgagctctaacggacggtggcgtcgcttcttgaagacgtcgttttggcacccccttgctgtagggcgatctcgtctgtgttcctttgttggtctagcggcggccggtcacgcttagcgacggccggtccggtgctaaccttctcctgtcatgtgtgttggcgctgctggtgtgtgggtggtggtatattttttctttttcctggttatgaccctccaggattgtaatcttgtaattttttcctactctgtcaatagaactcgttcaaaaaaaaacataatgactgtgaatacatgcatactagccatgtttaatttgtttttttttacaacttgtacaagttaaaaacataatttctatttttgtgaggtgatatatcacatattaattttatcttcacggttttttatatatctatttaaattatatggaaaaaacgaagtgacatccatacgagagtttagtgatcattcccctttctctccacgaagagtttagtgatcattcccctttctctccacgttcttcgtgtattgttcaattagtgcgttataaatgcttgggagtttgttaatatctttgtgtggtgatgggaggggtgtggaattgattgacgaactgtttgcacgatcgcatcgccttgctcaagttcaggtcatgctggagattgctggtgagctgtcgcctgcaattttctgcaggaattgcatcattaaactgaacagcgttcagacttttgtaaaacattacaaccgcgcacgtcgcctgcatagattacatgcagagatcataccattttatgaatcgtgaggaagactagtgatgttgagtgattaagcatttcgtggcagaatgtcacaaatttcagcctgcgggcacaccgggctattctgcaagactgcaaccaagtttatgggccttatgtcctggaccccgtgctcgagtacgaatggtctgtgtatttaaaggaaatatgaaaatacatataatacattatttccatttatttgcaacaataaggcaccagtggtctagtggtagaatagtaccctgccacggtacagacccgggttcgattcccggctggtgcattttgttcctcccttcatttttatcactggcttaatcgttttctgaagatgttcacctagtcagccatatttctgtgctcatttctgaagatgatcacctattcacctctgtcccgctgtgactatctttttttttctctcactggcttaatcgttttctgaagatgttgagatgttcaccctctcaaccctttttgtgctcatttatgtccctgtgactatccactgccaatcaaaagtcaagacaaaaaagactcgccgaggaacgcctcaacttagtaccactccataacactatcatatcctatgttttatgatagaatacagcctccaatatcagaccttcaaaacatgtagaagcaggaccgtttgaactgatcaaaacaggcagcaataaacaacccaaatcagaaatcacccccctactgttcttgcatccgtttaactataaattctgacgagatttcttacactggtatcagcaacagcttatagctcagctcggttcagttcagttcattcttgcaaagttacatagaacaagaagaaattgagcagcaaatatatatatcttctcttcaccgtccgttcttggacagattgagctagctagccagccagccatggccatgggttccatcaaggtgcaggccgtgatcctcacatacgtcctcctcgccgtcctcctccacccgctgctctgccagggctcgccggcggcgtctctcctcgaggcccagaccagcgacggtaacaagagagctagctatagccagctagctgctcgatttcttcttctccattgtttttctgaacttggtgaacctgaatgtgctctgttttttcttttttgttgttgttgttgtttttttcaggtaaaacgatcgaccagggcatcgcgtacattctgatgatcgtggctctcgtcgtcacctaccttgtcggatgagtgattcagtggcccgatgatgcaatgctgcctgctgcttttttttttgtttcttttgcacacgtttaattgtaatgttctttaagttgtacaaattcattttgatctgtcaatgagacacggcaagacatgagtaagcattagtactgaaagtttatgcggtgatgacaagttcttgatttcgtgtcatacaactggaatgacagaggatgatcgatcgacttacttaacgggcgattagttgcgcaaaagttttattcgtgtcatacaatggaaggacagagcaaatgccgataggctgcatgtcttcgccatctcttgaggtttcctgccaccacaacacacaaacacaaacgatcaaaaatcgtgaaatggttctatggttgatcttgaggagaattcgaatgtttttggtaaattcaaatttagacccataaattcgattaaactttgttgaaatttcccggttcttgacatctgattggaccctgcgacgtcctaattatttggttttattatcccattttttaaaatatagcgatgtgagcttttcgacattaagttcgacgattagtcttaacaaaaaaagtataagtgaaatgaggatatggaagaggtttatagaaattcaataaatatggatatagattcatatagtatggtgtggatgtggtatcctaaaatctagcagatgcggattatacaatattttcatctgaatatccggtaggttatttatcgggtaatctgaaatcgtcaacccatgtaaccattttatttgttccatataacatgagttgactcattcaatggcctaattcatgagttaactcaggctcctcaatctgatattctcaccatctcatctcatgaccacttgtaaccaccgctactatagcctttgctatgtattgttgttttatatttgtaacttattagtatatatggacatcatatttagacgtgctatgtgtcctaggatgtgtgtgctatcctgtgttgattgattgggtgcttgtcttgaacgtgttaatgccagctttgactttcaaatcttactaatctattatgtataaacattatggattcatattaagtacttaagaaaatactacctctatcccaaaatatcaaatttttggctgtgtctggacaaacgtatatccatatacataaccaaaaagttgtcatatttaggacggaataagtctacataacccccaacctattgtcaggagattacttaaccccctcaccttacaagccaggtatttaacccccaatcttactaaaatcatttaattaaccccttatggtggttttgctccctagttttgccttgctggcatgccacgttagacagatggattgacaggcatgctgtgactgtcacctgattttctcaggcaaggccttctactctacccggtcctctatttacattgaaaatctataccatttttatggttcataacattgccattgaagtcggaattgcatacatgtgcaagaattcagtagcacgagcaaaacaagagtgcaaaaccaccgcaaggtgttaattaaacggttttagtaaaggttagggagttaaatacctggtttgttaggtgagggggttaagtaatcacctggtaataggtcgggggttatatagacttattcatatttaggagagagataatagttgttatgttggtccgttgattgattattgttttttgtccattgtatcgctaacttaatgttgcatcgattgtatatatacgcaataccagcaattttgattcgtttctgagtggagtctgctttgactctgcaacattactgacataaaaaaacaatctgttatgcattcacatccgcaacatccacattcgctatgaattaatgctcttaaaaaaatatggtatatgatatggtatcatcactatccgaatttgcttaactttcatcctaaaaaaattacaagattcatattttttattgtgacttaatttatcactaaagacagtttaaacatgacttatattttttttagtaaaattttaaataaaacactttaagaatattcaaaaatagctcaaaacttcgtatgtgagggttaacacttaataccaaggtttcatgtttaggaaacttaccgaacggttccaaagtaggatagtctttcgacataatatattagaaattattttatatagctgtaattatagagatggagaaaaaaatttgagctctgcccccttcccgctatttgaagtcatagtaacctagtttttttccttgtcttttgttttcctcctttcttgacataactcggtataactgattgtgttgtgtaacaatattcttttcttttaatatattgacgtgtaattcttttacgtgttcgagaaaaaaattatacagattaagccgaaatttgtttgagtttcagtttcattttctatcattcccctttttatttccttaattaacactcgacgagaaccaccctcagttccatgattggactcctgaaacggttttgctataaataaatcttgcgacagatttcttgttacatatcattcgatttttggaccgtttgattgcgtcaagattcgtgcttacacgggtgggaaaataaaatgtgcgtgttaaacgtttaagcgaggagtcgaccgcacgatctcctgttgccgaacaaaggacttttaccaactgagcaggaaccaatattgtttttgagtccaaagaacaaacttatatactacttacaaattaattacagtgtaattactacataattacactataactactgaaattacaatgtaattatactaaaattacagtgtaactttttaatgcatatgttgatgacatttttatttttttattaaacctccttggacttataactgttagattgagtccgttgttacgattaagctagcccgtttccctctgcaacgtgacgcacatccatatgtggaaaaatccgagtgagatgaatgaaaaaatcattcgaatgattgctaggcactcccattaggcctgacgtttcttctagaagaacaaaagaggcgtgcgacccacagaatctgaacacgcagccaaacaagtgcccactgcttgactggctgacgggacatgacgcccaacgccgcgccgccagcaaacactgaaacacactcccacctctctctctctctctctctccctctctctctctctctccctctcgcaccatctccacgaccaaacccaccgccacgccgatataaggacccgtttcgggtactttaaatcaaaggatttatatagaaatttcatagaatttaagtcctataggaaaattttctatttggccctttgattcaaaggattgaagtttttcaaatcctataaaattcctatggaatagcatattgcatgtgaattttggaggaaatttagcatgagctccaacctcatggaaaatttcctttaagtctatctctctcatccgatttctgcgttttttttgcgctccaatcaaacgaccattcctgtatttttcctatgttttgcaatcatctgttttacacttcaattcctgtcagaatcctatatttttcctattcctccgttttttctaccctgcgattcaaaggggcccttagtttacaactttttcccaaaaacatcatatcaaatctttagacacggagcattaaatatagataaaaataaaaactaattgcacagttagggggaaatcgcgagacgaatcttttgagcctaattagtccatgattaggcataagtgctacagtaaccgacatgtgctaatgacggattaattaggctcaaaagattcgtctcgtggtttctaagcgagttatgaaattaatttttttattcgtgtccgaaaaccccttccgacatctagtcaaactaaataggccctaaaaggtgatcataggctcatagccttataggatacataatataagagattttatacggattgaacactttctaggactaagaatcgggtaaagagtttattcagaatcatagtcttgggaagtatcccatccatccttaatatcttaggtagtactccctccgttttttaatagattacgccgttaactttttctcacatgtttgaccattcgccttattcaaaaattttatgcaaatgtataagatataaatcacacttaaagtactatgagtaataaaacaactcataacaaaataaattataattacataatttttttgaataagatgaatggtcaaacatgtgagaaaaagtcaacggcgtcatctattaaaaaacggaggtagtatattttaggacagaggaagtatgtgaaaagaaaagaaaataacttatttaatcaatttatacttctatatactacgacctatttatatttttctctaattatatttaataaaatatttaaaaatatagtataaattgagtcacccatgtaaaaatcatacgcccccgcctctgagtctctgacctcccgcacggccgcaccccgcgcttgacccgtcgcgcgccacgccacgccacgccagccaccgcagcagcagcagcgcgaacgactaaaccccaccggcgccgtacgtacgtcaaacaccaaccatccatccccgtctcctcctccatataatcgcaagccgccgccaccaacgcgagatcgagttagcccggccggctcctcgtctcccttcccgtgtcgcctcgccgcgcgccgccgcccgtgtgtacgtacgttacgttacttcctcgtgccgtgcgttgctgaatactagtatgacggttcgctcggagacgggcggcgcggccaccaccaccaccgtcgtcgtcgccgccgccgtcgacgcgccgcccccgtggcggctgcggaggcagcgctccgtcccggccgccgtcgtcgccaccttcgccccctgcgtcggcatcggcggtcaccacgcgccaagaagagtccttcgcttgggagggaataaggcggcggcggcggcggcggtgcaccaccgccgcggcgaggcggaggaggagggggagtacttcgattccggcggcggcgtgggtgtcctgcgtgcgctgtggaggaggatcgtgagggggaggaggtggaaggtgatgagccggagcgggtcgtcgacggcgaggaggagggagcagtacgcgcaggacgagtacgagcagaacttcgacgagggcgccgccgcggccggcggggagcccgagccggagtacctctcgcgctccttctccgcccgctacgccgccgccggcggcggccggcgatccgccgggctagcgcgctttggcgtttcgcgcgctaattaattattaatcgatgtcgatggtttaaaactgtcgatggcgggtaattcgaacctcgttttgctttgctctcgatatgtaaattaaatttgtggaatgaattatgctgtcctaatccatcgatcgaaatgaagatgaagatgaacagtatggacactgatgatacttttaatattacttttctgcttgaattatgttttgttttcttttttgcctcattctttgatcaaatctacttcatctgtttgactgtttgctctgagcagcagatagtcgaagatagcaagaataatatctctcaattcaaatatccagaagaaaaaaaaaagatcatccattgcaagttctgttcaggcctgatcatatacactttcagataacccatggctatgatcaagagccgtttttatttttccagtgcaacctctcaattcaagcaacgtgttcaacagtgaaaggcatagcgtagacaggtagactaatgccatttctgcctcgattaatcttatattagtctccaccacaacatcaagaaaatctgtgatattagtattttggatggacgaaagtcgtatgtgcttttgactgctgacaaacagcctcatattattgggtgtagttgttcattcagctgaattttcgtacggtcatatctggagttgtcaaatgctcgccagtactacttatccatagttcccaaaagttttttgcattgtggtgaatatataattagtcccggatttggaagaataaccaccagtgattgtaagatgctttgacgtccttgccttaattacctcagaagttgaaaattttttgtttacctcagggttcaggaacacgtgaatcatccttcaacccaaaaaattcttgtcacgataaacagtactatcatagacttgattggttctcttatagtatgagtctactaccagtctaccaccatgtttaaatcgtgagaccggtttacaattattatcaaaatcttgaggaaatgagagttttccgtttactacccctaacatgctaaaccagccgtacgttaccctacctgttttttttttcgtgttacacgaaacagctcccatgaagtccatgatacaaacctgaaaaacaaaggttccatgaagtaggtaatttacttaagaacacccctaaataaatactaaaagaagtgatccagagagataggagactgggaagagagagaaaccaagattatgaattactccatgctctaaaataaataaatcaagtatgtgagatgacctgtctatatccatagtaacagaatatgtcacatgtcatactaggtttgtttatttagtatagggtgagtaattacaaggaacagtataaaacaaaatcagagatcatgaagaacatcagcagtggcttaggaagaacaggaggaacaaaaggccccggtttctgttcaagtgttcagttggatccctggcctctgctgctgcagcagcctaaagacgggagcatctatccatttatcaggtgatttttaataaaaagtcgggtgattttttagatttattttaccctttatttacatccaacggattacaaaagaaaataacaaatacatattaacttacatactatctttaccaaaattacaatgcacttgcatgtaatatcaactgaatatacacatgtaaatttagttatataggaccgtaattttatattttaaaaaaataataaatacatatttacttacacattatttttgtcaaaattacagtgcacttacatattaaatcaactaaatttacaaatgtaattttagttatataggactgtaattttatattttaagtacatatttacttacacattatttttatcaaaattacagtgcacttacatatcaaatcaactaaatttacaaatataattttagttatatatgactgtaattttatattttatagaaaataataagtatatatttacttacacattatttttatcaaaattatagtgcatttacatatcaaatcaactaaatttataaatgtaattttagttatataggactataattttatatttcacgacgacgagagggacggtgtcgctcaccgatcagtgttggccgtgctgtcgacggttggctcaccggtcagaggccacttgtcaccgtgcttctccaatctctatcatcgtgcgcgcttgggctagctggacacaacggccgatgtgcttgtgtccgatgtgccggtcggcagatgagctgaataaaaggtgaaatgttagcaaaaaaaaaatcacgcgagtgatcgatagcaaaatgctcccaaagacaatccgtacaccacggcgtgggccaccaaacagcccggcccatacatggtgtccgttgggctgccagcccatctatgacagctgggcccggctggccggccaacgcggcgtcacccccggacgggccggctagtggtcaaagccggcaactaaccgcgcgtcttcctcgcatcagccgcgtcatttctcacgtttttcccacgtcaaccgacctcgcgtccgcgtcgcacgcacggacacgggctacgcaagctacagtttacactagtagctttcgcctctctagaaggaaaatgacctcacagaattaaattaacttattaactaatggcctcttcttcttcttcttcttctaggttctctgacccctccgaatcaaacgtggcggctgacgaccttccttgtgcaagtcttcctcctcctcttcttctttttccttctcatcggtccttatatatacatcagcacgagctcgccatggcatcatcagcaattcccagttcattcctgcctccgtctccagtagcttgctttgctcgcagattgttccttttttctttttctccggcgactcgagatcgtggctagctagagcctagatggcctcttccatggcgggcgcggcgggggaggagaaggcggcggcgggggcggggcggcgggggatgatcgtgatcgaccggcaggccgtcgaccgggggatcgcctacgcgctcatggtcgtcgcgctcgtcgccacctacgcgctccactagctcgatcaatcggctcagggaggaggaggaggagaagaagaagtcgttccccttcccctaccaacctgcacttcgatcgatcgatgccaaaagtctataactatagaacctgattctttcttattcaattcttctttttagagaaggttaattaattgtgtgtgtgtgtgtgtgagagagagagagagagagagagatcgatggataatttggatatgtacactataccaagtgggttaattaactggatgtactcttctgcatattttggtgttcattggtaacagtttggcattggaatgtctggtaaatcgatgatttacccctttcgcctccaaatacagatttaaatattattttgtactagagaagtagaaatgtagtgatattttcgggagcagttgataatctgaatgctctgccacatcttcacaggttgaacaatcaaattacgtattggctggttatacttgtatcttttcttgagtcgtcgtcattcgtcaacacgctgaatattctttggagtcctctatagatagtagagccgtagaggggcgatgagagatggaaactttcttttgaacgggcaaaaagtctgccatttcatttataggagagagaaaaacacggaccgttcttacaagagggccagagtaaaaagcgaaaacatgatacaataattattaggtaaccgatggcaacaagtatttgcaaacggtggaggatcatctaattaccctcccaaactatcgcagtcatctgaattaccccataaaccattaaaccggacattcttcacccctaattatgcaaaccggacgaattacccccctcgacccaatccacggtagttttggtctacgtggcgtacacgtggcagtccagtcagcgttttttaaattaaaaaattatgagacccacatgccatacacttcttactctctccctattctctctctcactcttttctctcgcacagcgaggacgagcgcggggatgggcggtcggcgaggtgaggcgagcacggtggcgttgacgtcggcgcggaggcagaggcggcgcggacggcggaggagcatggcggcggagctgtgtggcggcggaggagcgaaggtggaggaggagcgtggcggcggagaagcggaggcggcggaggagcggaggcagcggaggaggtggaggcggagtcagttgtggcggaggcagaggcaaggtttgtggtgagagcgtgcagcggcgtggttagcgctttggcacagcaacagggaggaaggcgcgcgcaggtgcatgcatgagcaagaagaggagagaaggaggtggcggaggaaacagcggctgcgacccgccggtgatcgatgcgctgtccatggacggcggcctccgcgaggtgtccctctctgtcgtcttctccgtctggtgcctcctcctcctcctcctcctcctttgctcccagttcctccacagccagaccgacccttcaggtacccacgaacgatccacctcctctcatggatcgatcaatgtcatgtcaccctggcgtttgattgatcgcttctttgtagatttctatgatgacgtcgaggacggaatgcgtgaaaactactgcaaggtaatgccgctggaggcctacattttcccaactgagtataacgcctctgcggccgcgccgacatgccagccatcgttgcaccccccggagccacagcaggaaaccgaccaccggagcctggagccgttcaacaacacaaccggcggcaaatcgtccgcggaggcggcgctcgattagctcgacgagttccagaaccggatcctgcagggcaaggccgagaacggctgcgtccccgacggcgcggcggcccaccggctcgagccaagcggcggggagtacaactacgcggcggcgtccaagggctccaaggtgctcgcccacaaccgggaggccaagggcgccgccaacatcctcggcgccacgctcctccgctaccacacagcttcgctgccacgctcctccaccacctccgctcctcggccgccacacagatccgccaccacgctcctttgccgtccgcgcctcctccacctccgcgccgacgtctgtgccgccgcgctcgcctcaccttgccgaccgcccgtccccgcgctcgtcctcgccgtgcgagagagaaaagagtgagagacataatagggagagagagtaagaagtgtatgacatacggtttctataattttttaattaaaaaaacgctgactggactgccacgtgtacgccacgtagaccaaaaccaccgtggattgggtcgaggggggtaattcatccggtttgtatagttaggggtgaagaatgtccggttttgtggttcagggggtaattcagacgatcaggcggtaattcgcactttttccttaagataaagataaagataaagattaagtgtttcacataaaacgatgtgttaataatgtgtgattaattgagttttaattattacaaacttaaaaaatggattaatctgatattttagaacaactttcatatataaagttttcacacgaaacgcaccatttagccgtttaaaaagcgtgccattttaatccaaagtttatcctccattttcattagaaacgaacggggccactggacctcctccctgccttgcacattgccatgatggaatggaatccgccacctgattcgccgtgctgtatgctccattgaaaattttatcagtccgctgtaaccaaatgcctcaggtcgtgtatatgattattccgtcgaaaatctttttttttttctcctttgccatctcctttcggcaagttcacaaccatgaaggctggaaacatttatctgtctcacattttcaaaaccatgaaggataatggacatgaagtcacttgatgcataaacttagacaataatgttccttcattagaagagtctcacatttttacgcggatagatacaatgatgatctttaggcaatgatgaatccagaaaattgatttgttggtgttataacgtgtttattggtgtcatagtatgttaattatgcttagatcatggtggtataatatatggataaacagttttcctataaattttgcaaaaagtcatcggtgccgtttgacactggtcattacactacactgtagatccgcccttgtctttaggccacgtttgtttcccattaagatacaaagtttgcattagtttccgttaacactttcggaatcttgctatttaagagtattaaacataaattactgacaaaatccatttcataacccctaggctattttgcgagacgaatctaacgagatatattaatccatgatttgctacagtgatgctacagtaatcagccgctaattatggattaatatacatcattagatttatctcgcaaaatagcctaggggttatggaatcggttttgtcggtaatctacgtttaataatcctaaatagcaagatttcagagggcgatttaatagcccggaggatcaaacaaggccaatgtattttgtacaaaattttttttgtgtagaagttgttttaaaatatattagataaacccacattttagtttaaaataattaaaatttaattacatgacttctttcgctttacatgcccgtatttaatcctcatcttcatcactaccaaaagaagcctctcccttcgttctcaaatactgacacgctgttaacaacatatctgtaactttgcgttgttttttccagattatttactggattatcggcacatgtttatttgctctatactttgaaaatatgctttttgaaaaaaaaaactttcttctactacattttttagatcagcagttctaagatatttaaagtcttttctttaaaaaaatatttgatttaaccatctaactaattaagtagataacatgcaacgataatttatttaataatctaaatcaaacatggccctgaaatttgtacgattatactatgaccctacacatttcctttaaaaaaagagcacccataatgactaatcatagactaattagacttgaaagattcgtctcatgatttttatgcaaaccgcataattagagcaggtacaatagcaggctataagccagctgcaaacttattttaaggagataaataagaagagagaagagcagcgggctacagatttgtagccagctgtagcacggactccaagatgcagtgtgtgtatgataagtggtactaggtattaataatgtagtatgtacttattgtatgaatgagctattagattggttatagatgaattgtagctactagttggctatactattaaacttgttggtattttttttatctatatttaatattctattccaaaatttttccggaaccacagggccgaagtcaacagacccccaaatccccaatccacatgccatcttacatccgggacccgttaacccgtttgcccaccaccgtcctcctcctccgacccttctcccccatctcgcgccctcctccttcccggcgccgcgtcctactccccctccccgcaggcgacaccgcgagagccgagaaaacgaggcctcgcgccgccgcctctctccactccggcgcccctccacccacgacggcctcacagcccacctctaccgccgcgtccccgccgtagccggccgtcgcgggcgccacaatggtacgtgcccccccccaacccccccgcggctctctctcgctctcgccttcccccaggctcgcgctgtttaggtttcgccgcgaatgggggatcggtgtggcgaggcgaaccgttcgacggccgcgcctcgccgcgccgtgccgagatccggtggctggagcgtcgaattccgcgtggatctggggttttttgtttgttgcgtactgacgtgattgcattctcgctcgtgttctcctgtgattttttttctctggcggcgaactggcgatggctgtgaatgttggcagccgctcaggttggatatcaaggtaaccaccgcgcgtctccctcggatccgcttagcttagtttggtttgtttagctgatagtgatcgtctgtttgatggttggatcagaggaagctcgcgcagaggtcggagagggtcaagtccgtggatctgcatccgaccgagccatggtgagtgggcaagtttgtgtgggtgacatggttttgggttttgggggtgctagggatgtaatgattgtgttgttcaaagtcacatgaataacttcctccggtgtaatgccaggattttgtcgagtctgtattcagggagcgtctgcatctggaactaccagacgcaggtacgtgactgttcacagtagcttaattcgtcattttctgtctagtttcatgaattttatgagatgatgattatctactaccagcacgatgagcttttgtactgcaaaatggatattcccatccatatgtaaaattcaagttacatttggatttagtgtgcttgtagtagtgaactttgatggtatgcagtgatagtaagttgttccggagaaaaaagggggggggggtaagcatagtgatgaatgaatgaattcttaaaacctagcgaggaattcttcaatgcattgtagaaaggatatggtcaaaacagaagtaacaaggagtcaatgaacttctagatgattgtttcagatgttcgagtgttagctacataattgtgacttctaaaaaggtttgcaaactgtatagagtaataaaacaggaggaggaggtaaaacataaaagtaaaatctagtattttcagtatagtgaaatcgatagaaggaaaaagaaacatacatattttcagtatagttactcttactgttaaactgattataatatattcatctatccccagacgatggtgaaatcatttgaagtcacagagttaccaggtatgctttcccacgtcatcgcttacttctgttccttgatataccatcttgctaatataatcatccccatttcagttcggtcatctaaatttatcgcacggaaacaatggatagttgctggtgccgatgatatgttcatacgtgtgtacaattacaatacgatggataaggtcaaggtttttgaagctcatacggattacatcaggtgtgtggctgttcacccaacccagccttttgtgctgtcatcatctgatgacatgctgatcaagctttgggattgggataagggttggatgtgcactcaaatcttcgaggggcattctcactatgttatgcaagtcacatttaacccgaaagataccaatacttttgctagtgcttcccttgatcgcacagtaaaggtttgtgattttg

SEQ ID NO: 30288 - DNA, 1315 bp, Oryza sativa
attggacattgttacgagacacttcgttgattcaggtttgggactatcaaacgaagagctgtgttcaacggcttgaaggacatgcacataatgtctctgctgtttgtttccatccgaagttacctataacacttactggctccgaggatgggacagttcgcttgtggcactctactacctacaggttctcttgctctctccccctataatagaactcataggatacttcatgcatagtttgaattttgagataaattcatgtacttgttactctcatagatgtgatgttctattgatggcaataaaaactctgttcggtggcataaaatctggttcttaaataatcattggtgtgtcatatctattgatgaccttacaagtgtagtttctggtctccatgtccttgtttcttttggaattagtttgtgcatttagtaatttattatttagccatgtaattttgattgatgcagcattacagtctttaatctagatataagcttttgagtgaaagtgttacatttacgcctatagcataagtttgtattacaactcagtcctattttagtaacaatataggtcaatttacagcttgaagtacgactaactaagaggaatattttctattaaccctgtcctgactggtatcagacctggtagtgatggttgggggttaaactaagagaatttggagttaatggaaacatgaaaatattcaactatactacttcctaacaattggtgatctctgaagtgaagcactgtgtccagagaatttgaagctaccattttcctgtggtgttgagaacaaggagattctcttgccatattatgaaactacttcgtccgtttcataatgtaagactttctagtattgtccacattcatatacatgctaatgaatctatatatattataatgtctagattcattagcatctatatgaatatgtgcaatgctagaatgacttacattgtgaaacggagggagtagcattctacaccaggatatagataaacattttttgaggggtgcgaccaggatgcacatcacgcccatgccacaaacgttcactttcgcgtcgcagtttactatatatgcttatgcttagttggcacctggcaagatattcttatctctgtgcattggtttgttcttttctttttcttttttggaagactgctttggattgttccatttttgtcaatcattgttttaggccttttattcttactgtagacaggaataacacgttgcttgtttcttacaggcttgagaacactcttaactatggccttgagcgagtgtgggcttt

SEQ ID NO: 30289 - DNA, 5312 bp, Oryza sativa
tcggcattacgtacgttggttccgtatatgatgttccggatgttcttttttctttataaaatagatctaactaaatccaaccattcaaaataatgggtccaccaacataagtaaaaatagatggtcagatttttcttatttattatggtgccacttggcgatttgagagtgtttatagggtgccacttggcggtttgagagtgtttataggaaaatataaatattggcaccatccggcctaactgcctaacgacctaggagcgtttaatggacttttagtatataatagatagatagataaatattggcaccatccggcctaactgcctaaacaagtgcgaacttgtctaactgtcatgaccacgggctttaatacttcgtttaggtgctaaaataaaccaatattaatgaaattataaaattgtaaaatttacataggttatacgcagatttgcctatgggtgctggtgtcagcgtagcagttgtatggctaccttatacttcctacctcccatattaagttcattgttagccatctctatttgtccctaaataaattcgtttttagagtaatcatatcattacatcagaacttgtgaaagtggggaatactccctctagagtaattatattgaggctgatcggttgcagctgcggcagctccaagctgctgccactggcagctattttcaatggccacagccatagccgctaggacagccagcacaagcgaacagcctcattaggagtagataaagtgatgaatagttgcattgagatttgataaagtagatgtattatagtatttttgcttttgtattggtatgtgtgtgatgaatgaaaaataaacttattttgggacggaggtagtagtggctacgatggtacactcaatacatacaagtcctatacgtgcaaagtatacatgaaaatgatttcattcttattgaatgatagaaatagtccctattcaacgtgcgtgcatatagatgtctaattggctacttggcatggtccgcctcgggcacaaccaagacacgacctaagatcagttgggttggcacaccccgactgacacaccgtgcccacccacgggctgtatctacggcgtaggcacgacctagtaagactcgagctatgccgtatcggcccgaagacacgactagttcaccatactcgtccttagaataagtctattttcctccctcgtctctttaggctacacgttattgtctgttataagactatttgggctccctcatcgttttggactgtgtcttatatgactggagtaaatctattttgcctcccttttctctttggaccggctgttgacaagctatgacctgcggaagcgttggccgtgccatatcgaggaagaggctcaggcacaacccaacagtcggtcggaccggcatgggcccaataatagttgagccgtgcctggatcggaccaaaactccgtgtcctgagctagaccgtaaggccatgggccttttgaccaactatagttgcacgtcctaggttacgtttgtcgacccatcactcgagattgctatttagcgatcagtcgcgcgcccccttccccgcgcggctggacacgtgtcgcgcgcggagagggggcggcggacgcgtcgcgagggaggaccggaggagcgagttttccttttttccccttttttttccgtttatgttcggttgttttttctttctccggttttttcgttctattcggcctggttttttttggtgtatcttttgtttggttctttttttgtttatttaaagatgtataaatataaagtttatattcgtatgtataccaagtacgtattcgtacatatagaaagtttatatacgtgtttgtatacgcgtatataaactttctatatgcatatgtagagtttctatatgcgatacaaagtttctatacacgtatacaaactttgtatatgtgtatatatttttatgcattaaaatatattcataaaaattatatatatacacgtatgtatatactatatagtatagtatacatacgtatatacatacgatgtatatagtacttacatacgagagagactaggcgagcgagtgatcgcgcgcgcgtggaggcgcgcggctgatcgcgtatcagcgccgcccggtcactctatcacgtgtacatccgaaagcgaattttttttatttttaatttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaaaattttttatattgaaaactatataagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttatgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccatgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcattatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttataagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgtgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgtgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcatggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagatgtccccgtcgagtcaacctgtgaagagaggtaaattatatggctcaatgaagtaagtatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcagcaggatggtgagccagtaagcctggtcgcgtgtgcacaaggacgaaagtcctagcggtgctctcgcagcgacggcctcttctgtgtacggctcccagatga

SEQ ID NO: 30290 - DNA, 10262 bp, Oryza sativa
aaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctcaagcaacatagggcagccagcgataatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcttacaattaaaaatgaaatgttagtacaaaacactctgttgatcgcaaataagcatgtctgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaacaacaccgtccacgggaccaactcgtgctcccgccagcggtagcccgagcaggtacgacacgtcctgcagtgtcggagccatctccccacagggaaggtggaacgtgtgcgtctcaggtctccagcggtctaccagagcgacaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaatgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacaccatacctgcatcaaatagattggtcagaaacatataaataattagtcaacataagtaataaatgttcataagcgaattactaacacatattaaacaagagtacaaacaaacaaaagtgtcaccatacggaatatttctgattacaacaatagctgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacacacatcacatcacaacagcgttttatttcctaaatcgatagcattgttacaccatggaatcgcctgctgcgcgacgacgccttggccttgcgcgcctgcttgttgttccttcaccatgtggtcgcctaccatcacttgcctgtccagatagactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctaagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagacaacttctccttaggctcattctcaatccactgagtgaaatttctgatggccgaccctgacctccttctcattgttggtgggtcatcatgtaatgcaccaagaggtatgggaggctcgtcaccttcaacttgtggtctgcaagattgctcctctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgtatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatacccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactatatcttacaattaacactactgtctatgtctcaattcatactattatattctatgctctggatctacacatatgtgctgtgtactacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctttcggtttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccgcacagtacaaaatcgccctagcggaggccggcaaggggaccgcctgcaaaattccatgccccctcgccgcccatttgcaggcggccccccgcacagtacaatatcgccctagcggagggcggcaagggggccgcctgcaaatttcgttgacggccgtcgcccgagagcgaacggctgtctgccacgtcattttcgccgccctctgggatggcgatttttaaaaatcgccctcccagagggcggaaggcgactacttccgtcaattttcaaaatggaaaattattttttgtaaaacttttaataaaaaaaattaaaaataaaaaaaattcatccgaaagctgtgcacgtaactgacggccccatctgacacgagatgggccggcacagtgcacggggctacagctcactttgcaggaaacttagttagtgggttatgcggtggcccatgtaggataagaagatggtctactcatgcaacggtcccaatgaggcccaatattcgcaaaaaaaaaacaaaatattggacctggccccaccaaccaccacgcctgcgacaccttatccagggtcccactcgtcataatctctgtttggccataattggaaaccgaaactgcgcacagcagtactccatcccattttaatcctttgcacagagttcttatctcagttttcctaactcacctatcttgttttccgcgtgtacgttttttaaactgctaaatggtgtgtttttttaaaaaaattctatacgaaagttgttttaaaaaatcatattaatctatttttttaaaaaatagctaatatttaattaattgtgcaataatacgtacccaacccctccttctgaccacactcttaagagatcttttcaaattgatcatcatctaacctgtctatttgtttatttatgcagaagtaaatgcaatagttgcatgtctatttatccatgtgtgtaggagtaaatgctgtagttacatgtctgtttgatcgtgcatgtggacatcgttgcatatccacatgtatgcttaacacaacactttgattgatgaggtttaattaagagataattaaaaaatgccattgacgaacgtttaaatctaagaaataccatcaacgtgtgggttttaaaaaaataccatcgaacaaacgattttatcctaaaaataccatcaccgttaaaattccgtctattctacgctgttaaatacattgttcgtcctattacacttaacatagcggaatgaaaggaatcataatgacgatgacatttttgataaaattgtttgtacaatggtattttttagaactcacacttatcgatgatatttttttgtatttggacgcttgtcaatgacattttttttaggttatctcatttaaaaaaggaaggatgttttattgtcttggtcttgacgctattgcaaatatgataatcaaatttaaatagaggaagcaaccctttttttcctttcctttgtacaataaatgagctcactgctcacccatcttccatttctgctggctttcgtcaacgaaaaataaaggagaaaaaaaatatcttctcgccgtctcgcgtgctgccgtctccgtctccggcgatggcgccgccaccgccgccaccgacggcgacgaagtacttctggggcgactccccggagcccgacgagtactacgcctcgctgggtctccgccacgccgaggcctacttccagtccccctgcggccgcctcttcacgcactcgttccacccgctctccgccgccagcgacggcgacgtcaagggcgtcgtcttcatgagccacggctacggctccgactcctcgtggatgttccagaacatcgccatcagctacgcgcggtgggggtacgccgtcttctgcgccgacctgctcggacacggccgctccgacggcgtccgcggctacctcggcgacacggaggccgtcgcgagggcggcgctctccttcttcctctccgtgcggcggagcggcgcctacgcctccctcccggcgttcctcttcggcgagtccatgggcggcgccaccaccctgctcgcctacctccgctccccgcccgacgccgggtgggcggggatcatcctgtcggcgccgctgctcgtcttccccgacgacatgtacccgtcccgcgtgcggctcttcctgtacggcctcctcttcggcctagccgacacatgggcggtgatgccggacaagaggatggtggggagatcgatccgcgacccggcgaagctgagggtgatcgcgtccaacccgcggctgtaccgcggctcgccgcgggtggggacgatgcgggagctcgcacgcgtgacggcgctgctgcgggagagcttcggggaggtggcggcgccgttcctggtggtgcacggcaccgacgacggggtgacctcgccggaggggtccaggatgctgtacgagcgcgcggcgagcgaggacaagagcctcatcctctacgacgggatgtaccactcgctcatccagggggagtccgacgagaaccgcgaccgcgtgctcgccgacatgcgcgcctggatcgacgagcgcgtccgccgctacggcgccggcgccggcgccgcggcggccgacggccacgccgaggcgcccgcggcctgacgacacggcggtgcgattctactatgctcgatgtcctcctccaattcgctagattttttcctcttcctttttactagtatcgaattatctccacggacaaatgttttttttttaaataatgtaaatgatttacactcctggtctctaataatgtaaatgatttacatttgtggtttctacaagcaggcgcacaatcaataagtaaagagaagataaataaaaaaactcgaggttatgggataaatcccatctaggcatctaccatctccctcctgataatattcaactataataccaagtagaaaatacgtagaaactataacgataatatcaagcactagaaactacgccatctaaaatagaactcccacggaatatgtgtaggatgaggttgttactcttgcgaagattccaatatgatttctcatctaagataataccaacaaaacgatactcctactctataatattacgttcgttctcaaataaacgacctaaataaacattatctagtacaacgaatttaaatagatacgatacatatccgaaataggtaatgcacagatttattgtaatactccctctgtcccaaaatataagtatttttaaaatagtgccaagttaaatataatgtttaactttgactattaatagcaaaaatcaataaagatcaatcgtgtaaaattgatgttactggatttatcattaaacaaactatcataatatgcaattctttttatttaaaacattttacttttatagatattattggttaaaatagcatctcgaaaactacgtcgaagttcaaaactgtttatattatgggacggagggagtaaaatataattttgttatagcttggttttgattagtgtgcctcctcgtacaaacaaatgtctcacgtggtaatagaacttttgccgacagtcagacacaacatgcaaatgttcagagttgagttcagatgaagagctttatactatacttcctccgtgcaaaataaaaaggcaaactgtgggtttctgtgccaacgtttgactgtccgtcttatatgaaaaatttttataattagtattttcattgttattagatgataaaccatgataatactttatacgtaacttatctttttaattcttttcaaaattttttcaaataaaacgaacggtcaaacgttggtttgtcttttttgggacggaggaattactactgaacagatcacatggattgcagatcagatcagttgactccacgagaggatccccaggtccggagctaattcccgatcagtgtggaaacgcaagcgatcgaccaacgacgtcgcgatggctggttcagcgtggtcaggaatgttcgttcgatcgacatagacctcccaacgcgggcgccgcaacgattcccggtagagtgtttagggtgcgatgttcaggctaaaattggaagtttgaataaaattgaaacgatatgatagaaaagttagaagtttgtgtgtagaaaaattttgatgtgatggaaaagttaaaagattgataaaaaagttggaactaaaccaggccttaatgcgctgatcgagatgacgattgagatgtatggtgccaccaaccggttgcgaacagccgacggtttggaccagacaggcgttgagctatgatctcgtcaatgcctcctgtggatgaacctggagaacgctacgcgtcggacgaacggcgcgagacgaataatcggacgcatccatgagccgtccgatccgcgcgcacgccatcagccatccaacgttatcaagcatgcatgcatgcaaaactatttaaactattttttctcttaaattattatccaaatcatgatccgattgcaccattaaatccgttgcaattaaatctttaaaataagaccacacatgaatatattccggtgaaaaaaaaagcttattattgaattatttttaaatgttgcacgctgtttcaccaagtatattggaattgtttcactaggtagatcgaaaatgttttaatcgtttaaatcggacgctgcttcaccttatataaaaacaatgtttcagcaaatagcgaaagaatatttcgagtcaccgcaacatttgatccatataaagtgaaacattttttgtggaagaaaaaatgaaacgaattctcttaatagatgatttctataatatgtgagtgatttgttgtaaaagaatttttcaattcactacaacattagatctatacataaacattgtgagtacactaggtaaaacatttttagtggaatattgtgagtacactagtgaatacttattgtaacactcaaccaatacatatgcaacatttacaaataaactagtgaaacacaataaactacttactgaaacatgcaaataacaccatgagatatattaaagaaagatatatgcatcgtgacactaaataaatatgtgcaacataatagaatttcagctgaaacatctaattttcacatgtgaaacattaagtttaattggttgaaacatatgtgtgttttttattataatatagtcatatgagatcttgttgtaaagatttaattgcaacgaatacaatggtgtaatcgtatcatagattggatgagtaatctagaagaaaaatcatttttcaagtttgctaaaaaggtgttatgtacatgcaaataacctcgtctcatctctctttcatgcatattaatgctcagaaataaagcgtatgtaacagagagagcatctgacaaagtctgtatgaagcaaagtcatagtaagatgtgtccgatttttttttcaagatcggacgaccgatctgaagtgttttcctagttgttgctatgtgtacagtgtcgtttgtagagcgtccgatttttctccccgtgtcgaatgttcgagacgaagcattttcga

SEQ ID NO: 30291 - DNA, 681 bp, Oryza sativa
caaagcacttccctagttagatgtaggttagacttcccgttctagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcagttgctttgaaacatttgttgctatctaaattccatttatggtcggaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcttacatttaattaacaagagaactattgtatttatctaacacctggattatctccacctttcatttgatccctatttatagattacg

SEQ ID NO: 30292 - DNA, 763 bp, Oryza sativa
atttgaagatgttaaattacttctactaaactgatctctttttttgcatgcgaggtcctatatttatcaccaatctttaaaagtgatcattatttcaataaaatcgcatcttttgctcttcattatattttcttttcttcatgctttaagttgtaatatagtaatatcaatctgttccatcaggctattgaggaaaatggagtagaagagagccaagaagatgctgttgaggttgatgttgaagctgatggttcgactgatggtgctgtccttgtgaacggaaatgataccgaggaacagtggggtacgaacaacgaagaatcatcagcataaaagctgtagttgagcaagtgtacagtcctaaaaccctttttttggtcctcgtttatcctcccagtgcaccaatgatcacaatgaaaacttgatgctggtgtcctcaaaaagaaagaaagaaagaaagaaagaaaacctgcttctggatacaagtgtttattctggactatatcctttagtttaatctgttgggataatttcagttataatttcattttggtattcgagttaatctgttggtctgaccagttttcttagacagtttgaacatgagagcaaaatttgtgcttgctatacatgagttgttgatgttttctaacgactatcttgccttttgcagtattgactcctgaccaatagtgaatcagcgggacagcaacctgatacactgattcagcttgtaagggtgaagtgtttttcatctatacaa

SEQ ID NO: 30293 - DNA, 2923 bp, Oryza sativa
agttggggtagactgatcaatactaaaatgtgacttgagtaaggggcattatgaatcatttattcttctactgtgtcagggtcaacttgttacttatatttattaggcagctgccaagcttatcacaacaatctcctttactgtggtttctgaaacatagtatgatgataaaacctatctatttcaggagagaaagagtataagaccaccattttctgcagagcgtatatttggtggagtattgctggctatgtgtacaaatgattttatttgcttccatgactgggcagagggcaggatgatacgcagaattgatgtcaatgtgaaagtgagtaattttgttcctggatttaaatttttttttgcgtgtcatttggaatattatgatgctaaataggatctgctttcttatttgtagaatctctattgggccgatagtggtgatttagtgacaattgcaagtgacacctcattctacattttgaagtacaatgtaagtttttctgcattttgttggctctgtagttcaatgatgtaacatctacttgatgtaactataacacaacaattataccttccagagggatgtagtttcttctcatttggatggagggggttcagttggcgaggaaggtgtggaagatgcctttgaactacttcatgagatcaatgaacgcatccgaactggcctatgggttggtgattgttttatctacaacaattcttcgtcacggcttaattactgtgtaggaggagaggtaagtattttcattatatcaaaaatacattgtcacatatgatttggttagacccttaattttcaggggtagtataactattcgatgtattacaggtcacaaccttatttcacttggatcggcaaatgtatttactgggatatcttgctaaccaaagccgtgtctatcttattgacaagcaatttaagtgagtcttggttgtctggtattgtatcatattctgaagccacaatgaacttctgaggttaacttgttttcttactgcagtgttgtggggtatactttactccttaccatgattgagtataaaacacttgtaatgcgtggagacttcgatcgtgcaaacgctcttttaccatctataccaaaagaacaacatgacaggtgccccctgttctgctaattattgtactctgcaactcaggcctcagaatctgaagataacccttttattttcagtgtggcacgtttcttggaatcacggggcatgttggaagaagcccttgagatagcaacagactctaattacagatttgacttggccgtgcagcttggtcggcttgaagttgcaaaggcacagatgattaatttatttatcacatttccaagaatgtttttgtctttgttcaaatgttgttaactatttgcttttcaggcaattgccattgaggcacaaagtgagtccaagtggaggcagttaggagagttagctatgtcaaccggaaaggtacagctgttggatgtattagttactatcttctatgagtagtcaatatatattgtgctaatgaagtgggactgttctgccatggcattttagtttcttgattattagtaccagtataccgtgtaacttaataattatgagcacacaaataaatccctccgtccaacaatataagcacttgaagcatttgaattttgtccatgaatataagcatttctacaatacatatgtaaaatcaatcgcctcatttaaatttcttcccatcttacgcccaactactcttcaaccccaaccttctcattaaatgagggcactaaagtactttctcctcaactttaatctttgctcaacagtctagaaatgtttatattgttggacagaagaagtatataattcaacaatggcatttgtgaagagataatattgcagttttgatgggaagtagctttggtcgttgctatgatgcttgaattatgaacctaagaagttattttgccttcgcttttgctctttccatcttttgtactacctctatttcattttataagtcgttttgacttttttctaagtcagacttctttagctttgacgaaatctatagaaaaatatagcaatatttttaacacaaaagaaaaaaactattcaaatatattcaatgttagatgtaatgaaaccaacttggtgctataagtgttgctatattttttctataaacttggttaaacattcaagaagtttgatttttttaaagaaagtcaaaacgacttattatatgaaacggaaggagtagttgtttttaaaagtagaattatgcgtgcaaaacaatagttttgcctgatggcagagttctgtgtgtaaaaaaataacttatcatcttagttttaagtagaattcttgcaatttaataactttgccatgttatgtttcagcgccttgccagatacaaaactggctaaaagagtgcactcatattctaacatgtcaagtgtcaattacaattctgcagcttgatatggcagaggagtgtcttctacatgctatggatctcagtggtttattacttctgtattcatcccttggtgatgctgaagggctaacaaaattaacatctatggctaaagaacaagggaagaacaatgttgctttcctttgtttcttcatgcttggaaaactggaagaatgtcttcaattgttaatcgaaaggtattgccatttgccaagactatcctatttaatagtacaatgcttattcagaaaatgtattttttattttatggtgatcacgttatattctctatacagtaatcgtataccagaagcagcattgatgtcgagatcttatcttccgagcaaagtccctgagattgtaacattatggaaaaaggatctccaaaaggtaccatctgtctcttttttccccctccaaaaggtacccagt

SEQ ID NO: 30294 - DNA, 9206 bp, Oryza sativa
cttcatgctaggaaaacttgaagaatgccttcagttgttaatcgaaaggtattgccatttgccaagactatcctatttaatagtacaatgcttattcagaaaatatattttttattttatggtgatcacgttatattctctatacagtaatcgtataccagaagcagcattgatgtcgagatcttatcttccgagcaaagtccctgagattgtaacattatggaaaaaggatctccaaaaggtaccatctgccctatcccctataatatttctttgtttttttctacctattctcatgcttaatcttttgcacacctgtattagatcgtgctcagttgctcacattttagcgtgacttgtctcttcaacctaagttacatattcaagcatgaaatttctgttcggcattactgatgatttttagtgatgtttagtgatgtttcagtcctttctggtggtaatactgatggtttttagtgatgtttcagtcctaacaggcagaatgccccatctaatttttgtgtacctgataaatcaagggcattttgtctattatctaagctagcatgaaaaaaccaaccaaaagacatgcttgttatcttgtgctagagtattgttcttattttcagacttacgcgacactgtttaatttgtaggagctatgtgttttattatctcaccatgccttttttccttctcatgccattatctttataggtaaaccccaaagcagcagaatcattggcagatcctgacgagtacccaaacttgtttgaagactggcaaattgctctcaatgtagaagctaatgtcgcgcccaaaaggtatgttcgtaaaagtaaaaactatgttcttttgtgaaagttttaccagttctctcttccatgcatgggacaagtcgtcaaggtttgctttcctcttctctttaattgaaagcatctgatgaaataagaatgatgtcctctaccatgtacaggatgtggggttggaatatcatatttagcttcaattgaacacatatagtgaaataaatagaagtaatgtcggtgctcatttgtattgtttttctttattgttctgatgaaatcctgtttgaataggggtatttatccaccagctgaggagtacattatccatgctgagaggcccaatgagactctggtggaagctttcaaaagtatgcatatacatctagaggaggtgctgccagatgaaaatggagatgacactcacgaggtatcactcctacggaaagagttgtaaaaaaatattgttaaatagtgggtagctatttgaagatgttaaattacttctactaaactgatctcttttttttttggcatgcgatgtcctatatttatcaccaatcttttaaagtgatcattatttcaataaaatcacattttttgctattcattatattttcttttctccttgctttaagttgtaatatagtaatatcaatctggtccaccaggctatcgaggaaaatggagtagaagagagccaagaagatgctgttgaggttgatgttgaagctgatggttcgactgacggtactgtccttgtgaacggaaatgataccgaggaacagtggggtacgaacaatgaagaatcattagcataaaagctgtagttgagcaagtgtacagtcctaaaacctttttttcgtcctagtttctcctcccagggcaccaatgatcatagtgaaaacttgctgctggtgtcctcaaaaagaaaagaaagaaagaaagaaaacctacctgcttctggatacaagtgtttattctgggctatatcctttagtttaatctgtccgggataatttaattttggtattcgagttaatctgttggtctgaccagttttcttagacagtttgaacatgagagcaaaatttgtgcttgctatacatgagttgttgatgttttctaacgactatcttgccttttgcagtattgactcctgaccaatagtgaatcagcgggacagcaacctgatacactgattcagcttgtaaaggtgaagtgtttttccatctatacaattagcgacagttgttaacaactattcatttattatagctaattattttttgacaggttgctgactcctactgaaactatgtgaaggccgttttcctccacttgtataatcattgggcgtgctttaagatcggcatatccgacgataaaacccacagaaattagtcatcgctttgtccttgtttgagatagaaaattttgtacctttttacacacataggtccttactgtgggttctcaggatgctttatatatacgagggatgttcccttcttgttgaggttgaatttgattagctaaaccggatccatattttacacaaagtacatagggtaaaatgttaaaccagccgaacattacctttttttttttctgtttcatgttacacgaaccagctcccatgaagccatgatacaggtaattcactaaagagcacccctaaacaaaaaaaatagtataccagaaaaatgggggactaggaagagagagaccgcgagtaggaattaattacaagaaacagtataaaacaaaaatagagatcatgattcatgaagaacagcgacagtggctaggaggaaagaataggaggaacaagcccatgcaacttcatctgttaagttggatccctgcctttgctgctaccgccgctgctgcagcctgcagaccagtgtgtacataggagatgcgacaagctcagggaactagggaaaaatgagagggaggtgcggggagcgtttttataggctcgggagggtgaaagggagctggggcgaggcggatttgggcggcgacgacatgggcgaagtggagctcgattaggcgccagaatttggggaaatgtggagaagaggtgtagtagtgtgcgacgaccgggcccgcatgagagagggcgcgaggaggcgcggaagaagcggcagcgtggggcgggtgcagtgaccatggcggtttcggcccgaggagaccggaggtaggaggaggagctgacaggtggcgtcaccggtcccacctgtcggcgagggagggagagaggagaccgagagaggaacgtgaaatggacagcccaaagaggaaggaggagaggagggcggcccgatagggaaaagaggaaggaggggcgggcgggccaagggaggagatgaagcctttgggccggaagcggcccaaagtgcaggaagagattttaaatggttttctatttaatttaattgattaattgatgtttgtactattataattactttttgagctctgaaaattcacgggaaatttcagagagtaaattagaacatagagaattttacaaaaatattttcggccatgatttttaaagaaaatttttaattccctcaataattcacttgattaaattgctttaacttttaatataatttctagaaatgatttatttaatgatttttaatcccgaacgaaaatcagggcgcgacacgacagcttatcatcgtctagagaagttgtttgcttggactgggcttaaaactgatgttaactttattaagcagtgtcaagtatgtcagcatgccaagagtgaacattgcaagttgccaggcttgctggtacctcttcatgttcccaaagaggcttggatggatatctcaatggactttgtggagggtttgcctaaatctgatggctattcagtaattctggtagttgtgaatcggttcactaaatatgcttatttcattcctttgaggtatccttttacagcctctcaagtggctacaactatggatcgttctgtgtttaaaacatatggtattcctcacttgattgtctctgatcgggatatgatatttacaagcaaattctggggagatttgttcaaagtttggaacacacagttgcaaatgagtactgcgtatcatccacaaaccgatgggcaaaccgagcgtgtgaatcaatgtttggagatatatcttcgttgtgtatgactcaggcttctcctcacaagtggcatcattggctccatcttgccgaatattgatataacacttcttctcacacctccatgggctgttcaccatataaagcattctttggtactaatccccactccaatcagattcctgttctttgtcttcaactcatcatgctgtggatggatttagtatttgaatgtgatcagctctcagcttttcttcaggagcaattgcaaagagctcagttacgtatgaaacacaaagctgacaagggtcgttctgaacgtgctttttcagttggggaatctgtctttctgaaactctagccgtatgttcagtcatcgatggtcaatcgtccatatcccaaattggcgttcaagttctttgggccttccaagattctagagaaggttggcactgctgcttatcgtcttggtttgcctgatcacagtttggtgcatccggttttccatgtgtctcagttgaagccccatgtgccggctcacacacctgttttcggtagtctgcctactcttgtggttctggatgcagttgaagttgtacctgcagagatccttaatcgtcggcttgttaagaaggggaatgctgctcgaatgctgctcatgtgcaagtgttgatcaagtggacctcgctgccagccgatcatgcaacttgggaagactatgacgtactccctatttgtcaagattaatagccaaaagttgttatattttggggtggagatagtactgaagaatcccttcccttgtgcgccagcttggggacaagctgatactttggcgggtggtactgttactgttacgagtgtatgagatatagactttcatgtgtgagtgggcctgcgagcccaggaggatttaggcctgtgcgccaacaactagtatataagcaaacagaaatgagaaatacatctctcctcccccgacaactctgttctaacttcttcttcctcagttcctctgcttctcgatcttgagcgatttcgaagatactactctcttcctcaactccgatcagatctagcctgattccggcggtgaacggcggcggaggttgtgtaacagccgcgtccccgccgtagccggccgtcgcgggcgtcacaatggtacgtgactcccctctctctctcgctctcgccttcccccaggctcgcgctgcttaggtttcgccgcgagtggggatcggtacggcgagggcgaaccgtttgacggccgcgccgcgccgcgcggtgccgtgccgtgccgtgccgagatccggtggctggagcgtcgaattccgcgtggatctggggtttttttttgtttgttgcgtactgacgtgattgccttctcgttcgtgctttcgtgtgattttttttttctctggcggcgaaatggcgatggctgtgatgttggcagccgctcaggttggatatcaaggtaaccactgcgcctctccctcggatctgcttagcttagtttggtttgttttggtgtgtttagctgaatgtgtttggtggttggatcagaggaagctcgcgcagaggtcggagagggccaagtccgtggatctgcatccgaccgagccatggtgagtgggcaagtttgtgtgtgtgacatgatttttgggttttggggtgctagtgatgtaatgattatgttgttcaaagtcacatgaataacttcctccggtgtaatgcaggattttgtcgagtctgtattcagggagcgtttgcatctggaactaccagacgcaggtacatgactgttcacagtagcttaattcgtcattttctgctggtttcatggattttatgaaatgatgattatctactaccagcacgctgagcttttgtactgcaaaatggatattcccatccatatgtaaaattcaagatacattggatttagtgtgcttgtagtagtaaactttgacgatatgcgctcatagtaagttgtaccagagcccggaaagaaaacaaagaaaaagaggggggggggggtcaaacatagcgatgaatgatgaattcttaaaacctagcgaggaagtcttcgatgcattgtagaaaggaatatggtcaaaatagaagtaacaaggagtcaatgaacttctagatggttgtttcagatgtgtgagtgttagctacataattgggacttcttaataggtttgcaaactatttagagcaaaacaggaggaggtaaaacataaaagtaaaatctagaaatcgatggacggaaaaagaaacatacatattttcagcatagttactcttaaagttaaactgattataatatattcatctatcctcagacgatggtgaaatcatttgaagtcacagagttaccaggtatgctttcccacctcatcgcttacttctgtttgatataccatcttgctaatataatcatccccatttcagttcggtcatctaaatttatcacacggaaacaatgggtagttgctggtgccgacgatatgttcatacgtgtgtacaattacaatacgatggataaggtcaaggtttttgaagctcatacggattacatcaggtgtgtggctgttcacccaacccagccttttgtgctgtcatcatctgatgacatgctgatcaagctttgggattgggataagggttggatgtgcactcaaatcttcgaggggcattctcactatgttatgcaagtcacatttaacccgaaagataccaatacttttgctagtgcttcacttgatcgcacagtaaaggtttgcgattttgttccttacatttgcttggcatagtttttgcatttctaacatttcttggtctggatttgaatgtggtgcccttatttaatttcaggtatggagtcttggttcccctgatcctaatttcacattagatggccattcaaaaggtgtcaattgtgttgattactttactggtggtgatcgcccatacttaattacaggctctgatgatcagaccgcgaaggtatgccatctgcagtgaattatcttgtgagtatattggacattgttacgagacacttcgttgaatcaggtttgggactatcaaacgaagagctgtgttcaaacgcttgaaggacatgcacataatgtctctgctgtttgtttccatccggagttacctataatacttactggctctgaggatgggacagttcgcttgtggcactctactacctacaggttctctcgctctctccccctatgatacaactcataggatacttcatgcatagtttgaattttgagataaattcatgtactcgttactctcgtgggtgtgttgttctattgatggcaataaaaactctgttcggtggcataaaatctggttcttaaataatcattggtgtgtcatatctattgatgaccttacaagcatagtttctggtcttcatgtccttgtttctttacgaattagtttgtgcatttagtaatttattatttagccatgtaattttgattgatgcagcattacattctttaatctaaatataaatttttgagtgaaagtgttacatttactcctatagcataagtttgtattacaactcagtcctattttagtaacaatatagagcaatttatagcttgaagtacgactagctaagaggaatattttctattaaacctgtcctgattggcatcagagctggtagtgatggttagggtcaaactaagagaaatatgcaactataccacttcctaacaattggtgacctctgaagtgaagcactgtgtccagagaatttgaagctaccattttcctgtggtgttgaaaataaggagattctcttgccatattttgaaactagcattctacaccaggatatagataaacaattttggggggtgcgaccaggatgcacatcacgcccatgccacaaacattcacttacgcgtagctactatgcttgttagttacatgaattacactgtcttcaataagtattataggttactatatatgcatatgcttagttggcacctggcaagatgttcttatctctgtgcattggtttgttcttctcttttttttgaagactgctttggttgttccatttttgtcaatcattgttttggatccttttaatcttactgtagactggaataacacgttgcttgtttcttacaggcttgagaacactcttaactatggccttgagcgagtgtgggctttaggatacatgaagggttcaagaaggtattggaaatattacactcttactattcggatgctatggacttacggttaatgtcaagtaccatgatactaaatatcacctattcatgtggtattgaagttccccacacccaaaatgaatcaaagtataaagatttgattagtttagcgtatatgttctctgctccatagttctctcccaatgtagcaataacatttttcgttgtctgctaaacagtttattccacaatttgctcttcacagaaacccttttcttttcatgttttcattaacttcttccttttcaagttaatttagtgatacgggaaaaaacttgacttgtgcagggttgtgatcggatatgatgaagggacaataatgataaaaattggccgtgaagttcctgttgctagcatggacagcagtggaaaaatcatatggtcaaaacataatgaaatccaaactgttaatatcaagactattggtgcagacaatgaggttttcttgttcaccatgctaatatgttgaaaacttgtatactttcttatacgtcttgtttactaacctgttccatttttcagattgcagatggtgagcgcttacccttggctgtgaaggagttgggaacctgtgatctttatccacaagtatgttcatattttctatttaaatgaatgcatcattcgcatagtgatcaagtgatgttttccaccagaaccaacttgatgcttgcaaatgagtcccaaatttctgcttgagtttctttttcctattcattacatgagtcacatgtatacaccatttgaccatgcatgttgaaatatttttaatatgttaatttatttgacatttgcactggtgagttgttttatttaaacacaccttggagattctgttgttgtagtaaaattaaattaatctcaaatctagtatagtgtaattatagtgtatgttagtaattatagtaattatagtgtattcatttcagagcttaaggcacaatccgaatgggagatttgttgttgt

SEQ ID NO: 30295 - DNA, 19388 bp, Oryza sativa
ttcgacactagtatggcatgaacagactgaaattctgctttaaaagaacttatttgccattctgcttgccgccatctttagcacctgacacgcactgatcacataccatgcttgtttacgtcacttgccgtggagtaattttatcatcattaaggataagaaatcatagtgtaaaatttgatatcttctcgaggtactaaaatttttaattttaaaaaattttctcgaggacccaaaaatttgagaaagcacaagaatcttcaggtacatacaatatggtgaaaacaacttagaagtttcgttttgtcctgagtatcatacaacattccaaaaatggaccttacacaattatacatatcaaccataatccggtattaccatccacataaattttaatagccaactgcactgggggaaataaacaacctgggccaataagaatacatgatttgcacatggtccatggagaatccgaaaagaaagtcaaaaaaccattcgaggccccgaggcctcatccttcccaaatatacatgttgcaaccgcatcaaacacaaatatacaaacactattggaatgcgcatcaagaactccgaagggtggagcttatgctcagacgcagttacgctcgaccattgtccttgtggaaacgagttgtacaaccaactacagcggataaatacacaaccagtagtatgaattaacaaattctctcgagggctagtatggttcctgatcccgctgggcactgcaaaccctttgtccgatgatgcacaagaactccaaaagagcagataatatcgcacgtcgattgtataatgaccttacccaaaaggatttcccccaacagagccataggaaggtggggtgcttggctgggggtacctgggagcagcttgttgatcaaagcccatgttgagggaacccaaacctccttgttgcctgtaatgccacaacttggacataagcgtcgaaacaacaaaaaattgcacaatggaaccaacaccttggaagtattttaggacggaaatacgtcttgtaggaactaaaacttaaaatgaaagaatgatataacacaacggaaccaacgcaaaggctggtgcctttggttgcagtaccagattttaatgacacaaacaatgggcatgccactagaaggtggatgctattgtttatagtagagcaaaggtgagataattctgaaagctacgggtttcagtggttgatgtcaaccatccaatctggtcgaatggactcattaataattagtctctattttaaggttgcatgctacttcctactcctacatcccaaaagatacaacaaaaatggcagaaaaaaaaaatcaacacgagcaaaaagtatctttaaaaaaatgctaaaaagttcttcactacactttcagcttaggagatacactaaatacagcagtcaactcacattggaagcatggtattaggtaactgctcagacatgtttggaacttgctgcatcatgtaatgatctgaagttgaaccacaaattagcacacagataagaaatactaataaagagcacaatttcagagattatgctgagatatggaaatacttggaggtgcaggtgactggtacagctgctgaggttgctgtggaaggactccaaaactcgaggtaccaagtaaacctgggggagtcatgccagcagatgctcccagtggtccaggtaggggctgctgctgctcaaggacacaaagattaaccatgttaatggagcaaacaaagatggtgagtcataccagctgatccaggtcgggattgctcaagggtacaaacaatatggtcgcactatcgtagtgcatcatcaagtataaaactaatgcacttgacagttttttagaggaagaggaccaacatttacacgaatatcacaatgttaatgaaacaatcaggcataattaatagacaagatacctcaagatttacaagaatagtaagtgaaacgatcttagtttgagatattttgtaaaagaggtatttcattctcttcattcataccgtgtgagcttgaactggagctggctcattcccaagatcaaaaggatttgatgctttcgcaggttgggggtatgcatgttgctgttgcggatatacaggttgttgatatgcaggttgagcaaatgccatctgaggatatgcttgcattccctaaaattggtaaataatttatctagttaggaaaaacatcaacatcagatacacaataaatcgctaatatgagaatgatagataccattgcagtctgatatggcatggcatatcccattccaaattggggtgttctctgccaaccccctattgtttgaggtcctggtggatataacgaagtaaagatatcctgcaaaaaaatgatctaagggtcaactatgctgacacaatgattttatggagcatattagtggccccaccaggtttttttttcttctctaatatgaccatttttcacagaaaaggaaaaggatcgcacagttgtcctcaattcaaagttagtttaaacgatcttgcaagtgaaataggggtacaacgaaaagacaaatgaactgagaagcattgttggtcacaaccagcatgaatgggcgactcagatcactacttattacttactggaagtatagactcaaaccaatagctatatattttttttctttttttcctttttttgcataatgatgacctgaatgcctgtttagctttttcactcgataacctgatttatttccatgtatctggttagtcaacccagatatcacattcaaatgcaccaacaattattaacaccattattcaactcttgccctaccataccatgcattgttttacatgcatatattatcatctctcaataaaaaaaagttaataaccatgtaacccccattaaaatgcaatttaatatgtaaacaatcaacaaatctcacctagttttaaaccaacataactgatcgcataggaaatgatatatcctaccaacgtattaacagttagctaatgcttgctaaacagaaataccacctctgacagatcaaaagatcatcatttaaccttgggccaccacaccttacattatttgacaagatttcaaggaaatactagccatagaaaaactgtaagtgtcagtctcttagcagttttgagctctataccttttatcatgtactcctgttctttttttatctgacactttttaactccataaaatttcagcacgacactgcaaataacttttgtaactttatgtaaattattaaaggcacctgaatatctagggacacatctataatccaatacatgtatatgctcaacaagaattttggagcttgggtatgaaatgtaccccatatgcatatggtaagtgaaatccgaactaagaactcatattgactagtactcaatttagttggactgcagtgattatatgtcatgaaattagttcatgggaggataaccatatcataagtcctgaacctcaaagcatattgctgtcctatatattataggtaatacaccaacaggtatcgacttggaagcctaggcaacaacaaagtgcctcatactgctatcctatatattataggtataaaataatgcagttcctctgcaacttacaacatggattctaaagcgtcaaagagaaaacggttgtgctactaatctggtaagtagttggttctatgccctgtccacaaatttggtaatttcagctttatgattcacaaaatatggttacaataagtttagaaaatggcatcgcatattgcacaagctatactgtagaacatacaaattaacggattacatatctaaatgaagccaatgaagcaaaggggtggggaagatgaaacaagtcagtagtgcagggactagaaaatgctgcaatgctagatgttcaattctctacaagcagttaatcacataccgctggaagttctttccggccaatggatctactgtcagtattaggtgctgcttcttgaatgccactagttgctcgggaattcgcagagacctggaacggaagtccagctgccggagcagctagaccagtttgttgaactgaagatccatggatagacattcctgttgaggcctaagaaaagtatcaagtgaaaacctatttcaaggcaaaaaaagaaatggaaggtacacagatcgacttctgatattcctctgcaaacggaagtacctggtgacctgagactcagggggtgcaccaaaaaatgaagaatgtgactgccccatcatggatgaccctccatcatttggaactgaagtgggcatgaccgaagctggaaaagctgatgaattgggtgcagagggtgtttcagaaaatgatagttgagcaagtgcagactcaaggggatctacactattgccagtttgtggtgtttgttgctggccgaaagaatcaaacgatgcccagtcaccaccaccactgctcactgatgacacatttttcccttgttccacagcaggctgttgtgctggtgcattaacaggttgcactggctgtgcactagcaggctgctgttgtgatgtaggtgtagattgtggaggtggcacagatgcagaaggctcaggatcagcactgaaatcaattaaacttatcgtacttgccacttttatctgttcggaggtcccctctgaagaaccaatactgctggcagttgatgtcctctacaattatgaagtatgtattgtaagctaatgaattgaacctactgataaaattatcagcttaacgtggaaatggagacaagaacatggtgatatttctaaaagcaatgtctgcaaaaaaaaaaaggaaacatcagaggaaaataataacctgcatctgtggtggaggttcgatggttctggttccatttggtcttggaggatcaattggccttggaggatcaatcggtcttggaggatcaatcggtcttggaggatcgattggtctcggaggatcaatcgttctcgctacatttggcttaggaggctcaccaacccgtagttgaggtgcattatcacccagtatatccctcactggccgtacaacagggctagatccatcggtttccttctggtaatttggagacccattatctggcctctgtggttcagaaggcctgcggtcctcaaaccgttgaactggagttgtttttccagatctatcctcacgatttctatcatcaacttcaaagtagcgggggcttttcttataatcattatgttcatagccaggacttcgttctccataggaatatctggaatttctgtcatcgctccttccactataactgcgacgatcagaatagctttcattgtatggcggacttcttgaaccaccccaatttccatcagatctcctgttttcactatactcatccttatcatcctagaagatacaaagaaataaggaaataacgaatttaggatagtataatagcaatttccaacaagcaatggcaactgcaaaaaaacaaggatagttataattagccaacatatcacctttcccctcggtggccgatctgcacttctttctcctgtgtatctccgttccacataaacatgcttaataaagttcctcaatttatccgcattactgagaccaaaagaaacaggtcagaattccaagataaaggaaacaagttgtaatctaaatatggtatggctaaacagaaaggtaacctgctgtcagggaaagaattgcggtgagcatcccattccttgaagaatatttctctagcacgctacaggttatgcaaaacacatgtcaaattagaaaggcctaaaatggtagaaaacatgaaaaagaaaagagaggacaagtcacctcatttcctccttcttgaagggcactaacttcctgtgcagtaaatttagccatagaaactgacttcgctcgatgcgtgaactctcggctagaagcaaaacaaattttgtcatcaataaaattaggatcactgacttcactaaaatgcatctaatttgaccaaagggacagtgaagctagagaggttcgacatattacaagtgtaacaaaacagaactgaataagaatcttactgtgctccactgcaattggtacaaatgaaggtccagaaatttgtacagacatattgtggtccctgttaatatcaatatatgtgattcagtaatatacaaaaaaaattaggaaacaaagtaatgcacatcagtattacacaaatacccactaattaagtctactttcccaacaaaaacatgtgtggagcacctaagcaaggagtactctgctgaagcaaaatatgggcataaatataagcttgaactatcttagagtccacctaattgcaagagtggagtgcaatcctccataatcttgacatgacattattaggcaaacctagctgcttctactgccgattccctccagtacacatattgcaaaactcttcaagttccaaatgatagattttgacattattttgggtgcaccatagaattagaaagcataatactccctccgtcccaaaatatagcaacttttagctatgaatctagacatttacttgtccggattcatagctgaaagttactatattttggaatggagggagtaatttattctacttgtggtagagaaaattaggcaaggctcgctgtgatgactagttggagatttccaaataacctcattgcgctgtagatcgagtaataaacgaactaccaaaaaaggcttatgtagtgaaaatgtcatgtggactgcagatgattcatgcttttccaacagtagaaaacatttgcaacaactgatggcatctaattatataggaccccactgttgcaatagcagtttaagaaaaaaaatcatttattttgcataataatagaagcaatcactaattggcatactctaaaagagtaaaaaaggtgaagtcaactgccagaacaatagacatccaaatgggccatgataatatagtttccttattgatagctgtggtaaattattaatgcccaaaacaactagcagatcagtcaagtcaagaatgctatttgccttaaatagcagatactatgctagcagaaaaagaaaaggaaaaaatcaagcttaaagaaatgcatagagcctaaagtgcagcgtgcaaatgtgcatgtattagcacgacagagtttagggcataaacagaagggaaaaaatattaaacatccatgaacgcaaggtcaactaagctattcaggtggttgaaacaacacgtgaatttttagacatcatctggagagttaacaatcttggtatatagtagaatattactccctccttcccaaaatgatcatcatatatgtttatgcaccaagaccaaggataatttaaatcacatcaatcaagacaccatgcacgcattctcccacaatgcatgcatcgatcaaaacaccatgccaattacaccttagcatgcacacattctcccatgctgcattaattgtattatgatgaaatccgtgtccatgcggttatatgatgatcaatttgagaaattttgaattccattacatgatgatcaatttgggaaggagggagtagcatgtactgccttgcaagtgccagaatgtcacaaaatacacgttttggtccaagacgaccatagtggtttctaattttttttgcttatgatcttcaattcttcatcaactataatagcaaagagtatatgtcaaagctgtttttcgactagggatttattaaaattccacatgttgtaattcaattataaagaggtgttctttttattttattttctgcttgtgctgctttttgaagggctgctttgttttgtcacaccacagacaatgtaagcaagtgtgacattcaccattgactttgactgcaaagatatgaacatgataactttgagacgctcataatccgtttttccgcaaagataagaatactttagcagctcataagcgccattactttcttgatacttgtatcttaggtacctcttggccattgttctagtcctaagtcgtaacgcgtgatgtatatctggcagaaagtagcaacatttgtcgtctacataattaattacatgaaaaagaatatgctgtgtgattacagggcatggcattacatccagcaatagctccacgcattactctccgtcccaatttactgaattgtgatccagtatcaaccagcctaataaaataccgctatccgatcggaaacctacctatccagccagccaatgagatctcctagtatgccgcaaacattcgcgggtagctctaaaaccctcgccattactagcaacgctgaagtataaagccaagcgagctcaaaaaccacttcccctagatcctagccaaccccgccgaaatcctaccacatttagcaagcgaacagtagaaagccagcgggaactcaccaaattgttgcagttgatgcacctcttgttggcgggcagcttgagcagcccgcgtatgatccgctcgttcctctcgtcctccttgagcctgctcgccatcgccgcccggatccccggccgccgctgccgccgccacaaaccctaaaaccccaccgccgcaaaaaaaaaaatcaaacaaaaatatcccccaccgaaatggctcgagatccgaccaacccagccagatccgcccacaattagagcaaagccaccgccaaaatcggcgagcactcacctgccgacgcgcctcctcctccgatggcggcgctcgcgcgagatctcgcagcggaagacgaggtggcggcgagcggcgacgcgaaggcttcgcctctttcgttcgctggctgcttcgctgcgcgtgtaagtaagtaataataataaaactgaaaaaaaaaacttttaattaaacctttttttctctcttccctttctcgtggggggtttgggagaagaaggcgaaggttaggcagccggtcaaccgagagagcggtgaccggcggcagccggtgggttggtggggcctggggtgtgtggggcccacatggcagtggcggttgggtcggttgtgggtgcgtgtgtgagctggacgtgggctgttccttcaccggcgtttctggtctggtcttggtttgtttttgggttttcgctgagtcgctgactaatgatgattcctgtctccgcgctgtctcaccgacaggtggggcctaacagaaagaaggtattttttttttattttggggggaagggaagatgatggttctagaacctttgtggttgagttggtggcatgtagtgatagatgaattcatctttgtttttgttctctttggatgcatgagagggtaatgaaggttttgaatcagttgtttgattagatgttttgaggtttactgtgttttattaagttattactaggtgatatcccgcactttgctgcgagatttatagatatatattaaatattatcgaaatgataaaagttgaaatgttaaaaaaataatgttaggaagattatttgacatatacttgttgatctctataatataatattgtagatataatataatattgtagataatatgttatgcttgcatgggatttaaaataggctagaatagtaatcgctagtgagtgaagatgtggtatacttgcatgggattttaaataggctagaatagtaattgccagtcggtgatgatgttgcatgcttgcatattgaactttagcttctatcaattgttagtgggtactaattatataattatatagaaagtatagattagtatgtgcctgattactatttggaagcatgttaagggaaaattgggtctcctgttcggagaacatgctttacggtggtctttttcaccccaggctataatgttgacgaaatgaaaactgaaactatgacgatgtccacatcttctaataatctaaaagctagctcttttgctagctttcgattggtgcatgtggcgccttttactttgaagaaaaaacataagtttatactagagaaaaaaaaacacctaacaatcatatgtgaggaaaaatctagagaaaaatataattccagaggcttccaaaactatcttctctttccaatcacacagaattctacttatttgcctcctataaatataacacgcctactcgataccgctccggtaactctagaatatatagtaaacctaaaaatattaagcaaaaaaacatatctaaaacaacaaatttacactcattttctttctttaaatatactaatcatactcggtactattagcttgcgcttttgttagctttcgattgatccacgtggcgcctcttactttgaagaaaaattataaatttatactagggaaaaaacacctaacaatcatatgttatgataaaaatatcacatatggattccagaggattccaaaactatcttctatttacaatcacatgtaattctactcctttgcctcctataaatataccacgtctactcggtactactcatataactctagaattatagtgtaaaacaaaaattattaagaaaaaacaaatctgaaacaatgaatttatatttattttccctcttttaaatatactacgcatattcggtactacccatataactctagtctagaatatatagtgaacaaataaatcatttatatataaatccataaaatgtttctttaatatcatatatgtccatttgtcaaaactaaaataatggttcataattttatttctaaaatattttatgaaaactttaaaatttcaaataagaatgtcacagtaattatccagcatgtcacagtaaatcttcccaacactctggtttaaagtagaaactcgtttatcacccccaccatttgtgttcattgtcttctccagcgcattgttcttcatcttcgccaaatgggtgttcattgtcttctacagtgtttgttgttcatcttcttctctagcaagaagatacgacttatataggtcatcgctctcttctgctagctgccaattatataatataaattatcaaccttgtcagtgtttaaataaataaacaaaaataaaaagagtgaaagtattgagcatcaggtatttaggtcaggtgtaagtatttgttgctactgtcggttttcgtagtaacatgtactactctgaatttctcttttaaaccacttatgtgataagcattaatgttcatccatacctcgctagaatgaggcttcgaccgtgctgatatcaacaccaactggttcatccgagtgaattctactacttatgtgatagcactaatgttcatccatacctcgctagaaggaggattcgaccgtgctgatatcaacaccaacgggtgaattctactgtgattacaaggcaaaaacgaaaacatcaaaaatactacaccgtaataataattacttacttgaaaacatcaaaaggaggtctaaattatgttagttcttaaagcgtcatgataatcatggcacatggcacatgtcaatgctacttgagcacttcatatctcgcattatgtctgttttgagttaccaattgtggtcatatctttggattgctcgttcgactatgatagcgcttatgaaacagagctgtaatgaaattattttacatctcatcctctgttgtgaggcacacatgcagtcaataaagttattaacaaaagaggattaaaaaaacagggtgagacacctaaatcaataaaaaaatgatttaaatggtacttcgaaacaaggttgcagttagttgctccggttatatatatatagtgtagaaaatcggtgtgccgttggcatgtttgctagtcaacctatataaatttatcataaaaaaatagtaaatgataaaattgatgtgctcactaatttgtcgtcactacaaagtggaaagccaaactaaatatgaaaggtttgccgtggaaataagtgcaagctgaggtaaatgagttggagaggcgaaaggtgatgttgctggcctcatgcaaggctagcgagaaagagttgaatcttcgatgaatcaaatccttgagctacagcacagcctctacagcacccacctcttcttgaaagacacccggtccagtttgattcgagagcagaatttaagagacaaaagttggaggaaaagaagatcattaggaaggaaagaagaagggaagaaaggatggcattgaaagaagataaatctgatagggaaaggtcatcaactaagaaaaaaaaggagagaggggcagtctgagagtgaaaggaacatgccatcagagaatacaagaaatgggaggtgaagtctcagatatcttctgagaagaagaagtcatatgagagctccaaggctgaggatcataagggaaagggttatgagaagtccaacacggagaagaaggggaaaggcaaggagaacaagagttctgagaaggggaaggggaagacaattgacggtagaaagaaatgacgaggaaggttagaagaaattgtttcagccactaggacaactaaatgccaagtatgaaatgcgactaggagagtaattaaggaacgatccctccagataaaagaaaacttgttgagtttttaagtcctatttctctgcaagtactttttttcatgaaataaagaccatgcacttatgcttcttatgcatttctctcagatccatcatccttattagtatgtgcctgatttctacttggatacatgttaaggggaaattgggtttatgttcggagaacatgttttactatggtctttttcatcccaggccataatgctgaccaaatgaaaaccaaaactagaagatgtctagatccatgtatataactggagcaactatctgcaaccttgttttgaagtaccatttaaatcatttttttcattgatttaggtgtctcactctgttttttaatcccttttgactgtgtgcgcgcttcataacagaggatggagatgtaaaataatttcattacagctctatttcatgagcgctaccgctggtgatcacaagtaaaccaagatatgaacacaattggtagctcaaggcagacctgatgcgagatattaagtactcaagtaacattggcatgtgccatgcgacatgattagctaacaagaactaacataatttagaccttctctagaacacaaatttgactggttttcatacaaactagttctaattccgtgaaaaaaatgccctatttctcccttcacaaataaggcatttgatacacaagacccagacggtgagctctttgatagctaaatagcaatttgacaatatactttaccttcgtttaaaactctttttttgttaagtataatattgtactccctccgtttcaggttataagacgttttgactttggtcaaagtcaaactactctaagcttgactaattttgtagaaaaaagtagtaatatttttaacccaaggctagtagtattataaaaaattattaaattatagatttaatgaaactatgttggtgttgtaaatattactacctttttctatagagttagttcaacttagagtagtttgactttgaccaaagtcaaaatatcttataacctaaaacaaagagagtagataactattttgaatcaaagtaaacaaagtgaatccaattttatggataacatgttactacctattttgataggtcacacacgtaccgagtctgagtcagcgtccgagcggctttggctaggagtccggatcagaattcgaatccgaatccgaaatagaatgagcgccccgcactataaatatatcaaccggcgatcgtataaggaatttggcatcgttgaatagcctcatcaccgtcgcagaccacccatcgcctgatctgcgcctgctgctacccatctgcttgctagccggggccgatcgatcgagaggcccaatcagtgatcagcttgcgagcatggcgacggacatggaggtggacgagatgcgccggtgccggcgatcgtcgggaggaagaggtgcgcggcggaggaccggaggatggagtcggatttgcggcaggaggcggagctccgtgcgaaggcgctcaaggacaacacgtggggggagatggtggcctgcgacgacccctggctgaaggagatcttgcggaggaggtgcgtgaacgcaatgcggacgagggccctccacgcccagatcaccaggctcatcgacgacatggatcgccgccatcgcaagttcttcctcacggggaacgaacaggtgctctggccgccctcccatgtgtactagtatcatggatgcatctcttctgtgcaattgttcatggttgaatcctttgttcctctgttccagattatccaataattctatgtgtaatcaagtaggtaattattattacggtgtagtagcaaacttttcaaggttttttttggccttagaatcataatagaatttactcagatgaagctgttggtgttgagatcggcaactgctaatacggccgaatcatcattctagcaagtcaagagagatttagaggcatggatgaacattactaatagtgctatcacataagtggtttaaagagaaattcagagtagtacatcactacatctcactataaaaaccaaccgtagcaatagctacttacacctgacctaaatgagagctcctagcgcgggattaagtgacgcacgcgggattaacgctagcacgtcatggaaaaaaaaaggggctgctagcacgcacgcacggcagccgctttcctttttctctctgatctcctattttggtgctttttggattttttttaaatctctttcttttttttctccacacgcgcgcataattttttttcaatattttacaaattcaatctttcacctttaatatcagtcgagagttttaaatttgagttgaatgtttattaaatttaagttgaatgttttaaattttgagatggaagttttcaaatttaagtcgaaggtgaaagtttttaaatttgagttaaaagttttcaaatcttgacttgattttttaaatttgagttaaaagttttcgaatccgagttgaaagttttcaagtctgaatagaaagttttcaagttcgagttgaaagtttcaaatcagagttgaaagttttcaagtctgaattgaaagttttcaaatccgagttgaaagtttttaaatctttaattgaaagttttcaaatctgagttgaaaaattcaaaaaatcttaagttgaaagttttaatcttgactcctatacatgtgcggtagtcaaaggcgaaaaaagaaaaaaaaacgtgacaacgccatatagtccatgggaaaaaaaagaaaaaaaggaataaaaaaacgtcacaacgccaataaaaaaaaagaaaaaagaaacatcgcgtctacacgggcctccgtttggcggcgtcgtaggcgcgtatgcgctagatagcttttccggacatgaatacctacctgaagctcaatcctctcactctttttttttcttttttgcttattcatctaaatactaacaagttgaataaactagatatcatgaccatccaaatgtgaaatgatattacaattaggcaaaaatcaacgacctcttccattcttcaatcaagaaaaaagaactgaatttcattctgccacaaaaatattgcattactgaactacaggcccaatactgaatgttggtgatatgggcctgggggtatcatgtttagagtgccccccaaggccacgtggccctcccccgaggggagtgaggccagaggtggggcggcggccactccttcccaaagactagtcagaggaggctgccccccaaggccacgtggccctcccacgaggggagtgaggcccgaggtggggcggcggctactccttcccaaagactagttagaggaagctgccccccaatgccacgtggctctcccccgaggggagtcaggcccgaggtggggtggcggccactcctacatagactagtcgaaggaggctgccccccaatgccacgcggccctcccccgaggggagtaggcccgaggtggggtggcggccactccctcccagagattggacggaggaggctgccccccaatgccacgtggccctcccccgagggggatcgggcctgaggtagggtggcggccactccctggccgagactagagggagaaggctgccccaggcgccacgtggccctccctcgaggggagatcgggcccgaggtcgggcggcgaccgccccctcccgtgactaggggtcggactcccccgaccccctctctaggtcaccacgtacggtgggttaggtgtccgcctccaggtgcccacctaccagcattaacggcgacccgagcggtcgcgccacgccgcatttaatgcggtgtgcagtgcactcaaccggtctgtgaccggtcgaatgactgatgggacccaggatgtcatgcgcaccatcgcttgtgtcaggcgacgtgcagcccgacatatcccatcaaataatgatggtgagaggttctcatcctcttatcccagccggagtcggtcctcccattttggtcaaagcaaggctcccgtttcccggtgtaataggagcccagaagtcttcacccattaaatggtgactgacaggggcaccccccgtgtcaggcggcaagatttgataggccccatcatcaagacgacgtgcgcatggcttcccaagccaagagacaagacatgcatttaatgcaaagattataatacttctccaccggagctaggttaggttgttgggcccatgtggtaaccccttgaggtataaaaagaggtccaggcctagtggtgggggggggggacttccgagcgaactggcgcttgagtctcgcaaccccaggcacttgtgttctacacttgaccataatcccaaacacaggagttggcccgaacctgtataaaccccttttgtctcatcgtctttgggggattgaaccccctcaagatcacacagcttcgctcaccgaatccttgaatctcacccgctgcccccagccgaactcacaaaggggggcctcacagttccctggtggaggagttcattctccgacatctggcgcgccaggtagggtgtgtgttcgtgatttttgaggttctttcgagcgccggcgcgacgagcgtcacaccgccgatgcgggggaaggcgcagcctcctcgggagagccgcgccaccctaggcagggggctaggcctcccacttcctcaccggaaaaggctagcggccaggcctttgtggcgagtcttcggaatgtccgatggcccctaaagttccgacccagcctcaccgagaagtacgacggcggcgtcaacccctccgagtccctccagatctgcacgacgatcatagaggcggcggggggtgatgaccagatcatggggagcttcttccccatgaccctcaggggccaagcgcggggttggctcatgaacctgctgcctgcctcggtctactcttgggaggactcttgcagttgagctccgggtgccgtcgaagcccgggaccccctgtgctggttcttccgtagcggctagctttggtcccgccggctggctatggtgcccggcccggctcaactaatcgtcctttcaaccttcaagtattttcaatttttcaattcatcagcttaatacagcttgaagtcttatatttcttttcccccattcttttctcatggccctgtgacgctcgtgtattgcgcattcgtttgcttcctcggtggtaagagcccaacctctttctcatctacatgaacgtttcctcgccaagtgtgggggctaagttttctagccctattccagccttaagttgagctccgggtgccgtcgaagccagggaccccctgtgctggctcttccgtagcggctagctttggccccgccggctggctatggcgctcggcccggctcaactgcagacagggatcgctggctctagagtttttcggctctcacactcgtgcaaaagtagtcgtccgtgtagaagggagagatattggaaggaggccaccgaaaggaaagagcaaacagaatgtgtagcgtggggacacaggctcgtgggaacttgacctcgtttgctaagtgatcacaggcttcccaagatggttcggaacccatggtggggggctctcttcgagctaaaggtttgaaaggtcgtgacatgcaagcaaggtttgtgtttgcttcattcatacaagcaattctttgctataagtctggggctacgattcctagctctatcctagccctgcgtcgagctttgggcgccgtcgacgcctgggcccccctgtgctggctcttctgtagcggctggctttggccctgacggctcgctacagcgcccaacttggcttgatcatgggtgaagattgttggctatggaaaatttagtcctcgcactcgcgcgaagataatcgtttgcatagaattattattgcttatatttatctgtcgcccatctcttcctcgtagtcccgcggtacccatgtgtcgcgcgctggcttgcctcccttgataacaaaaagtttgtattcgcttcatctattcaaatgattctttgctaaaagtgtgggggctacgattcctagctctattctagccctgcgtcgagctttggtcgccgtcgacgcccggggccccctgtgctggctcttccgtagcagctagctttggccccaccggctggctacggcgcccagcctggcttgatcacgggtaaagattgctggctatgggaagttcagtcctcacactcatgcgaaaataatcgtttgaatagataaagtagaacaccaacagaggttaacaaaaggcaggggcaagcgaggtacgcggcgtaaggtcacgggcccgagagaatctaaaaccgtttgctgagtatatacatgaaataagttcacgacctaaggtacgtgctaaactcccgagcccacagcgcttcggaaaccgggaggaaagtgagaagttaaggcaacgtatgaacgtgactaaactcccaccgcccaactcccagaatgataggatagaagatcgggcccacatgtcaactgactagaagattggcgtcaaccctgaccacctgggaaagggtttggtcagggctaacgccgggggctactgtcggtgatatgggcccggggtatcatgtttagagtgccccccactagtctttgggaaggagtggccgccgccccaccttcggcctcactcccctcgggggagggccacgtggccttgaggggcagcctcctccgactagtctttgggaaggagtggccgccgcccacctcgggcctcactcccctcgggggagggccacgtggccttgggggcaaccttctccgactagtctttgggaaggagtgggcgcctccccaccttgggcctcactccc

SEQ ID NO: 30296 - DNA, 15737 bp, Oryza sativa
catggcttcccaagccaaaagtcaaagacatgcatttaatgcaaagattataatacttctccaccggagctaggttaggttgttgggcccatgtggtaacccctgagggtataaaaggaggtccaggcctagtggtggggggggacttccgagcgaactggcgcttgagtctcgcaaccccaggcacttgtgttctacacttgaccataatcccaaacacaggagtaggcccgaacctgtataaaccccttttgtctcatcgtctttggggattgaaccccctcaagatcacacagcttcgctcaccgaatccttgaatctcacccgctgccctcggccgaactcacaaaggggggcctcacggttccctggtggaggagttcattctccgacactgaaattcttatcgtcatcatgcgacggcccattactggcgagtaaataaaccagatatcatgaccatccaaatgtgaaatgatattacaattaggcgaaaatcaacgacctcttccattcttcaatcaagaaaaaagaactgaatcttattctgccacaaaaatattgcattactgaactacaggcccaatactgaaattcttatcgccgtcatgcgacggcacattactggcgagtaaatacgacggagagatctcccttttttatttctttctccggtcagtctcacgaataaataacaacaacgttgcgcttggacacacgagccagccatcatcgatccaaacctgataaagaacttgatcttgccgtcttggccatcttgctgtccctgtaaaatttgtcaattatgtgtgtgatgaagtgtgaacagcgcgttacattcgactgatcctgaaaataatcccccaaattaatatctgagctagtagctagctgcaatcgatcctgcaagctacaccagcggccaaaaaacgagccggattaaagccggtgcaattgcattgatgctcccaacgcccaatctgatcgacaatttgcactgcacgatcggctcaaatcagctcgtcagtcacactcgatgcgtaacagtgacagtgacatgtcactcctgtgtctgtgactctgtgtggctctctgtaaaaacgggatcgagagcgcgcgtgcgagcatgtgctcgtcgacggcggcggcgtcgcgaacgagtggatagggcggtgcgccgacgatctgatcgatccgcggctccgaccgcgacggacgtcgatttgggaggaaatgggttaatggaatggatgcacttgcagttacagttaagttaaccagagctttgctttatttgctctgctctgttttgtctgttcggtcactccgctggtccactaaatatcaccctttatcctgatcgattagttggatgggcacgaggaataactggtatgcttaaaaggtaccggtatttttttattgaccggtaaacagaatcaactctgtactcttcccatcaaaataaaggaattaacttcttactataaatttaaacatagaaagaaaatactagcaccgttataaaaaaagctatctactactccctccgccctaaaatataagtgtttttaattagatgagacacattctactatgtggatagattatcatacaaaacataaggcagcaagatcatttgaaccaagggactagggtagtacatagagaggaacggatcatgaagttaaccaagccataacaactttgtcacacataaatcgacgtatacattcaagacttcgggttggccatagcttcgttgaaacaaaagtagaaataacctaagtgagcaatagtttaactgattaggtttcttgtgatagaatttccctctgaatttctaaatgtttaaatttatagctgattattttttttattgctaggcaatgtaattgttgacaatgagatgtccgtgttgatttcatcaatattaagatataccaatccaatcttttaatatggtgtgcatatgtgtatttatagaagtgagtatatgaacgtttacgtttgtactgtgttctaaaaaatcgaaataaattttactacagtattaaaaaaaacttgtggttgtacgcacatatagcctagtcataccagccggcagtggctcgtcggcaaaaactccatcaaattttaatattgatgtgtaaattgatggtgaaatttatagagtaaatactatgaatccagttactctgcagtaatgttgagcaacattggtgatgtgaggagaacagtgaacgaatgcattgagcatcagcgctctactgtagctacagtatagtagatgttgctttacagcagaatttactgtagcagatcatccgaaccatcaatcacacaaccaacgatacacagtatccctaatgccatatattgtacctctctgccgtattacatttacatgctactcctataatatattaatatattatagtaacataatatcggatgagacatttcatattataatgtagacaccctcttatctagtatattcgttgtactatgaaatatctcatccgatactagtttattatattatgggagagagagagagtactgtaatagaggatcccaatccaaatacgaagttatattgaaatctattcgggttaaaagaaaatcttaagcgacgggcgccttcgtgactcctcattgcatccaattttccccctgacccaaccgtgtgcccgcgccgccgaatacaatagaaacacacgcaaattaaaacacacctccaaaaccacgcgacgcgacgcgacccccggttcccctcaaaccaaacggttcgccgcaattcccacccccccccccccccttccccaaaacactgccgcaccacgcctcgttcccgcggactccgacctctcccgaatccctttctctcctttgcccgcctatttaaacctctccctctattcccaaaccccaacatctccacttgactaatccacagttccactctctgattctcaattttcaatttcttaatagagaagaagcgatcggattaagcgatgagtgatgacgagctgattccggggctaccggaggaagtggcccgggaatgcctgctgcgcgtgggattcgaccagctgccgtcggcgaggagcacgtcgcggcggtggaaggcggaggtcgagtcgccgttctaccaccgcctccgcagggcccgcggcatggcgcgcccgctcctcgccctcgcccaggccgagccgccgctcgccgccgccggcccggctaacaagtacgccggcctgtccacctcctaccgcctcgtcctccacgaccccgtcgccggcggctgggccgcgctgccgccgctccccggcgccggtgggctgccgctcttctgccagctcgccgcggtggcggcgtgcggcggggagaggaggcggctggtggtggtcggcgggtgggatcccgagacgtgggcgccgacggacgcggtgcacgtgtacgacttcctgtccgggtcgtggcggcgcggcgcggcgatgcctggaccgaggcggtcgttcttcgcgtgcgccgcggtggggaggtgggtgttcgtcgccggcgggcacgacgaggagaagaacgcgctgcggtcggcggtcgcgtacgacgccgaggccgacgcgtgggtgccgctcccggacatggcggcggagcgggacgaggccaggggcgtctgcgtcggcggcaggttcgtcgccgtcggcgggtacccgacggaggcgcagggccggttcgccggctccgccgaggcgttcgacccggccgcgtgggcgtggggccccgtgcaggagcgtgtcctcgacgaggggacgtgcccgaggacgtgctgcgccgcgccggcgcccgcggcgggcgcgacgatgtacatgctccgcgacggccacctcgcggcgcgcgacgccacgaacaacggcggcgccgcgtggcgggcggtggcgagcctgcccgaggacggccgcgcggtgacggccctcgccgccatcggggacggccgcgtggtcgccatcggcgcggggagccacggcggcgagcaggcggtgtacctgctcaccaccggggagggcggcgacaagaacggcgcggcgcagtcgtgggcgcgcgccgcggcgccgccggagttcgcggggtacgtgcaggccgcgtgctgcgtcgaagtataacgatacgtgcaagtaatgtacgtacagaaacgtacactgtacgtacgtacatatgcgcgcgcgcgcgcgcgattgtgtatacgtttttgtgcgcaatttttatagtgtatatgtttgtgttgtacacttaaagctcagcgtttcgtatatacgatgatccgagatggagatgatcagttttgcataagctctgttttgtttgtttacttcacataagcagataagctcattggagtcttccgtgcatccacaaattgaacgctatttttttcttttcaaatatgcaaacagcatcaagcgtgtgtacactgcacggaagaagcttcttttgatataggacgctgacatgtaggcccgtgatatgtaggctaatgaactgtgggactatcaggcattcaaaatcagagagcaggagagtaagggggttagaacatgtttaaagagacaaaagattataataaattcatattcttgctgaaatccttttaaagtgttgtatatatatacttcctctgctctataaaaaaactatttttaacggtgaatctgaacatgtgcatatacatgtttgggttataacacgttctgtagaaaaatcccgcatattactgctaaacttattttttgataaaaaatatggcgccataaatatagctacacccaaagaaaaataccaccacccctaccatatgtcactgattaaatttacaaatcccaaaaatagaataatgatgtcagtaatatccgagacaattgacagagccagctttcggatgatattttggcaatcatctgtgacatttccctcttgaagacacggacaggacaaaccaaaaaaaaccatgagccaaatggattcaaagtggaccctgtagacacatcacacatatccctgcagcggcaagtgacgatgtgtaaaccagaagacgacgaacggcgacgatctgatccgaaaacccgccgccggtaaatggcgcgcgagagcaaccgcccgccgcaggataccttttttttggggcgcccaacggataaccgttgccggcacgaggtcccacggaaggcgaccatgtcgtgtgccgtttgacggcgacgtcctccaatccaacccgggcagctgctgaatccgccagctgaaactggcaagctgatgaggatgtttttcagtcagcgccatcggttactcctcaactcagtagcccccagctcaaatttaaaattgagtaaatttcatcatggactacattttttttaccagtgtttcatattgggctagggctaagtcaagattttcactttacaccatgtttctttgccaattgccaagagttgcactttggggcagggtatgttcacaacttgggcatgtgtgactgacctcgccgtagatattatgattggattgtgatgacactcaattcaaacaacttcttgatgcgcggtgtggcacggttcaggtagagatggctaaacccactcatgacatgacgaaagaacgagatgtgtgctatcgtttcatgcgtgcagaacttccttcgcatatctaggtgttgtcacattgcaataatctctattacaagcttgccgacgtccacaatccaatcatctccatcacaagcttgccggcgtcctctcttatctcctgatctactgacatgtgagagcatccagtccaaagtgaaagcttttggtaaaagaaactggcccaaagtgaaaactttgtctttaggattgtccatgttgaaacttaggtaaaaatacctagaccaatgtgcaatttactctttaaaatttaaaagttattttaaaaattgatcttgattttttttatcatactttatttcagaatttatattaaaagttaattttatagttgattttgattttttttaatcgtaccattgaattttaagtcgtccaaaatacatataaaaaagtttttcatatgaacaaccttctctatctcatattataaaaaagtcaaacgacttataatacgaaacaaagggaatattttttaaccgctaacaaaagctacagcttgtaatagctgtaggcgaaacgacggtttctagtgaatggatactgccacagtggatgggaagaaagggctgcaggtttcgattccaacgagaggcaaaaatgcctttttggaacgccgacaaaaaagcgaagaaatttctttaaggactcctcttgaaaaagagggaggtgaatcaaactaaaaactttaagaattgagataccttggctgcgtactctttgttcatgagcttcagagtcaccgtgctgccaattcttaaagctgacttaagaaagagccaactctgtcaacgccagaaagttcaccagcttgtatctgaagcaaagatcatttctggctgcttcgtgatgaagtgcccaaatctttctttcctctgctttgcacctggttattgactgcatacggcaaagcataatttaaggtcaattcttggtgcaaatccaactccaggcacttctacttcataataactgcggagaacaaagccacaaaaaatgtccggcacatgcagaatactaactattttttttttgcgaggaatctgacctaaaaattggcagcatgttctgactataggctaagacagaaaatggatgttcccaagccaatatccacctgataagctggaccattggtaaagttgacatcaacaaatatatccagaagtcaagccgttggcaccgatgaaacctgagtttactgagtacgatttctgcatgctgatgacacaattgccattcactaaatctccaatgttgatcacataagggcagcatatcttaccagatatggtggatatattcatgagaagtgcgttcagcaatctaaaccaaacagaccaagtagaacaaatgagcccggtgctcattctgaactctgaacttggtgatggaagcagtctatctatcgacaggctgttggttttctctttcttctttgcaccagcaagctttgcactcctagcagcatcctccattttgcagcatgctttgcagccccatccacctctgccggacttctttttggctgaagctatcttcttcatcttctccttcatatacacagctgtgatttcctcttcagatttgtatccgccacctctccatggtccttgctggaatccatttcattgggctgctctttagaatccttgattgatttgtcttctttgatttcttcttccttgaagtcttgctctctgaaggtacaggagcaccattcttatcaccaccattctgcttatctggctttctttcagctgtaaatttgggaaaaatcaaaatacttgcttgtttattaaaatatatcatatgatcaataaacaatagttaatgaatactccctccgtccctaatataagggattttgatattttgtttccactgtttgaccactcattttattcaaaaaatttatgcaaatataaaaaacgaaaagttgtgcttaaaatactttggataatgaagtaagtcacaaataaaataaataataattcttttttttaaataagacgtatggtcaaacagtgcaagtaaaatgttaaaatcccttatattagaggacggagggagtatgaaatagtgaagatgttcttaatttggtacaagtcacaccatgagtaagttctatacatttactaattgcatcaagctgggtaccatgtccagaaatccccagctcagccagcacagtatctagttctgcaagctctttcttcttccattccttcttcgaaagctgcctttctgtctctttagattgtgcaggtattagaccagaattcttaacctcaagctcagatggtacatcacctataccaacatcaaggtcatcatcttcactccccgattcctagagagcaaacgtacaagtaattaattaaaccagagtgagttggaggaaaaataattaggacacatacatcttaagggtggacagctggacacatgagccacataccaatttacatacctaagataaagagcagaatttattttatgcctaattagtctctgaatcagagaaaatcttgttcatgctgtccctcatagaatcgtgcaggagaaataaattagaagaatataaagcttaaataaacatttccccctttctgttctgtttagttaacactttcatatacacaagaaaaacatgtatcgttcatctttgctttcagcagtgttcgctaggggattcccacaagcacaaatttatgtttataatgagttcaaaattttctttattgcgaaatgatctatcagactatctggtatggtgtggtatcgcagaatgttgtgagcatagatactggcatagtctttagagaatactttagcaaatattggtactaaaatatatttaaaagttctgataaaattgaatataataaaaatatgcttgagataaatttgcacgcttgatatttatgcgttcaatccaaatatttaacaatgttgacatttttaaaagtaatttttgattaaatctctaacatgatataattaaaaatatatatgtagagtttctaagtagaggaatgaattttcttttttttctcttttttttggtaacacacgaacattatggtacttcaataaaacaagagaatctcccctcaaagaaaaaaaagaaaagaaaagaatctaccacttaataggatggggaaaaaccaaagcattgccatagatgggaaggtccagaaatggtagcgcactgtactaccgcatgcattgtcccaacatcaacatcattcatgatacgaaaaaggtgagaccacaaattcttctggcaagtcaatagtcgctttgcaatttccactagtgcaccgaatgccacctgacaatttgacaatttaaaccaagcagattctgctttgcattacattattatcgtttaatcaattattcgaagtgtctacgaacagattggttcgaagagaggagctattgttcgaaacgaagatttaaaatttcttttcctacgattatgaatacaacccacaactatctctagtttatccagattacatcccctgtacgggtgtacacgactgactcatgcttacattgaatcgctgaactaaaagagagaaagagagaagccaccctacaacggacgctcgcaggttgtaaaaccagcataaatttcaaggttttacaggttctatctcggtctccatgccattccacccacactcccagaaccatagctttgcgcgctgttattactgttgggtatcacaccatactgcgactgctgcaccatgctcgccggcgcagcggcggcggcggcgccgccctgcgccggccaccaagcattggtctgctgccaggcttgcgctggctgaagctgctgctgcatcagaggaagttgctgcaatggttgctgggttcggaggtaagcctgggggatagagttgctgggtatctgaggttgcaatgcattttggtggtggtaaagctgctgctgctgctgctgctgatgctggtagggatgatgcaattgctgaagcgagggcggtggtggtggtggaggcagcggttgctgtggtgtgggtggaactgggagctgccttgttggctgttgttgggtgacaagctggttggggttccattctggtatatcatcgtcgtcatcatcatcccaaggacgagcctgaacagatgatcttttaccatacttctgaaccagttccctcatttgctctaccgggcgagcagaggtaaggggtacatgctgccggcccttgtaggcctgggtggttgttacattagcagcaggattggacgagttaacaaaattaaattcaggaagatcgtcttcatccctagcaacaccagggccaaagcccggagggacatcatcagttacatcttcctcgtggcggtgacgctgaactggaaaacccggcggcgcgccgtgcgagctcataggcagggagggcctagggcctggagtagaaccagtaacctgcggtttctttaaaatcgacggcctccgggaaccatcatgcctagggtgtgccggcatcctgggaacgttgggcctccgccagacgatgaccccgatgatggaggatgctgacacagcaagactctccaaatgctcctttggcaggtgccgagagagaatctccacagttttcccttgagaagggcacaggtacagctctattccatctgcaggttcagctaaccctactctttcatctgaaatatacgagtcaattgtctgcagaagaatagacaaatttaatgatcaaatccacaaacattcattaagctagctcctgaaggaaggtctttctctgaaagaaaaagggctacgatagaaaaacctgcaagagatgttggcgaccactctcatgagaaccttccttccaacacaactcagttacctatgaacaaagttggacatattcaattactatcctatcaacaccagcatgaaccataatctgtgatgacaaaagcgcactaactatagtttgaggcatttagttaaataaaggatagatcgagtaacaactcccaaacagagtgatacttctagatgctaagcatacaatcataagaagcatttcaaaagttaagacttaaaatacatgcaagagatcatgtcaagagttgttttttttgtctgtaacaattgttttcttttctggctgacacatgctccaattcatagctttttgttttcttggcaaatttagcatataagtaccaacatttttcaaacatcctgacccagacctcagacatttaaacatattagttagttttcaacaggaaaaatgcaagattaccattatagcacggctcctagatttgggaagctgttcaacaaactcttgaaaggcactaagtttgactctccccttgatttcaacaaagctccgccattcttttactggtggcttttcaccactgcaaagtgaaattttaatacatgtcatcacaaatacaaaaataaaatacagaataaacacatatcaacactatctttcaggtagagtggatcatgtgtacttggacagtagcagggcattctgggccacaacaatgaagaaccagttgtaaattgttatcaacattaattaaatcagcaaactttgcaaaagggatgatttagatcagtattaactaacaagacataaatcgaacaaatacacaagtatacaagttcccatcagaaagaggtgaagtagccaagctggaccctcaatgacatacacctacttaatgcactctctgcggaatcaagagaagtacactgaagcatgtcacatttggcagtgcttgctaattataaattattactcttagcagttctcacatgaagatatatttatatacttgcatgccatgagctatcagtttttacttattacttaatttgatgctagatgtctagcttctaaacctaaagtaatttaggtagagcaagaccttgagcctcttgagaaaccaatagaaacaaggaatcaaacaacagcagctagcttcaccagatgaggaagaaagacttccataactcacttgcctgaggcgcgaaagaactgagatcttcaacgaaagccccccaatttcattgacccttacttaatgaccagtgatggcgatttatgcttttattgcctcccaaacttatcattcttactcaagcttaagaccaggacagaatagttggagtataaataaataaagttatcatacgagtcttggacatatgcaagttgtgtgtgtgttttgccaaggagtgcatatgccatatagttcaacaagtatctttctgaaggaacagacaatcaatttccaaaatacgaccaagcgaatacaatgtagaagatgaaattgcagaatacagttcagtaaaagctttgtgcaaaagaagatgtacgtgttctgtaaagcactaatctgcttttaataaattaaaactaagacaaaggcatcgaagagaatgtgtcaaatcatcatggtatgctaacagaaacgattgtatattggtaattcaaaggaaaaggctgcagatgaaacaaaccttttgaagatggcaacgacatttgtgagcgaagacatggtaagttgaattgcaccctcccatatactttcacgtatcataggaagagtagttgccatattatgcacagtagagtcacgattcagcacattttcagtagttgtttgtttgacttcaacactatctggggaggattttatcagctttccttcacgctgctcaacagggcccaaatttgaacccacctcatctttgggtgactctaacttggactcaaatttatcctgcgaagatggcaggtcagcttctagatacaatcttctctgctgcaaaagactttaccttcttcccaagaaagttccgcagattctacagtagtgtcagcttcgtctcgatcatctgaatcttcttctggcgtcccagctaaaaattttcaaaaggtggttcagaatctaaaccttgcatgaattcatctagtaaagggatcggtgaaaggttttcagtgtctttcaagtcatccaccataagttcttgcataaggtcacttttctcattatcaacatattctaaatcatcttgtggatcgttcttgcctgccccattatcttcatcttgtgaagtcccatcaggtgccttgtcattgtcttgtatgcctgttttatcatctgtactttctttatcgtctgatttggtctgatctacaggggcttttgatggaacttgagtaaaagattacctccaagctcaacctccactgaagataccatctgtttcttctacttcaacttaaaattctcctttgtgtgttttccaaaccaaacgtctaacatcaacctcggtactaggaagaacaaccatttgtgctagttcttcagctttagctaaccgccactccgatagctccttggaagcaagttcctccgcagtcattgaacagaggcgatcaggtgtaatatctccagacaataccctctctcttaactcaggattacttttatcttttagattaaatagaagagatctacctttctccttatacttcttattaactccaccaaatagtttgaacagctcctcttcaaccctaactgctaaatcatctgccttctgaataatgctatccttatctatcgcttcctcatcattggcagacttcattcttttggactcagattctgagagagtgtctgcaacaacagggtcaatgtcagaagccctggacctttttaaattaggttgtgtggcaggttcaggaaccccagcatcaaagtcagaaacccaacaaagtccatgaccttgcaagagttcatcagcaacaactgtatattgtcccaacatttcatcttgtaaagaagcattctctggttgttgctggatgtccgcgtttaatggtgtggctatgttcgaaactaaatcactgtttaacttctcatcttcagcacgcctctcagcaccaacacttgtcaatacttccgacttggctgcactcatgccttgggatgtggtggccacttgatctgcatctacatccatctctttcttttggtctgcagacccatcaggctgcacatcagaagattgattcttactctgatcagaatctgttctcagagcagcagaaagtgactccctgaactttgatctcacagattccaattgctgagtttgaacctttgatggtgtctccttctgtgcagaacgtttgttcgatgactgtgactgtgtagatttcagtatttgaacctttggagaagcaattgtcggttgcagtttcttgccagcaggagagtgttgtgatccaaccattgttggcaaagatgttcgaatacttagcacttgctggggtggcctcaatgatactctgcttagagaatgtgcccctgaagaacgcggagtctctggcctagaagcaccaatttggaccgattgttgactcataggaacaataaaatacgaactaattggaacagaagctcccatagaaaacattggctgtgcaccccagtcagcaggcaaagatggataaaacatagacggatactcagcctgattaggttgaatatttgaagaaggcaatggttgagaacccatgttagttgacatgggtgtctgcccttgatttgacaactccattatgcaactatttcaaaaactcccaagatccttgacgagaaatagttgtgttgcttagaacagttaatacatatatctgaaatagatatgaagcaatggaggtcttagaaccgtaaacgggaaaggagtaaatacaaactgtggaggacatcaaaatagatgctccctgggccagtatacatagatttaagaattaaaaaaaatattgaattagaatttcgtaaaaaagcaatccctatgtaaaaatgatacatcccacatgagtatgaatattattatggtggaaaattgaatttattagaaaagtacgcacacagattccattcatgataagtattctgaagaggtgtccgcattaatcagttctagattaacacaacaatagtctaacagtaaaaagaaaaacaatccagaatacaatcgtgatacaacaaaatgccaacatggctgttcatacgcatacagtaaaacataatcctccacagcgcattgacctagagtgaagaaatgaattaacgtttgattagcaattgctaggaaatgcaccaggcggtgatagcagtgaaaataggaggcatgtgaatgaagtaacactaacagatctcaatacagcttaacaaagcaaaccctagagctataacattcgtctacatcgaaccaatatcaaggaacacccaaccatcatcatcaaatctaaaagggcacaacgcccagagaagggacgataacctcgctccgtagacgaatcccccccggcagcgcagacccaacccaaccaaaccctaaacgtctccctccacgtatccgacgatcccaatcactcaaacccaacgaacaaatccctcgctcacaccgagccgcggcaatcacgaagcaaacacgccgacaaaaaaaaaaaagaactacacgcatcgatcgcacgaatcatctggagctcagaagcgcccggcggaagagggatccacttttacctaggcgccgggcggcgacggcgacggcggcgagagggaagggggggggggggttgggagatttgcggggaaggtgggggattcgatttgggggtttagggttagctatgggcaggggcagaggtcacggattgtgcgcttcgggtttccatttggttcgtctcgtctcgtccccgcgcgaggtggtgaggtgaacggctgctgcgtggtggatggatggatgaggtgggtgatgactgggtgagtggggtgaggccgccaccaacgtcgcaagtcgcgactcatctcccgtcatccgtctccttcctacccacgtcgcgtgcggtgcgggtgcgggtgtttctcgtgttgggccgtgtctacattggggccttttgtgggaacaagtctattgttgactcc

SEQ ID NO: 30297 - DNA, 30128 bp, Oryza sativa
  unsure (1)..(30128): unsure at all n locations
tttatggtttttcgcgtcgcggtccggcttgccgcatttaaatatacaagtggatcgatctataaaccaatttataagtcaaattcatagttaacccgctagtcaaaccggcgggttacgcactatttttgcctataagtggtttcgcgggtaaacccacttacacccctagaatagatgcttttagaaagaagcaaatcttcatattgtagggggaaaaaatggcaccatccaaaccagcgcttagtctaatcactgcttcctctctaacgcatgatatttacaagatctagacactccttggaagaaacaaattttatagtattttcaagggtgttgaattgattcacatgaaaaatcctgtaaaatttatatgttccagcccccataaaatcatcttaggattttcggagcccacggatcatccaaaaatccgcccatacaatggatctccttttctatgttggacatgcaatcctaacaaattattttctctctccatgtgctcataaaaatatatatcttgtgtttgttctgttgttagattttaggaatcatactgttgaaacatctctgtattatagttccaagagtaattttacggtccttaaggaggtaccatgaagtaccgttttttctattgtaaatttggtacctcatggtacctaggtactgcgaggtatcatgaggtaccaaaatttaagtgtaaattttgatacctcatgatacctcctcaaggacagtagaattgctctagttccaaattgtgtcctgcaaactatttccaggcatcatcactgtgtagaaggataagaatacactggcccaatgtagtagctgttcctggtaaggcctcctctccaccaatcaactccagaatccatccaaacttactacatactgttaagtagctcaattgtctctccaaatcaatcagcttggatgatgagcttcaaaaggacaggacagggacacttggaattctgttccctgatcacctgataccctgatatccaaagatgctaatctatacattaggtttccaaccatggctgtgctgtttaactctgtttatgctttcctgatcaaaagcttgacagtagaattcatgtttgtaacttgtaaaaaataactggtgtttacaaaaccactaactctctaaaaaaaagaaatttatatttagaattatctgcttaaatcatgtagttcaggaattcggtaagacgatttcaagtatttgcaagaacagcttgatgggagttgcttaatgcttttgtatgggatgatgcaattcctatgaaaatcttgtagaaaacttccaaggaaagacttagctactattgccagttcaacgtactctgacaaaaaaaatagtaatataaagataatctgcaatcaaatattctcagttggcgaacgcctgaacgggatatgctgatgcaaaagatatatattctccgaactcagatcatcttatggaaaaaaagaactgatttgccatatgattggttgcttcaaacctctaattgtgtgacacattgccccatagtgcttgatgtgccattgagatgatgtttacatccaatatatggattattggatgctggggcataaacaatgagtcactgaaaacaacatcttctgaaaatgtcaaaataatatttacaatcggtatgtaaattcaacttcaattgagctattctatctctaactttgaatcatgcacgcctggtttaaagagattaattgaactgtggttcattttgcttggatatgataccaatgagctatcactaattcggtggcaggtcaccttaatgaatattaaccatggattgtgattgatgaattattagaagtttagaacagtctaactaatctaaaatctgcacctgaatggatcaatggaaggataagggctagccacttttatggtctgaaattgatatgttttcgcactaactgcagatatatattagcctgcatctttacattcccataaaccatatattattatattttggagtcagtatgaatgcaaaatctgtgatatgatataggagtatatatacttttttcaaaagtagtttttctacctctgcacatcttcttacacattaatcttcagaagctgaatcttaagcctgtaaaatatttgactacaattactacttttttttactgttaaatatttgatacaccaaactgaagcactacagttactatctaagggcctattcggtttggaggatttacgcgagaattttggaggaattgaactgtcctgtgaaaattctgtaaaattcctacattccgaagatggctaggttccttgtggtggaaccagtccacctgggttcaaatcctagatttgacacgggtgctcgcatttacggttaattattcttttagtaatagaccatgtacctatcaacagcgatgcgtctgtggtaactttgttaatctcaagatacgttgacttagtcttccggaggtgctcatatggatagggtgtgtgtgcgtttatagggatgagtgtgcgcacgttatgggcacctacattcatactatgtttctaaaaagaagttgatggagaaaaaaaatggtgcactgaatgcggtcgtattggctttgtattttggtgttgagtcccttccatacaagaactaatggacacttcttttgcagtttcaaaccaatgttgcattgttcaacatacactgttttagtcccatctgttgcaagaaccaatgcagatcactgctgcagcaactgaagcatccgaaggggttagccatatccatcaaaccatcagcatcactatcacagtaacagttcagagcatcttcagaggcatctcctaatcctagctatatatgctccttttctagctgaaaattggtggggaacacgatgaccacgacgcgatcgtattagtacacaaatcaaaagagaaataattaaacaatggtgcactatcagtagctgttaactgaaacagtctgctctgaattctgaagattgcaaggggttaggtagagctctaggcctctagcctagccagcctttctcttcccttctccttatataccacactagaacacaggagcaagaacaagccacaccattgctcatcacctctccatctttagtttgaagtatctcagttttgcgattctcctcgctgttcaccgcgaataatcaagcatcgattgacgacgacgatggacgaaccatcgcagggcggtgaccagaagctgtcggccatggagcatgtcaagaaacgccatgaagagaagggcttcctctatgcctggtttgtacagaaacacaacactctgcatctgcatgcatgatcatactgcaagttcttgctgcatgcagtagcttcagttcagtaccagtgctttagctctgaactctgaacttctgaatgcatctcagcatgtgaactctgtatcagactgcatctgcaacgatgtggcactgcaagaacaatcacacatgcatacatgatgattaattggttgccgttaatttgggtgtcggatttattttttttttccttttttgcagcttgttcatgctgtgctgctgcttctgctgctacgaaacctgcgagcactgcctcgagtgcttctgctgctgctgcaagaaggacaactgatagagatcaagatcgatttcctggatttgttagcgaattgttcgtcgaaataataaaaggctagcttggtgtgattcttctcggttttaatttgtgtgttaactatgcgttaaccgtggtgagctagctaatagttatgtactccatgctgtgactatgagtgagcgagtgaattgcaggtggattgtggttgtaagtttgtaagctggatttctgatttttcatgtcagttcattgttgtagtacaaattcttgtgtaaacataagtgtaggtgattcatgttgcagttatccagttatttcttctgcttgcataaactgatacacagaagttcagattagacgggaagatatgcagaactaaataactgtagagttcagtggatcatgaaggcatcttgtttgtgatgaattatttttgcctttcttttctttctccctatcttcagttttgcattgcgagaatagaaagcaaaggagaaaatgaaaaaaaatgttcaaatgttataaaaaaaattctccaattcaaatttggaaaaagctctaaaatttgaaacaaattttcagcaggttattgcaacgatttactttattgtacagataaattttaaaaatagcttaaaacaattggtataaacaaaagattatttttttgggtgaaatgtattttgagagatgtgaaacaattaatccatcataggataatcgatggatgtgtaaagaaatggacaagagcaaaaagctcttatgctaagttggggtcggggagactggggagcttctcgttgttatagcttctctcagaattagaagctcccctatacagtttagtttttggtccacattatgagaagccgtagttgtataatctagaaagtgaactagaagtcagaagttgaaaaacccatctttttcatattctcagaaactggctgccaaccagttgtttctcaaaatcttaaactccccaaacaggcctgagagtgatcccacgcctatttcttatccaacggtggttagatcattaaagatatttttttttgtcagaaaggggaaaattgaaaagtttatatgtactcaattttgtctgttatactaaaattctatctgtcacactatgagtccagctatatttttttataattttatctaattaaattaaactttttttatacatgccacactatattttttttttataattttctctaattaaattaaactatgagtacttaaaagccctgaaatctgaacccaacccaggcgcgaaatccgaggtgccccgcgaccgcgctgaccggcggcgatgccgatccggcggccggcccacgggcggatcgtggccgccgccgcccgcgttactccggcgcttggtcggcgtggctctgggtaacgatcctgtaaccctacttctcctcagagtcagatccatcccgcgcctaatcttcctgcgggtgtatgttgccatcgcgaattaccagtctatagttgctgtatgaatgtgggaggcgatcttgttgatctgtacttccatcgattgtttagtgctgggtagttggatgatcccctgcaaaatgtgcctgtttctgtacctgagctagtgcggctggaggggaattgtttggggatttctgagttgcgctgaatttggtggtgcgattgctgtttatcaccatttccacttgtgcttttgttgtggaacactttggcaattttgacaaaatcttccgaggattaccaagagtccaatgtcaattttggaggattacattgtttcgtgaaaacaacgactaatctaaatcaacaatttatttctcacagtcagttaaccatcgatattgctgcaaaaaaaaaagttgactatcgattctatggatctgttttcgacttattgttagttaacaatgccatacttttgtatagagaagtcccccctcccccggtttttaagcaactaggccatgttgtttttttgcctaagagaaactatcacatgttgaaatgtgcaatatagttgttgaacagtcatctttctttcccttggttgggccaaattgattgacagacaaaggccgctcaataaatggcacaagttattttgtgaatatgactgcaataatccctgatgcagtccatgctctgtacattcttgtaaaccagaggtttgctggatgtctgttcaaaagtttgtgtcgaagtatagttgcttttggaatgttatttttatatgacaatctggcctgtccttgctggatgtctgtttaaaactttgtctcaaagtatagtttgcttttggaatgttattttcatatgacaatcagtcttgactataaaattcgtttcttatgcaaaattgcaaacctttatcgatattctttaagcctcccaaattatccaatagttaaatatatggcacaccttagaagcttcaatagttggatatctgaatttgtctttggttgtcaatacttttgctgtcctgctgtctagaaatgtgagtcacgtctcatttaaaattcgcatcaaggttatttttaatccaaatggtaatatgttatcacaataatcgtaaattattaattatatgctgaacacacaacatcatcagcaatcttgaattattgattatatcagttcctaatgctagtgtttgtagtagatttctaaagtttctactgttttcagcattatatagcagtgccatcttttttttttcacattaatgtttcatttgctgctttttgaaggcagtgagattcaattgaacaaatacttgacaatattatggaaaaaattacatcatggaactattgcatatttttacagtttacatacatgcctcttatctgtttgataaatgccaaactgaacagatagagatgtcaattgcctacgaatgaaacaaatactgaatacattctctcctcatttacagtgctgtgtgccagtactcaacagcaaacttatccaaacttgaatcaagatgagatggtgctcttatcttctttggaaattgaagactttgatggagaaggcaaagacgaacgcgaagagagcagcaaacccaacaacggcagttgctacataacctaagtagtcatgcctaaacccaaagtatcgtctgatgtaatcttgcaccacttccccgtcctccagtgtagagtttgtgatatcaccatattgtgaggcaacaagtccgtacagtgtccatgccactgggcatgcccaggaataccacctccaccatattggtatcctctgcaaaccagccatgtatatttcagcatcaacagtatagaaaaaagacttaaaggttggtatggacaatgaatgaatatcagatacttactggtcgggggattaggaagccggcaaagatattccatatgcaatagaatgcagtagagactatggcagcaatgtcgctgtttggtgtcatggcgactgccatcatcccatagaatgtgaagtacatgaaggtgaagaacatgaagaacatgtaccagaagaatttttcaactgtccagtcaaagccaatcaggctgtagacgatcagaccatacacgacagtctggaggaagatgtgtggtatctcaataagaacctgttgaaaggataaattgttagatttttttccgtataataaaggaagcacactgcaattgttttttgtttaaatatgcagctatgaccatttacctgcgcaaatgcatatggtagagcggagtacattccagcggccttttctcggtagaacactgttcgctcaacgtctacaattggttggacagtctggccgttttgaattccaatgaaaaggactgctgcatacatggatcccaaagagttgaacagatccaatctcttgtttctgtaggcaagataagcacaggtaagtttctttctcacaacatgccaacatagatcaagttaattgggtttgttagcaaagatacttacattttcttccctaggttcaagaatatagtgccgaaaatgagggctataactgttgtgaagaagattctagttgctgtatacgacggatttctccagtatgatttgtgctgctttcacaggcaagccatgcattgtgtgaagaagggctgtgaaaattgagttgggaagtgtaggtccgttgatccaggtggaggtgtgcttaattcacttatcaatgttttattcctcctgcaatggtgcaattgaatcagtgatataacacagaaaaagcagaaaaagaacattttggggggcttttgtcatgaaacatactggtatagatcagaattcctgtatacttcagcaaagttgatgccaaggatatcttcttgggctagggtggtaacctccaacatccatgttgcaggattgtaaccatccttgattttcctcactccttgtataccctaaatttggagcagcgagcaaggttaccatgcatgtcttaagttggaaatttggtgttcacttcagtatttaagtatcgaggctcacctcaaagtaattgatgagatggcatgagttgtgtcccagggggcccacatatatttcttcacctcctcgtttcatcagaaacagctgcagaagttcaagaatagcctgttagtgttcgtatgagaggcatccaagaattgtgcaattttggcccttgcttcaacttacctcatcaaaagcttcaaatatgtcaatgctgggctggtgaaatgtgcagacaacagttcttcctgtgtctactgtgtttcaaactgttctcatcacaattgcagctgcccttgcatctagtcctgaagttggttcatccatgaatatgatggatgggttggcaacaagctcaacggcaatagtgagcctcttcctctgttcggtggataaaccattcactcctggcagtcccaccagtgctcccctcagtgatgtcagctcaacaagttccatgacttcttccacaaacatctgcatccgtgaagtgagtcagcatcacaatgcaaaatgtgtaatgagctagcagagtaaaggctgtttgactaacctttcttgcttctgagtctacttcagagggtaaccggagccatgctgagtacagaagggactcgtaaacagtgacatgtggagagtggatatcattttgctcacagtaaccagcaatccgagcaaaggtctcttgcttctttgggtatccagagatggagatgtctccttcaatgtaaccgcctgttttccttcccgccagcacatccattagagttgttttaccagctccgctaacacccatcagtgctgtaaggactcctggcctgaaagctccgcttacacctttcagcagcagtagccgatcttcagtaacacctttatctttcatttcctgtcaaaaattgtgcatcgggattagcataatagcatttggtggtatatttgttacacacagggaggcttccaatgcttgcttacctgaggcatatccacagagtatctgatattgtcgaaggtgatcgacagaggagtaaatggaagtaccattcctctcttcctggtgtcagctcctgtaatctctcctcttcctgcatttgctatacttgttaaaaggacacaacaaaatggcatatcttgttcaatgccataatacagaggaatgtactaaaaagactgaccatcaaaaggtgaattctgggaatctgttccaagagtcagcagctcaacattttctccggtacggtttacatgtttttccctcaattcctattcagaaacaacagcctgaccttttccaagtgctgcaggcataatatggtgtcaatgccaaataaatgatgtttgaatatgctaatctatgtgtttcagagctgagatgatactcacggtcaagccattcaaggaacagaatgaagaggatgttgaagagcatgatgtatccaagtaatgcgccaacgccaatccagtaccagtttgcatcgacaaatatgccacgtaccttaaggacttggacaccaagcgtgtttttgctttgtgtcggatcaacaacctgcgcaaagattaggttgcttctgagttatctaaatccaaacttagattgtcaggtttgagttggtgcaggagacactgcattaccttgttccagctgtggccaaggaactcattaactgctatggcattctgtgcatacatcagaggagaggaccagtagccccaaatccaccatttcttgatgttttctgcaaaaggagaactcagtacaatgctcttgttactactggaacaatatatgagttacttggcatacctctagatatcaagaaaccaccgagaaccagaagaataagctgagcaaatgacccaaacgtgtctgcaacaaccatctctcttcctagtgcagcgagaagccggaagagaccggacgccatctggctgatcagtaccagcagcacataatggcggaagaatctctctatgtttggatcgaagcccatgacatagtatgtcatgcaaatccacacagcacattctaagaatgatattgggattttgagcacccatgtaggtaatgcatacgcccatgatggatagaaaagcaggtccctctgcttatagaatatcggcagctttgcaatgctcatggcgagctccgcaaatccattgaacaaatgtgtgactaatccaaggaacatagcacccaggaagatcgcaccatcttaaacactgcgtcgatgcatctttgtacgcaggaagaccgtcattccgatgcttccaaggattatgagctggtacagatgtacctttcgtcagattttatttatggtcccgaagtagagagaaaaaattcaagatgcgagatacatacctggagaattttgaagatgtaaacaaatgaattcctcttcatcagcagccactccctcgagaagcatgccttggtaagctccatcttgctgatgccatacctggaagttgtgagagcagcaggatggttcctggttcggtcaaagggcaccctgagctctgagcccagattacgcccaacatggaattccttgaaggcctccgaaaagtcgttcaccgagatgtaccggtatggttcatctctgcggcaccagtactgatgctgatccttcctcgatgtaacctgtgcattcagaatgaacactgtctaatttgagttcctagtccaacatgctgggaagattactctgctggctcactcactttttgctagaagtatgttgcacctttcctatacggacatttgaagaccattgcctcaaagaacgtaaggatgttttctcgaggcccctggtatacgatttgggcctccgagaggaaaacaatgtcatcaaagaggtcatacgtgtcaggtgcaggctgaagcaacgcgatgagcgcggttcctcctaagatgtggacagattgcctgagggagttgacgatctggtatgctgtggagctgtccaaaccggtggagatctcatccatgaacagagcctttgctggaccgacaagcatctcacctacgtaaattcagtggattgagaggtcaagattttntttcaactattgatcggaaagaacaaactgtcatgcctagttctttgttgactgcagattgcacataccagttgtgacacgtttcttttgtcctcctgagatacctctgatcatagcgtctccaaccattgtatcagcgcagatttccagacccagaatctgcaatagcaacttaattagttctagtcatgtatatttcttctttttttctctattttcctgtagtgtgttgtactcactttgagaatgtaatctgtgaccacgctttcctgaccttccacggagatggcctgtttgcacaagggaacaacaatttgagcacttcttgtatacttttccaaaaaaaaaaagaaaaaaaaggaaggcttgtgctttgaataaactagcattttaccttcatgtaaacatcaatatcaggatctggtttaatgctggcttctttctcccttcttgacagttcagtaagcatgtctgcgtgataacaaaaccaccataagaataacttcaccaaaagcgaaacaaattgctctgcactttcagtgcagcatgctgcgtaccgtaacgagttccaactccttgacatcttgcagagaaggccagtgtctccctcacagtcatctcgccgatgtgaagatcatgctgcccgatgtaagccgatgtcctctgagggacaaattcgtccatgtcatgcccattgtaagtcactcttcctgatacctgagcatttcaaaattcaaattcagccatgttacaacttttgcgactaatctttcccatgtgataatttttgtccgaaaacacgggaatactcggaaattaacaagaaacatgtgaagatgtggttaccttcagtgttgagtccagtttccctgccagagctaggagcaggctggttttcccagaaccaggagggccaagcaacagagacatcctgaacaaatttcacattattaagctccaacctttcatcaaaatatgataatccgacacatgaacagttcttgattttcctcacctgccgggtctgatgattccactgatgtcatgaaggatggagataggcctcttcccgctcgaaacgatccgcatcgcgctcagcacatcctgatgatccaaacagttcaacaagaatcagaagctgcaggacgagcttaacaacatctgaacttggaaactctttcagctcctccatgatgatcatggatgatccaaatgcgtaccatgattttgttggagaagaagttggtgaacgttgggattccccggttgccgacgtatgcctccgcgtcgatgctaaggttctcaaacctcacttcaatcgtcgggttgtcaatcccaactctgcaaatcaaatcatcacaagttcaaatttcaaaaccacccagaattaactctcaaaaacaaagacaaacaaagaaggaaaagaagccatgactgatcacttttcccccactatctttcagttgctactgatgatgaacaccttttgtgtctgaaatttgaatttgatcgagaagaagaggaagtgaatggaattgagcctcaccgctccatccggtcgcggagcttgaggaggaagcgctcgttgtcctcctcggcggtgcggacgaggcgctcgatgaggttcctcctctcctgcagcccgagccccccgatgtccacctcctccacgccgccggcggtgaggatgcccttccgcatccggtcgtacgtcgggagcttctcgatcgccgcccacttgagcgcctcctcgtcgtcctcctccctcaccgacctcccgaacgcgtcgctcctccccgacgtccccctccacgacgacgccgtccgccgcacgctcccgccgccgctcgccacgctccccatcctcactatatccatcttctccgatcacctcctctcaactccgatcacctcctctcaactccgatctctccttcgatcgatccgcccttgcttgcagctgcagctttttgctgctgctcgagtggagaagatgacgagaaagaagcgagggtttgtgttggttggaggagacggtgatgggggtggtatatatacctcgccacccacgcgcgcctcttaattacatattaatcggagattagcgaggtgattgatgattagtatagctaattactagatttagtcgaaatggcgggctcgctggtcatgacgcagccgcttgtttcgaattttttttaatttttttaatgcggtctcgagcgtggatagtttgaccggccggtcggttcgcgccgaaacgtcttgaccggttcggggtcaggtccgcctcgtctgacccgggcactagggggcatcggggtcatcgtggccgttggtgggaggatctgcgggtgggattgttccacgtgtcgccgggattcgcggtgttggggtacctcccgcgtacggcaagggggtgcgtttagtattagtggtgcgagtgaagtcagctatgcaggtaaacgtcaattagtggctgcatgctgtagtgtttattactactagcttggtatgtagattatcacgtccatgaacagcgacaatgttgccagatatcgtgatgatcaaaacaaaaggaaaaagtgtgggcctgagaactacagcatgcaatttggatgtgttggaattaatactcttatgtgccgaatggttgaatggatgaatagttgaataatttttagcaattattcgagagtacaaataaatgaaataaattaacaatggatttaatatgtttcttggaaatttatatataggaaaattcatgcatgtttcttgcgaagcgtgcacatctctcctatcatttcattaagtacaaaagaatacgcaggttacaaatctcagcatctatatttggagggggttcattgatttttattaaatagaaaaaagagaactgtacatggcgaaaagaaagagaaaaggtacaggctaaggacccttggtccaagctaactaagggtgtgtttagttccacgccaaaattgaaagtttgattaaaattgaaaattcgaagaaaaaagttgaatgtttatatgtgtagaaaagttttaatgtgatgaaaaagttgaaagtttgaaggaaaagttggaaactaaacaagggctaatgtgtaagccggcgaactgatttttcactctcttgtactctcccctagctgctgttcctgctagcgaacacctgtgatcaaaaggcaaactgaacaccaaaataactgatcggcgatcggtttgtacggcaaaaacaaaaggagaaacagggtagaccatctacgaagggggagtagacagtagactacttcatctgcaggcaacaagaaatcaacggcggcgtgcgcgaggtctggtcagtcgccaccccagatcggacggccacggttcgtcttctagacgaccagctgtatgacatagccgatcttcaagccttcgttgaaaaggataacgtttcttatatttaatttcttaacgattccgttaataatactatatcgcttgccaaagttaacaaagtcagaatccagtggcaatcgagagcatcacgaactctggactctgaagtctgaaccagtcagcagtggcttgcggccagttaataataacaacacttttcctcgcaaacaaaatataatgataataatgctaatcctttctgtctggtcaggtcaggtcaaagatggccagctcttgcgttgtactcgaccattgttttttcaaggatttgtgggagaatttctctggagaaaacaatgtgatagtagtagctttagatgagatttaactgttttggtcgtggaagtcgtgcttcgacggggacggtgacggacggccacgggattcacgggcggccggcgagccgccgccgttcgttcgttcgcactgccggcctcttaattcgcttccattagtttctggtcgccgaaccggtgtcgtgcacgttgcaccaacattgcgaagtctgcttccagctgcattggagattcggagtcgtcttccaaaatagttttcatcacgataggagcatacggttttagcttttgctgatgtagttttgcttggagaaaacatagtacaagaactgtgctgctcctagaaacgtgaaaagggaatagcactacggcacacattcgtggacgtgcaatagttgaaaaatatgtgttggtgtactagcccagttgaactatgcagggagctagtggcacacagactgttcaagtggttcacaacattattcttaagaaaaaaaagagagctttagaccgcacgtgatgatacgaaacccattccaaaaccagtggcctatgcagagacacctctagaaaacaaagaggttctggacaaatttcaaagtcagataactgctcgagttggcatggtacggacagcatacacattatcacttgtcaaagtcaggcaagaattcctcgggctaataatctacaccgacaaaagttcacactaaacaatctgcagactaatacatggtttcctagccttcacttacatgaatcacttgttacagttcttcatggtatattgtacttctaggaaagttagcaccatgataaactaataataccggttttgtgatgtgcagattttcatgctacgccattctcatacattgaaccatctttggttgtggcttcttcaccaatgtcaacctcacccattgcatcgtcaataagagactgtaatacagaaagagacagcagttcaattatatagcaggtcaaacaactcccaagaaatacaaactaagctaacgcattacttcatgaaatcatgagtatctccacagactctgggcacgactacaagagcatgcaggtactgcacccaggattactgaaattcaataaagggtactctagggaatcaaaagaaatcatatgttgagcaaataacctggagctccttttcagacatcttcaccctgtcattgtagtcttgaagttgcagaaaacatttgtacagctgcatttaatattttcaaagtacagaatgtgatttgtcttggttatccgttgcttattttcataaagcagcagctagcatgtgagcaaaataccacatgtacctttgtaacaaccaattgtcgttctgaagaaactttccgtgcagcagacaattcatcctctaacttctgtatttttgtatttaaaaatagtttgtcagaaaaaaataaacccgagtattggacaaggataagcacttgcaaatttaaaaaataacagtgcgaaagatgctaaaaaggattccagtatcaggatacacagatcacctgggatctcttttgcaaatctgcaatgtgttgttcctttgctgcaactttatctttgatctgactaacctgtaataggacagcgttcaaactattttttcataatatgagaagcaaacagaacaaagaacactatataacaattgtaaatgctaaagttagtagccagataaatatgtggtctaatgcactagcaccatgagtagtgacaaaatcctagcatgctcctagttgactatctgttggtgttcaagcaatttaggcatgttgcatcaaatgtatcttatgagacaatgttagctttgctgactcagattttatgaactagctttgattatccaaataatgactaataaaatagagcatagctgaaaaagaaaaagagtacctcattttcaaggtcctcgcgcatttgaattgctttgttcaactgtcgttttgcctgataaatgcatgaaaagaaagaaaggagaaatgagaaacccaacaaaaattagaagcaatagaataaatggttagaaaagctcatagacaaatttccatttgaagtaacagaacaaagagagatgtatttacatcactgtgaagatcatcactggaaactgatagatccctgctatcatgatcttttggacggctgtacagaagaagtcaggaaagtaaagagatgactcaatcctaacttctctactacttggtagcaagcaaaaatattaatcatatacaaattttgtttcaaagcagacacagcagaaggtaatagactgtagacattacatgaagactcgaaactcaccagtgctctttgtaaattttgcaccagccaacataagtacataacagatgtcataccagtaaatgagatttggctggcaaatttcaagtatgacatacgaaagtacactctattttattgcgcagataacagaaagacaaccctggatccaggctcgctatttatggtttcatatctcagttcagatccagcagaacacttgtttaaagtgctaatcacggcgacaaggcacatacgataatttcagttttaaatcctcagcatactcaatatgtgaaacccattcagttggtatgtgtgctgttagtcttgatcactgtggggtaaacttaattgcaatgtgccaatgtctatccccatcaccccctaggagatagcaaaggtgtcaacccaatttaatctacaatcagccacttgcagttgaaatcaagactgacagatgacatatgcaggtaaaagcaacttacaagactcaatatatctgcaagtcactactcactacaaaggtgcattcagcatttcagctgcacaaattctaacaaatttggacaagactgaccatcaactttaaattcagggagtagtcaattagtaaattaacaattgcaaatttacattattgataaaaatgaatatacagtataaattattgggtaagttggcaaaataataataataataagaagaagaagaatagaacaattggttttcgtggttgaaactttactaaggacaccaggatcctatccagatttatcaaaaaatatgccacatcaatagtcctaaaaactaaataacaccactaaagaaattacaaccttctgacacaattacatgcatcaaccagaaatatattttttgtggaaattcaactcagatgccttgcaacttcaattaagcttcatgccttcatcacaatacaaatatcttccctagaatatatatatacatgatctatttccacccaagtgcatgattagcaatattaacagagctaaaatacaatgagaagataatacctgaacctttttcttgatcgctgctccttttctttctctctttcactatcatagtctttagagttttctttttctctgtcattatccgaatcaacattatgcatttctgctgcacggtcgtagtctctacgcctttcatccccatgatcttgatccatgggatagtcaatttcttgatcaaagcctctaggttcgtaaaatctgtctctatcacggtcacgagatctatcactatccctgtcatggtagggatctctgtcacggtcatagctcctttctctatcccttctgtcccaataagcatcccttgcgcttccaggttctcgccgaaaaccttcacgcccgaattctcgggcacctctagtacgcacttcattcactctaacaacacgtctatttattctctgttgcaaacaaaaatgtaattaatacaagagataataaaaggtgttaagttccagataggagcataccttgccgtccatgcctgagatagcatgctgtgcagcatcagcatgagtgaaagtaacaaaaccgtaacacttgcctctgactctctgatcatttatcacctgcaaaggtcagaaagagattcctctgtactctcacataatttgaatcttatctgacaggtaactactttaagagggaaaaaatagtgcattgactgcttcaaagcaaaaatccttttctgttattgtatcggcaaactcgggaactaaaactttaaacccatctttggcattgcagtaatgccatgcctcctccacttgaaccagaaacaatataaccacatctatcacttgcattattgaacctctcattctactaggtattaaatcaagtaccaataacacaaaaaaaggaacgcatccaaactaatatccaaagggaaccctgaatccttctagtgtaaatttaccctaaaaactaatttgaaatatgagctacttgcctccctattcatcttagcagcaaaataagtgactgtgtgactgaaccaagtagcatgtcactacatattcaccttcatttcccccctcccgctttagataatacaactatctccccaccaaatcccgagccctcactccagagtcccaattacccagccactccatgtctcgcattaggacgtagatccaaataaaaaccctaaaacaaacaacgcccttgttgaacccagctatctcgaccaccaaaacgagtctcgcgacatctcgcgtgcttttacatcacagcgggcagcagcaaaacaaaccctagaaaaaaaaataaacaagccgattgacctcggagctcggaccaaacaaccgtcaacagctaaaactcctcaacgccgcaaacccctgcgacgggagagcgggacgggatagcggtggggggcgcgcggcgtgggaagtagggaagggaaccttgacggagacgatggtgccgaatcggccgaaggcgtcgcggagcatgtcctcgttggcctcgtacggcaggccgccgacgtagaccgaggtctcctcgttcaccgccgccgacatctcgccgccggcgacgacgacgacgacgacgcgggctagggttttgggtttacctccgctccctcccctctctctctttctctctctcgcggagacgaggagtcgacgagcgagcggaatgggtggggaggctgtcggatctgacgccgcgcgtggtgatggtggtggtgggctggcggcatccacaatccagatccgtgtgtcccctcgtgaccaatccccgtcgtccccgttccgatcgtgggttttttctacgtgggccggatcaaagatcaggcccatctcgtttggaaggatcgcggctttcaatacaggttggagtaggtctattttccatacttcaactattgccccttagttgaatcacattactctaccacaaaaccgggtacatcacatactacaactaccaaaactgaatccctcagcggtttggccgatggttttctcctacatgatgccaaataattaataaaaaacttaatgagacccacatgtcaatcagataaaagttagtaaacgcatagtgggcccacatgtaagtattctctccctttacccctccatcttcatctctcatattttccacgccggtgccaagagtgacgacgtccttgatctcgaccccagaaccagcgcgggtcgccgtcgatgagtcccgccgagctggcatgcctatccaccatcatccccgatgagcccctctgagacagcacaccatcccctttcctgaattgttgtctccttaagctgcgcaacacttagtggcaccttggctaccagggttcgcagcaatggaggtgaaggcagagctcattggaaggaggcaccaacaaaccttggtggcgagaatagaagcttggaaaggccacgtcagcggcactccagcttcatctatgtgcttagtgacgaggggtggccgcagatgcccaaacctagcccaagctcctctacttcgttggccacgcccaaacttccacgtctctctatcgctatccgacgtcctcttcctaagatgctcaatgcggccgatggcccgtgcttcctctgcctcttcctcgacttttgcactccgccaccagcccaccgaccgccgctaacatgcactgcctgccatgtcattgggcgcctcgtgcgtccttgctctcgtgaagagataaggggtgagaagaagtgatgagagatagagagaatgacacgtgggtcttaatgggtctttttttacattttttcaagagcgatttacttgtgggcccttttttttattttgggttgactgtgatgctatttaaacgccgtatagacgtcacgccagataaagaccagtttaacatgccatgtaatcgccacatcatccaaaaccaccttgcaaaccaccaaagtagttaatttacaccggttttaaatagttgaggtagactttatacccggttgtgtggttgagggatgccatttgaaggagaacgatagtccaaggagactttattccatactagcttgactcatgtgcgggccatctaaattgggctcgagaacgggatcgcagctttcgtgcgggcccatattagttggactggaatggaacttcggctcacgtttggcccatgctgtttgggccagaacgggatcggatctgacgtgaggccgtaacggaactgtcgctaacgaatgtacgggcccaaatgagaggcatatcatgcggttgtgggacgacggcggccgacggcaggggagcgagcgccggcgacggcgtcgaccgagaggtggaaccgccggtgaccattggactgcgctgacctcaccggctccggcagttcttcgctggctggcagcccgagtcttctgaagttctgataccaacactttgtcttgtagtaaacatcagcatagatgtcacaactctagtatagctaaatttaaaggttgcaaggccggaaaaaaaacatggatagctactattgtaaagattcaaaaacttctccaacgtttacttccagatcagacaacgtcctagtctggaaaatccgacgaaaagttttggtcctttcctgaaggttgcaggttgcagcacgaaataaacatttgcaaattgcaagcatcggccactagtagatgcaaaatgagttgaggaaccggaatttccacaaaattgtaattaccaaaaaggcagtttcatatctatgggatggaacaacagacagctacagatattctcaagcaaagaactaaagacaattctcaaggtgaagtcaaaatatacatgctacaacaacacaaaaaaaatggcctgcttatttttcttaccactctgctgctttcctcagcaacaacccagggcaggccaaactaagcagcttttgattccacggaagacttatactaactaaatttgcaaggcaaagaacttattgagattgttgaccagacttctccgaggtcgtactctcaggttcctgagacactttgatggccgaaccattcgcagagttctcactggctagagtttcttggagagaaccatttcctgacccaacaacttgagcagttgtttcgaccgtctttgctttcagcattttctccttctcaagctcttgctttgccagtggggagaactgtgagtcaagggaccttacagcacccaaccaggcaagaacaattaccaatagaattcctcccaggtagggtgtagaatttgcgagagatccaaatgataagatcatgaactgctggatcaaggcgcctccagacttccccaatgggttgcagaccacatcaattgctgccttacctttgacctgaaatcatgaatagaaggcacacatgagaagaaaatttcagaaccgcgtgaaaattttgaatcttatatcagccttaaaatttgacaggccatacgttcttaatggtgagataatgtgtgaataatattggactgcaactatagtggatttgtacatcacaaatgttacggttagcacttagaaaaaaaaagcacaataaatttgatagacaaatgcattccagtcacaatcaacaaattaatcagattattgtagaactagcaattttgatatgtatgcattctactatcagcctatcaggtgtcagggactatcctcatagtaacccaacccatcttgtaatagcaagtgcatcaaccatctggtgaggtactatcaaacatgcctagcacagttttctgaattccaacagaactagtgggtagcagggtttatctgtttaatactaccatatgttttctgacattagagcaactggcctgattaattatatcaagataggaattttggagactaaccttcatgtcctcgtccaaaggaatgtatgccatttccttacaagggtcaaacaaactgtacttcgcactcttactgaaaatgttctgcattgccccaacatagaccgcagcaagcaaaggtgtcattccaagtgtggccataagaggagtcaatggctcaccgaataaaatcagtgagaagaatccaactccagtgagaagcaacactgcaggggtgattgtagctgcgactccccacccaaacttcctaagaattactctccctaacaacatcattgtaaatgtggctatgccagtagcagtcgagaaatcccccatgaatgaagaatattcattagggcttgggtactgcaacagaaaatagagttaataaccactcatattatcaccaaacaattgcacatctggcaatgtggatgaacttacttgtgccttcagttttgacttccatgtcacctccacaaggttaatgcttataccataagcaacgaccagggtggcaagatccctcacataccgagatgacacaagcaccttcaaactctctcccatactcagctttggcttatcctgcagggtcatgtttgaagcaccataaatgaaagctcaataaacagaagttgcaaaccatagaacccataagaaaaccgaccttcttcttccgctcgacgactggcgcagctgatttatcaattacaaacttgtttactccccagtagatgccggcaatcacaaggcccagcaaaaccactatgctcatcatgcccctcaatgaaatcgcccatccgtccacccctggacccaaattctgcctcatgtttgagaagtatttcactgtgcgacccgagaagatgagtgccacattggccccaagcccgaacagtgggtaaaactctttggcctcttcaaccgtagtaatctgcaatcgttaaatgcactgagaatttgtgtacgtagccaattgttttgaagtgagaatctacacaaatttaaacatgacccgttcagctattcacaaatgtttagaacaacaatgtcctacaaccaactgacaattttgtaatttcgtagaccaacatcactgtcagttattgccgatatttcaggagaatagtttgcaaacttcaattgctgctactaaatccgagaggaaagatttgattgtacctgattggcgaatccccagaagagcacggagatgacgacgctgccccagagctcggccatgacatagaagaggcagaagctccagacgcggaggatggcgacggggcccaggaagctgggccccagcgcggcgaggaggcggtcggcgagcgcggtggggtggatggcgtcgcgcatggggtagagcaggtagccgaaggcgccgaagaaggcgatgaaggggaagatgacggtgtagaagagggcctccttggagagcacgtcggcgagcttggtgtagagcagcatgaacccgatggccatggggaggttgacccacgtcttgaggaacgggatgatctccgcgctgctgcccttggcggtgacgacgagcacgtccttggtgtcccgcaggatggtgtagttgaagaggatgcagaagaacatgagccccagcggcacgatcttcttcagcgtcttcgtctccacgcccaggaacttgggcgaggccgaccccaccggctccggtgccgccgccgacgcggcggcggcgcggagaggcgggagggaagggcggagcgggagcgcggcggggaggcggagcggggtcggcgtggggaggtggagcccgagccggagtggggtggcggcgacgctgccccgccgctggcggaggaggtgcggcggcgcggccgggtggtggcggtggtgggcgacggcgaaggggacgcggaggcggtggcttgcgacgaggccggactccatggcggcggcggcggcggaggtggggaaatatcttggaggtggtggggggaaaggagataaggtcggggcgctcggcaaagcgggggtttggggaaggggaggggtgtgtcttatactactactccggtgagattaggaggtggggaggaagacgacagcagtggggagagtgggagggcccgtgtggctggcttagtgctgagattagcctaacgaaccttcttcgctaatctgaggaggggagacgcggacttgggagtgtatattcagtgtactgaattttttttcctctagaaaagttatactaccaggctgtagtaaaaagacaaccaatttattttagaaaaaaacgaaactgatttgaattctagtagaatttaattttagttgtttatttaaggcccagtattgggtgcttaagattctaaaaatctgctggtcggtatccagcttatgagaatatggaaaagctgggttttcttgcttctgggttgtagtttattttttggattttataactacagattctcagaatctgggtgataatctggactgtttgagagaactggagattctggtaaaatctgcaacaactagaaaatcccctcaaacaggcgcttagccgtttctgtttaagctctcttctcatcatggttaagaaaacaaataaaataattttttttgtaaaactacagatagtttagtaaaattattatgagactatagatagatttattaatttatagtatcacaaaactaaatgaacaaatttattagaaagctataaatttaagcaattgtatatagaaactatatattcagtgtcatttttttcctcgcaacacggagcatcgattttctcggagaattacacattttaaaattttactatgttaataggtatagggatagcacatctaaaatttattgttttatgaagataatactaaatgtatgctttcgagtaacaatagttttatgttaccatggtttaaatatgttgttttatgataattttgttaaagtatatgtagtttttgaaaattattttaaaacatatgtttaaattatccctaaaaatatatgagggtttgtactatgtatttcacaaaatattcttaaaaaccaaaatttttaaattcaagtcaaaatgatgctgatcaatatcttaaagcaaagcgtaataaacgcaacacacaatatacaggtatcacataatttactgggtgtggttgttgaatcacgcttggccttattgtaagtagaatgatgcatagaaacaacagttgacacgacaatgatctccagtaaactccacgttgattatgaacaacacttgaaaaacaaataaaataacggtttcgtatgatcgggatattaatttgagttacattcggactaaagagagattcagccatataaaaagataaatataattcctcatttggattaccataataaatataatggatgcactcaatatgattagggatgttgagggtagatggtttttctataataaaaaaaagatgaatctagagaaattggatgtattagttaattgtatacatgcatgtctttttattatgaaaaaaaagatggttacatcctatattttgaagtaaagaaagtaatagattgttatattttaggacaaaataagtatttttttaaaaagaaaagggcgaataaaaaatatcagtaaagtaaaatggcctcctgaggtagatactacaagtcttgacaagaggttaattggtactactactacttgctacagtaggggccagtagcagtggatcattttgcatgatttgctacagcctacaggatgagtagcagtagtagtagtacgttccatgccaaaccgatcgatccgtgcgtgcctacaccccagaagggtctgaggagagtgagaggacgggaaacgcatgggaatgggatgcgcccgccccgcccccggtccctggtcgcaggcgatcaacgttccatcctcacgtcgcgacgagcgagcagcacactgtacacacactgatactgatacaaaacgctccgatgctcgcacctgcaggatcgaaaagtttgttgggcgccaccaccgctgtcgcgtgaccctccctccgctccgattgacggccaggaaatgcccggcgcgacgcgatgccccctttgctctcgtctcgtccgccaccgcgacgtcgtcgtgtccgtccttcccacgtgactccgcccccgcccggtggcccctcgcctcctcacggccgtccattcgctcgcagcgccctcgtgctagctgccggggggccttggacaaatactgggacggagtacgggaaaacgcactgattctgccgtcgaatcgcgtgcgtatctgcatctgcatatatcgggccgctctttctgggactgggtgattaatctcgtgtcgtgtcagcttaactagtggcctggtctagtgcatgggatgatgataattccgaggtacgccctgtttagttctaatttttttttcaaactttcaacttttcattacatcaaacctttcatatacatataacttttttaccacatcatatcaatttcaatcaaacttttaaattttagtgtgaactaaacataaacatagtcgtagatggcgtgtggggtggggtttattagtgataaaaaccccttttggctttacgcgcgtgagtgccacgggactctcgggctcggctcgtgtaagctgtacgtagcgtgcaaaatatctctctccctctctcgatcgatcgcctcgtgtcattttcagtttgctccctttttccggcgacgcacgcacacgctcctcatttcgtacggggaaagctcgtggcttatagctattttgcatgcactggccggttgctggcacagtggcgctccacacgtatccgaagttctaaaccaactagaaaggtagcccgcgcacatgcgtgggcaccttctcgtataatatgagtaaaattttattatgaatatttatatgtaggtggctttttattaaaatatcttgtattatattctaaactaaaattaaatttattttgtgtgctttgaaaagctttttatatttttataattatccttgcaacatataaattctaaaataaaattacttgaaatcatgtggttttgaattgatgagaaactattgtgtcgaaacaatggaggtggttcctatgataaaatttagggtattttaactcgccaaaaggatagtttacaacctcaaaacaaattcaataatatcatttttttgtttgattgtattttaaaattatatatatatatatatatatatatatatatatattcattctaaccgtccttgtaaaatgtttcaatttttctatcaagtattggttttaaatccagcaacatttgttcaattttcaatttatttcatgcctatttttattttttttcttttggatagtttcattctatgaatcatccttgaaatgatttgatctttgcaatttgggacgaaaatataagaacacataacctagtatggggtaaaggtatacgttctaaattttctctcctgaaatatcaaagtaatggtcataatgtatttagtgaatcatcactaaagtgtattgtcttataaaaaaaggaactgacttgatttattgctaaagccactgcaaggttgttccatagttaaaatccttagatacaacctacatgcttatcgatatgatgttcaaccaaccacacctttattttcaccctattgtctatattgctagatgaatacctgctatgattagtgacttcgtagatcatatgtgtaattcgaacgctatgatcatctttcttaaaaatatttatctatgtactaaaaactttattttgaaagtaccaaggtcaatttgtataggcatgtcaagagaaattaattaagttggcagaaagtctttagatgcctaacatgatataagtaataaatggaggtccatttgtaattttttcccatatagataattttaattttaattatcaaggagataaaaaatagagagaagaatggcgcacgctgtacatgggcaggaagggagggaggtttgggatgtttttctaaatgattaatctaacagactaaaataatgtgtcagatgtttatgtcgaaaccgatggtcggatgttttgttttcttgtcagaattttattaggattttctttgatttaagagaataacataatatcttaagagcatttataagatgtgtaatcgactttttaacccgtatgccgcaaaggagggagggaagaaggtttagggtgttctttttttttaaaaaaaaatagatctaatgacctaatataatgtgtcaattaatccattgaaaaaatgtgtccatcgatttatgtcatatctaatggttggggttttttttcccaaaatttctaagatttttctctaatttaagaatgccatatagcagcttagaggcattaataatatatttaatggattttaaccccgcacgggattggggaggaagcaagaaagagaggtttgggttttttcttattaaaaacctaacaaatcgatagccaaatgttttgttgtttttttaatattttctagtattttatttaatttaatagcaccacgtggcattttagaggcatttgtaggatatttagagtcacagagcgagagctgctagacctaataggtggaggtctctttgtgatttttttaatgtaaaaataattttgattataatttcttatgaacatagctcgttggtaagtacgtgacgggaggttcggaatgcgtgcttttttttaaaaaaaatctaaccttctaagataaaaataatagatcaccgatttaaataaaaatcgatggttggattagagtgccacttggcgacctaggagcgttcgtaaggtaccacttggcgaattaaaagtatttttaagatatttaatgaacttttatatataattatcttttttttgaaaattctaaggagtatgtgatatagtagcttagaggtgtttataaaatgtttaatggattttaacaccgcat

SEQ ID NO: 30298 - DNA, 1263 bp, Oryza sativa
accatgggtaatacccttttttctgaacccatgccccgttggttttgaccaagtctaacacgccaaattgctacatgttgaggtagtcaattggtccgtcatgtgtgccaaatactctctagatgaattgttacagtccggcacaatgctcaataatgtaggaaacggatattgtggctggatgaggggatcttacactctgatgatcactgatatcactcatatatcagcttttctatcggtcaggtgacgggaaactcttttaattaaacactcggtggatctccatccatttcttatatgtcaattaattgattatgatttttttaaaaaagatgacaagatagattaatatataatatattactccacaaacacgcaaattcaaatttgattttctgaagaaaaatcacaaatttgactatgaatattgtagttagagtatttattatttttgttataacttgtataagttgaatttaaacttgtatgtttgtgatgcgatatattacatattaatctatcttttttttttgaatttttttcataatcattcagttgacatgcaaaaaaacgggtggttatccgcccgggagattagaatccatctccagcaagtgcctgaaatttgtccaaatctagtcatatgatcattggttattgtattgacatccaagggagaagttatgggaaaattcaccatcaattgcgacaacggcagagagtcccggtcttgatggtgggcaccattgaactcaagtgagcattgatggattaccattttgaggttgggtgatgatgggagaaaggtagaaggtggtgaggatatatggccggagtggcagaggaccggctttgggtggtacagatgaactggctgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctgggcagggcaggcggcgcgcgtgcacgacgtacgcgtcgaatggtccgaaaaattggctcctcacccttgcgcagatgcagcctctttttgcagttttgttttgctgcaaattcggattcgtttttgttttggaaacgttccgaaaaa

SEQ ID NO: 30299 - DNA, 420 bp, Oryza sativa
acatcgaagggcatcgataggcttgccgagagatcatttcagtcaatttataattggttgatgcgaggatttaaaatagactcagaagtctacacaatgtcagtatcggttgtagtgagtcgtgcaacggaaggttatttttaggaactcatcccgatgcatagcactgttgcttggaaacggtatctggagatggcttttgaaaggtcatggccctggttatttttgtgtcggtgcatgaaaatgatagaaatattgcaatggaaactgaagatgtcgagggtccaagccatgagggggattttgttgaaccatcaggggaagatgagggaatgacacaggggtggagcaggccatgggcgtggcggatgagggggagagaaacaatacaatcgttgatgaaatggagagggaagattc

SEQ ID NO: 30300 - DNA, 666 bp, Oryza sativa
  unsure (1)..(666): unsure at all n locations
nnnnnnnnnnnnnnnnnnnnnnnnnnnnnnnnnnnnnnnnnnnnnnnnnnnnnnnnnnnnnnnncccaaaagaaaaggggaaaaaaagaagaagggacacatcagtgatagcgaagggcggcatccttttgagagcaaataattgcactccactggagtacccgtagtacgatccatcatcgacgagtccatgtcgtgtgccaccaacttgggtttaatataacggtgctcaatttacacagaaaataccttgcaaaatcccttgaaatatgcctctctgcctttgcagacgaccataaacatcaaggaaggcagcaaactgcaaacccccatcctgtccctctccccctcccttaccttccactcttgatggacacagccgacaagctccactctcccaccactccccttctcgcccacgcccaccatgacgaccgcctcttactctgctccccgccggcggccgtggagttccctgtgctcaagagcagggcggcgcggggcgcgctgctgctggcggcgaactacgcggcgttgtttgtcgggtcgctctcgtccagcctgctctctcggttctacttcgcgcacggcggcgccgaccggtggctggccacgctcgtccagtcggcgggattcccggcgctcctgctgncgctgatgtgcgcg

SEQ ID NO: 30301 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnnnnnnnnnattagtacatgagggttactgtaacacttatggctaattatggactaattaggctcaaaagattcgtctcgcaatttctcctctaaccatgcaattagtttttcattttatctatatttaatgctccatatatgtgttcaatgattcgatgcgatgttttttggaaaaaaattttgggactaaacagggcctaaggcctaagtactccagctaatgcagttgtttgtaaagagtctaatcagcagagagatcagttcatccccccaacgatccgaccgtccatctcccctcccacggatcgacgggcccaccaccctccccttcccccaaccgtttaaatacgccaccccaccggcctcgtctccatcgcgcactcgcattcgacgacccaagaaaaggaaaaaaaaagaaaaacaatcctccacgccttcgagcgcagcaggaaccagcttagctagactagccatggacgccgccggagccggagcgggtgggaagctgaagaagggagccgccgggaggaaggccggtgggccgaggaagaaggcggtgtcgcgctccgtcaaggccgggctccagttccccgtcggccgtatcggccgctacctcaaggagggccgctacgcgcagcgcatcggcaccggcgcccccgtct

SEQ ID NO: 30302 - DNA, 10316 bp, Oryza sativa
cgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggcggccggcaagtcccccaagaaggcctagacgtcggcgcctcgctttgcttgtttagctggagtagattggacgggatgtgtgtctgttagtagtctgctgatgctgttgatctaatctatagtggtgtcgttgaaccttgtgtctgttcaagaagataaatctaagatatgttaaatttttcttcagagatgtttccattcttgctccttatgctttggctgtggagatctgaattttctcaattgtcagatccgatcttataagatcgttcgaatttggttgcttgggttgggcgggtaacttaaaatcacccaaatttgttggtggtgtgttgggcttagtgccgcctcaaaaatttggtgtttggaatgaaaatcaccgaatgcctaagtatgggtatctcagcatctgtgattttgctggatgttgaagtgattggttggaatttgcattttgggaggcaatctggcgctttggtttgaattagtggagggggaatggcgggaaaccgggtacgaaatgaaaatttgtcttgggatttcctatggcattgggcgggctaaatccatggaagtttggagctacttggcccctcaattgtgtcttgagctgtatatttttgggccaacaggcaaataaacttggtcctcaattccgctatggacttattttgggtcaagatccacgtccttatgaatagaccttctctgtatttatgttactacctccatttttgtattgaacacgggtaaaattaaatgtgatgattgtgatttgttgagaatagaaaataggtgaggatactaagaggtggaaggttgtgattggttgaaaaaaagttattatatttaaggataaacgtacacctaagttgttatattttgaaacgaatgaaatactaatatatttgaaagatccatctttgtaatagggtcttgtttgtgtaccctcctttttaagcaaggacatttattttttagaaaacatagtacaacataggcgcttaaaatatgcaaactcactctacgaatacgcacatacacatcctaactctatgaacagtcatcatgagtacatcatctatcgttaaaagaataattagttgtaaatttgagtacatttgttgaatttgaattagttccaccacaatgttacactcattccgtcaagggtatttaattttgatcaactatataacctttgtacctatttccatatctcacagagcacgcttaatttttcatgtagtgaactaatgatggattataatgttatatctgctagtacaatttaattttgaagaaatggttgtctgctcctgtaaaacaataaacttccggtacatcctcaggccaaggcaacccagtagcacaagatttttttaatttttgttggtctttttattttattaaaatattttttaaaaaaatcatagcacaattggaatcgtccccatatttggactggaggaattttatacaaggaattaaactaattactgcaaaattcctacatagaaaggaaccctttacctatcctaggttaatcagcgcattctaattgatttaattgaactaaagtgagataatccaactttagccatgcccatggaactataacctcttaggtaatgtgttcacaggtccgcatgtcaatgatcacgttactctgacgtagggcacaaagccatccaaaaccagttcatcggatatacataacggctttaatacttttcagatcaaattcaaacaatatcgctttatagatgacacagaagaaaacggtggaagcactagctagtggagcaggggcgggtatatgggtcatccagcattctacgcatatataaccttccagctcgggttcataaattcaacttaaccttccaacaacaattttcctgtttgaaagctttctttgtctttaaaaaacaaacaatgttgttcgcaaaccaatacttggctcaacagaagtcacaaaagtacgcattcaggccgggagaagtgctcataggtcttgttggaactaagccagattagccatgtagtcatgtacgagtacgctttaaggcaggaaaactgctccagttcagcaacgatggtgatagactatgccctatgcagttttattcttttgcaatttccacaaaaattagtcttccacgtatgatctgccaaagaaaagatttattgaaagtttagtcttacaataaaacagaccaatcaggggaaataagaaggctggtttagtataaatctatgctgaatacgaatcatttccacatgaagaaagatctgaatgaatactcacacgtcacaatcccaaaataaaaacaacattctacagtgacaaaatggtggagggccaacatgctagcaagatgatatctaatctcaaagtttatggccaatctagaagatattttctttgggattaacagaataaaaagaactatataagcaacacaatgttcctcacagaaggaaataaaccccacagtttggtccacatggttttacagaaaaaggcagcaaaaagtttgcttcacatgatttttacagtaaactagccaagttctcaatctgggttgaacgtaaaatactataaatctctacttagtgtctcaatctcatagaactacaaaaattagttctgttccacaccatgcagttatgccaagattacaaacatgcaacacattatatcttgaaattaggtacatcagttctgcaggcaaattgtccttttcattcagtactccaggtaagtgcctcagctaatgtagttgtttgtaaagagtctaatcagcggagagatcagttctgcagtcaacttgtccttttcattcagttgtccaggtaagtgcctcatctaatttagttgtttgtatcagtggattttttttatccccttagtatctgaagtagatcagagataacatcacaaatgaggcccactcaatctacgagggtaggtgttatcatgaatccaataaaccactctaggcttcaagtaattaagctagaaatgtgtgtgtggtgtgcatgtaccttcaattccaattgaaaaccaggtagaaagtactatatacagattttcagaactcttctcagataaagaagaatcaaaactaacatcagaaaggtaaattgcgggtcataggcaagataggggatgagcagagcaaatacccgtccatccattgccttaacagctttctctgcgtctgcttgagaagaatatttaacaaaaccaaatccctttggccttccagtttggttgtctctcaccaatcgagctacgcttgataaggtagataaagcagagtgaaacttgaatgccaattaagagcaacaacaaggatttaaattgccctgtgctgaaaatcatgtgactactgactggtaccttcctcaacagcgccaaatggtgagaagacatttttaagttcttcctctgttgtgtaaaatgatagccctacaaaatcccaaaatgagtgaatgaatgtttaagctgtacaagcaatcaacatcaaaacatgatagaatgagtggacaatccactaagaacataacttacatggctttagcttgcatagatagcagaatatctacaggcaatttatgtgttctactcatggtccaatgtgaacaggtgagcatctcacaagctcaacagattagggacttctaagtaccgctatcaccaagagaataaataagcatctatcaaacactatgagctctataacaatagctagctatgtttctataggctgtaattccctaactcgctagaaagcatcctctgatcgatcctttgttgcaatcaaaaggaatcatattctgaaagcaccaagcctcaacaacttctggcatgccatatctatcatattcagaaaaaaagaagggctaaaggacacaccatttagtgctcatttcatccaccatatcatattcagaaaaaaagaagggctaaaggacacaccatttagtgctcatttcatccaccacaccccccagaatcacaccagatcatcactcatgaagttctgacggacagatcatgacaagcgaaactgtgaagcagcaggacatcacatcacaggctcacacagatccaaacattttgcagcaaaccacaagattacgtaggcggcgaaaaattaattacttactgctcacaaatatctccgtgctgaaaggcttggctccaaccatccgagaggccaagccagccagccgcccacctcgcagcatcatctccagaagtacagagccccccgcctcaaaccctagatccccaaattgcaatcgcataagagagaaaaaaacacgagatgcgaatcagccaccgacagtaaataacactccacgtctattacatcaaatccaagctgtccattatgatcaagcacaatttacaaagcaaacacaagcttgcaactactgccacctagcaaacgagaggggaaagggaaggagagaagcatatggcggcgaaaccctagagagataaggctagttgctggtgaacttggtgacggccttggtgccctcggagacggcgtgcttggcgagctcgccggggaggacgaggcggacggaggtctagatctcgcgggaggtggcgatgggcttcttgttgtagcgggcgaggtgggcggcctcctgcgcgagcttctcgaagatgtcgttgatgaaggagttcatgatcgacatggccttggaggagatgccgatgtccgggtgcacctgcttcaggaccttgaagatgtagatctcgacgctcttcttcgccttcttcctccccttcttgtcgccggcgccgccctccttggacgacgccttcgactccgacagccgcttctccgccttgggcttcttctccaccggcttcttctctgccttgggcgccatcggagctgcctctcgagggatcggcgcaaatggagattgaggtgggattcgtgaggaggaagactttttcccttcgcgtggagttgaggcaaagggaaagaagacctcaattatatataggcgcgtggtggaaccccattggtcgacatgggttcatggatatatctgtccggtgctagcatatgaatcttttactagaaaacctgtcgaactccatacacatttatcttctattaggagtcattcaaaaatgtttaatacgacaggttttgtatttctcacattgactagagcagatataattgaactccatagctcccatacaagtaagatatatttcagcacaggacggtcgaaagagtttattgatggcgtgcattattttttgagagtggccgatgctaacaagcataagggttttatctgttgtccatgcaataagtgcaaaaaccagaaggagtattctgcattaagaagttttcatttccacttgtttgagtcggggttcatgcctagctataagtgttgggcattgcacgaagagctaggggttcaaatggaagaagatgaagtggattttatcacggctgttcaagaacaactgatgggattcatcaacgaacaaatccttgatcccgagggtgaattctactacgacggatcgacaattcataccgtcggtccttcttcttctgagataacaccggcgtcgaagtcgtagctagcgagcatatgatagaaacattatatttagggtccgaaggaattgtaaatatatgtatatatttatatatgtacacatttagtttagtgtaaatatatattttggtaatatatgcacataaattgttaagtgctttaatttatatgtgtgtaatacatatatgtatttatacatacaaatatatatcccctagaataactattctacaccccccctctcccatgggccaatcccacagacagaaatggtaaaggtttcttcaggagaagaatctgttcctctttccttccacggcagatcacacacacgaaagaacaaacccatcaagcaacaccagcccaccccccaaagatcctagcacaagaaccctaatccgcgcacggaacagcatgaaacgggcaccgatcaggatgaaaccgggcgggggaagaaggattcaggaggcgaattgggggggggggggggggtggggacaaacctggccgatctgggaaccggagatcaatcggaactggggtctcggctgcggcgcctcctcctcttgttgttgctgcttttccccccttctctctcgtgtttgttcttttctccgtgtctttgacggagctatgggctaaaataaataaaatttaaaaagaaaaacaaaatcgacaaatactctctctgtcccatagtgtaagggagtagtatacaagaagggggcggcgttgcgtgtgcgtgcctgacggggatagggccgacaacgttgttggcgtacgtgaggcggcggcagctcggtaggcgtgggcggaatggcggcggcgacggcgcggcggtcgaccgcgtaggtggtggtgtaacaccccaggtaaccacgtacctagagtgccacacaaaaatacactcaaaaccactaactcacaagttttttagaaatttcggcaggcaaatataagataactcaaagacaacataacccacacaatcccaaaccatcctagctccataaattccgtgtgaaaataaggaccagaactttaaatgacctttacaagttctgtgcaaaacttatgctaagcataatcacagtccaaaactaaatttgaatagtgtgcaataataatgtgtagaccaagggtgctactcccatcccatgccgatcaatattattaggtacctaaaaaccaatttaaacacaagagtaaagaatactcagcaagtacaatatagaactagtaaaacatacacagatttattgcaatatgaaaccaatataaaatgttggatttactttattctaaaacaaagaagtcaaaagatagtacttccctcccgggcaggtatgaacatcctcttagcattaccggtaagcctagcaagcgtgatcaacgcttctcaaggatcatgaataaagatacaaattgcactcccatgcctacacatggttcttgaataatgtaaacagaaacatccgaaataataaaacacgaataacatcgtgaatttgaatatggattgaaacatgaataagtagcataacatcagagccatacgatcaataatatcaagcaattgaataataattatgcaagtaaaacccaaaaaaaaacaactaagttcatccatcaaataagtccgtcttgtacttgccttaagtccttcgatactccgactcaactcctccaacgttggaaccctccacacctgtggagcaaaactacgcataaaccactatatccaactaatgatagttacaagggatatctactaaaatcaataacctagaacatataaactttttatcgatttgtattaaataatctatagtagttcccttactgttttatgtgtaactcgcaaaccgtctaacggaatctagcaaataatacaacttcggacatctaggcaaaattgtctacatctttcatattgggcacaaaatcagattcaccctctattggtctcagattaagaaaaactaattactgtccctattttcagaccgggcagccgcactgttttttctgtttctcctaaaccgtttatcggaatcgagcgaaaccagtggcgttaaaaacatatcgacattgactacaaactttatttagaacaactaacctgaatcccgacggtttaataccagatgcgaaaatactattgtcagcccataaacaacatctaaaaacacccgaccggcaaaccgatcgattcccacgtgaaaatttgagctaccatggatcaagaggagttacccttacaaaggagaaaaacaaatttgaggtaaatttgcggaatcccagaaaatccccaatttttgcttatctttccccttttcttctattcccctcctcttcatgtgcccctgaaccttctcctccctgaccacacaacggcagacctagcagcaacaccagcagcagccagctttggatcacggcagcagcgccaaccatcagatcggcaacaacagggaaacgatagaaggaggagcagccgcaggaactcaccgggaagaagcaaaacggaaaggaaccaccggttgcgatggatggcgacggctgcgacccccggctatggccgtggtggcggcgcaaagatagcggcggcggcaagaacgcaggcgtgtggcggctagggctgctgctgtagcgctctcttttttttccttttttttttctcttttttttataaaagagactaaaaagagatctaacggcgcacttcgtttcaaaccccgctatttcgttcggactccgattactataaacttatatctattttgcattactcgacgagctctgcgcatccatggtttctgatcgcctattcaaacaacggtttaaaaattgaacttttacgtgtttgttcaaatattccccgaaatatattaattcaaaatccagggcattacattcttctcccttcaatcgaattcgccatcgaattcgtccaaccatactctagaacacagggtattataggtggggactagggaatggggacggctcatgcacggtaggaaaggtaggagcagtatttctggcgccgtttcggattgtgggaatgaaacgagaaggttatataaaggattaatttgatccattgccattgtaattattgtattttagataaatgtcattacaatttatctattcataattacatcatcaaaattttacaaaattagagccgtgcccctatcgtcatgttttctattttcttttccatctgcacgtgggacccacgcatcatattcttcttcttccttcatcttccccttttctttttttcccatatctctccatcacctttcagcctcccacccaatccatcacgtcctctcctcgccatatatgccacgagctgcacatggccaccccggattccctccccactgcccttctcctccccacctgtcacacccagaaattcacgaaccagaatttctaagctgaatatgtattaaatccctgtccaggaccagccagggtacacaaacgacaattgttgacatacagatctacgtcttacaaaaatacaaaagattacaaatgcagcggaaaagataaaacgagctagacttggacgcttgacttcagcagtggggcgactccactccacatgcaatccttgatggcagcgatgaaaccaacctctctaagatagctccaacttggaagaacttcaactctggtgtgggagaaaagagagcaagactgagtactacccactgtacttagcaagtcataccggaaaaggaggtatgatgcaggatataaccaaaggaggctaaaggttcatttgcataaagctagcatttaaaagcaatagttgaaaacagtaaaacaattgcagtagattaagcaatattaaccaatcactgtcctacgctacaccacgttgcaataggcccaaccaaccacctgaactacaccagttcattaagctaatctaggggtgagactaatcatggtgaatctggttgatcgcccataaccgcgggcacgactattcgaatagttttactcttgtcagaggtgtacaactgtacccacaagacacgattccacacatgtcaccatgccccgaagtatcaccatgatactacaaagggggaaatcgtgcaagaccctccgcataaccctcccctaaccatccacaccacgctaaggtttcacccccacccctcaaaaggcagtgagcaatcccctcgtgcaccgcggtgaatccggcagctggacaaccggatatcccggccgacccaactacatcacgcccaccctcgccaccgatgcctaggaaagggtcgagctatacttcagatcaagcagttacccactccgcttgtggtaaacacggtaagtgtaacatcccggcctagggcttaataggattaatagaatactcatatcaacaagttgcaacttcttttccggaatccaatctccaaagaactccagggttaagcgtgcttggcctaagcgtgcttggcctggagcaatttgggatgggtgaccgaccgggaaat

SEQ ID NO: 30303 - DNA, 1765 bp, Oryza sativa
gggtgcacacgagtgaggacaaagtgtgcagaaaagatatgtgttggtctgtgagggcagtctatgacctatcaaagctatcagatgtaagcgggcccggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgactggggtgtcgatctctcttaagggggtgagggtgtaacatcccggcctagggcttaataggattaatagaatactcatatcaacaagttgcaacttcttttccggaatccaatctccaaagaactccagggttaagcgtgcttggcctggagcaatttgggatgggtgaccaaccgggaaattcttcccgggtgcacacgagtgaggacatcttcccgggtgcacatgagtgaggacaaagtgtgcagaaaagatatgtgttggtctgtgagggcagtctatgacctctgaaagctatcagatgtaagcgggcctggcctgggggaaggcgggacgttacatcccgggtgcacacgagtgaggacatcttcccgggtgcacacgagtgaggacaaagtgtgcagaaaagatatgtgtaagtctcctagggtttcccgtgaaccggtccttaactgccatgggtgcgaccagcaaaaccatgcacccacagcacaccatttagtgtattttaattaactaacaccatttgtggtggtaccaatctaaagctatgctaatagacaaagtctatgtaataatgtgatctccatttgtgtactagttgagctaggcatgactaaacattttcctaaaccaacatctagtcatttttgatacccaagttatcaatggcataaggtaaacaataaatggctgagtaataggacccatcacacgtgacattgtaaaagaatacaacatttaatagaaatgcaggatatttgtaaattgggtacaatatgatcaattgttatacatgacttgccttactctcgtacttatgagaccacagcaacgtcttcgagaaaccgtggatcgacgaaacggccgaaatctacgcgacaaacaaagcacccaagcaaaacatgctataagactactgaaacaggaaacaaaaccatttttaatagattctagggatttttatgaatttactaagacttgaatggacttaaacggagctcggatgaattacttatgaatttgaattttagaagataatatgtgcttttacaaataaagaaaaatccttattcgatttattgcacaatattgccccaggaccgacgtcagcggcggggggggggggagggagacaggtgggccccacgggtcggcggcacaaggcggccggtcaaccgtggactaggaccacgcaggtggtccactgcctgtccacgggaccgacagtccagatcggccgggagccgatcggacggcgcggcggcgactaggaatggctcggctcggcacaaagccggccggccggccatggggagcggcggcggcgagtggtcgcatgcgacggtaagtggcggcgcgggaggcaacagcgaccggcgcggaagcggcggcacacggccgatgcggcggtgcaacgaaaggcggcggcgcacgcgggaaggggaaaaaaaggagaggggggag

SEQ ID NO: 30304 - DNA, 3112 bp, Oryza sativa
  unsure (1)..(3112): unsure at all n locations
nnnnnnnnnnnnnnnnnnnnnnnnnnnnnnnnnnnnnnnnnnnnnnnnnnnnnnnagattattttcatattctcatgaccaaagtcttgtgcacttagccaccaaaaattttgctttttctccgcactgtaggattagcaacacattccattcactttcatatgctaaacttctacaccagaagtcggcatccaccaaataaagactaaaaacattgtatggtctctcctctaatgatccatgccaaatgagacatgagctaaaaaaaactctgctcaaaagagaatgaagcaaattttctcaagcatgatgaaaaaaaaagtatagtgatgttctctggaataaaagtgcaagcaggaggatcataaaaaaaatgagtcaccatcccattttcattttttccactctcccatttccacccataaatataggtgaccaagcttggtcatggttttatgattagttatcttcttacatcctctatttgactttacaatatatctgatgtaagtatgtcttttcttattccctatcctgatctccacataagccttattagaaatataggatgagaaaatgcaacatcaatgccttgatgagtgatttgagagaaattaattgagaagtatagtaaaagttatattgtaacgagcatcaaagaaaacccaaaggtaattcaccagaaggagtaaatgtgacttgattcgaggaccattccattcttcaatcactcaagatgacatgatagacgcatcaaggttcacagacaaaagtttgtcttggaatatttagtatgttatatcattaagcagaaagtcattactataatatattcatgagctttactcagggacgagtaaaggataagtgtgggggtgttgttgacggtcgttaagtgcaaactttaaccgtcaacttatgcataaaagagatcaaatatactatcgagacttagtggtaggagtttactactaaccacttccactagtgtatgattgagatgtcaactagagggggggtgaatatgcgatattaaaaataaatagcacctaattaaaactaacctaagttgctaggcttggtgaaggataagtctaacaaagcaactaggttatgttttgcaatcctggggtgataagggctcaagtatgtctctatgaatgtaaattgcacaaaagtaaatgcaataagtgaatgagacaagagacaaaggaaattttacttgaggttcggaaactcgctggtttctaatccccgttgaggcaaacccaacttcaccgctcaaaaccacgaagccaccacaagcccccttcgccaaggggtgggcaaggttggagccggcccacgagaagtggactatcaagcctcaatcactagggtagttcttccttcactccgaaggtggtgaactccaaatcacgcacaaaccggcactaggccttctgtacaatctccttggagaggtcaccaggcaatacctccacaagtcgtctatgagagggcaacctctaagagtaacaagtaacaacctagcttgaagatgatcaagtgccacgctagctctacaatgaagcaatgcacttgtcttggctcaatcaactctcaaacacaccaaatggatgaacacaagctcaagagagtgtatgcaaattaagcaagtgccatgagagtccccttgctactgatgggggagtatttatacccacatccacaaaaactggccattggggtcgaaatccccaacccctgttgcctgccggtcagaccaccatagggtggtcggtcagaccgccaattggtgtaacggctagaagccgttacggttcatttattgcataggcacaactagcacggtttgaccaccataggtcggccggtcagattggcctcggctctggcagctctagatcgccaagctaggggcatccaaccgactcaaaggaggcccggtcaaaccgagcctggcccggtctgaccagcatggggcctgcggtcagactagccatggtcaggggatgtatgagtaaaagtagttgaaccaagtgacaatgcaagaaatgttagttctctttctttgtcgagataattgacgatcgaaatcggtacttaatgacggtcaacattaatactcatcattttattcatattctttatatgcggttggttggtcaagtattagagatcattaacaggatcattgtaactaacaatttcattgagttaaataaaagatataggtccttagaaatggaaaaggtgctaatgctcaagtcacatcatgacacctaatgatcaagatgaatagtttgcttggtcaaaggatgaaaaaagttgaaatatgcaagcaaagatcaattgatgagaattactgtgaagatattgaagaggtggggtatgaagtagctatccatggaaagatattgaagggcaagaaatgattggtcgtcataggccatgtggtggtgaagggcaagcaatggcttggcaccaaggaccgaatctggaggtaaaggacaagtgaaggctttgtcgtgatgtattgtgcgaggccatttaaagctacaggtaaacatcatcaatcttttaaagaatacaaggtgaaatggttttggtgttaacatccctcaagacaaagaaagaaagaaatcatgaaggtattcctgttggtatagttttctttctatttgcgtttgagtataggattggcgtattattaagtgggatgcaatgtcgatgtgtttgtttatgtctcagtgctcaaagtttcatatccaagtgctacattgagagaaaacccaaacttaaccaatcctttgagtggttttagacattggttttaactgggttgggtacccctctaggtaagctttttatagagtccaagatcataaacaatgaacttccgggtgcaagaagctatggttatttcaaagattatagaggatttggatttttccctttaattactaacaaattatggatttcgagccctgctctacaccctctacataatcttgtagattaaatattattttaatatccataggaacaatgataatccatgttttacactgttagagatataattgattaaaagtactttcaatctttt

SEQ ID NO: 30305 - DNA, 6172 bp, Oryza sativa
atccaattaaatatccgataagatatctaaaaattttcttttctccaactaaactgggcacaagtagtcagataatagcatagccgtcacaaaattatgtaaaccctagctggctgtccgtccttccccctccacagcgtcagtggcggctcaccgcaattctgtccccaatccagtgtcatttgactcatttcctcttcctgccctcggggagtacgtgaggacctaaaagtacctcgcccccaaaccctagaaccccacaccacacccaattcgcccacccaaaccctagtcctcccgatgctgtgatccgccgcgcgtgccccatggctctagacggccccgcggagcgacgggacgaggcccaggccgcgatgggtaatggcaacggcgtggccccgccgccgttgcggccggccggccggccctccggggcgccggcgtgcgcagatcggcggctgcggttgaaccccaacatggagcacaagccgcaggactacagcgacgtccgcggcgagtacgcaccagctgtatacagtgcacttgagaggcacctcccacccagtgtccttgatgccaaccgggaaatcaagctgcagctcatgcgagaggtcctcgggcactattggccccatggtgagcgcaacaaggtgaggttgtggatcttgttagatagaaatatatatgggccttgcgtgtttttttaagtgtttgctgtggcccttttgtcgatagaattttgttttgtttttttttttttactacggactctgaaattagagattcagaatgggcgatggtgaagaaagtaactgctgagttgtatgcccattaggtggaataatgtggttcttgtgccagcaacttctggcaggcaggtgttgtggctggagaagggtacgaggtgcagccacaaatgctggactaaatccaataaccaaaagatttgtctgttcattttgcataagacaagctgtagccagcccagacaataccagacaattgctgtgaaaaatttgatctggatttggcatacctgctgttaatatgtgccaatgccccaatctagtacaccctttctaggtataactggatgcatgtgatgatggaagatcctatttaagaatgcatgcaattttgtaacttatattagatgaacataagggactaattaaccatgggcaagtttggtttgatgcgaaatattgccctaccctttatttggtagcttcaaactcttgctagctatttggattggatccccccctcccccgaaaaaaaaaatcttgccaaatcaatataattgatacaactttaccctaccaaaaatttggtagtgccaaagcttgcccaaaggtttggcattaccaatggtttggtagagtagagaaccaaactcaccctaaatacatacacaatttgggttagagacaaaatattgtgataatcacttcctttctaaataattgtctctatgggttaatcactaggcttttccttacctaatcgtcacttggtccaccttaaaggtgtcataatatccttctgtttgcctttatctgctagttatgccatggcactttccttgatcaacctgtgcttatgaaaaatgtttggtggaagcctatctcttgcttgatctgcttgattgatacaacattatggattggctgtttctaggacatcctaaaattagtcttgttcaatacttatattatgacgccatcgatccgaactaatctatcttgaactgcaatttggatctatgcagtactgtactaattgaacttcattctataaaggattctaaaaaatcatattgtttatctgtagcttaagagttctttttccttgtagcatggcaaattgcatgatatatcttggttgtcttggaattcgaaatttgattttagttttggtgattgagaaaaaaaaagagtaaattcgactggcagtatataaacttttaagatttggtgcaaaacaaggccaaaatgaccacatgggcaaatctggctgacttgacaaggattccatctagctgagcagtggaccctggagttttcaggagccaaatcaaagtcttcatgcacataaatacaattagggtccttattcatgaaaagtgaagtacaaataggtcaaatagtcttacataacacaaacaaacgtttagtcatttcgggctttttttcatggcatataaatgcttgattacatcccgagaaagatgatcatatattcagaggaagtgaaaaggtgaaagaccacctggtcatctggtgttgcctgttgccaccttcagttgctggttgcgtgctacccagggatgctacgcttgcaggccatgagttgcagccctgtcaggcatcgtcgccagtactccatgctcagggggttggggctcagctgttcaggggccattctgcaagggagtgctattggctttgctagactctaactcactggcagttccacttcacacgcgcctccaacggaaaccctcaagatgttgaaaggctttgttgcatgtgcactcccgcattgacgcaagcacacgcatggtcttccggtgggtgactgcacctaggcttcttgggctttggtttactacatcctttttcctttttgcaaatttgttgggtatgccagtgtccacgtagcatcccatgggtccgcccctgtagatgaggtgtacttcattggttagttgttccttgatattgctgtagaaacgaaagcatgctatgttatggagcttcttgtgttgttccggctaacttgtaatcgaagaatgggattgaagataaggatgtgaatcttatcccgtgtaaatagatggtacgtacccggataaggtgggatccggatacctctcaatagccagttccctgtgtctatataaagggaaccgggaaccctaaagcaggtgatcactacacgctactcctaatgtcgtattgcgaacccctacacagatctaatccacataagtggactaaggtattacctctccctaagggcctgaaccagtatccctgtgtcaccatccctccatgatcttttgcaccccataaatattattgctaatccgtagaattgacaaggtgagtcaacgtggctgaacccataccaggatagctcacaacacaaaccatcacttggttgtcatccttgttaacaccaaggcaaccagatttgccttcttggattgtgtttgtcttggttcgcacctatgagtctatcatattttgctagttattgcactaatgtgtatcctccattcaagtttgtttaccacaagtgcaatcatatttgttaaaatataaagtgtatttggtatgaagcatataatttatgcaaattttgaggtaataggagcaaagttgcagaaagaaaagatagccatttaaattctgctgatattacttgcatttgcaagactagaatggattggtatcacgggaaacggatgcaaaaattaagcaatgcttaacatcaatatatattttattgtttacaataaactttgatgttatgcctagtggtaggactttttagtataagtttatgatgttcaaagaagctgttactgcataccacagagatcaggtcaaaatatttgtggctgcttcagatatttgtaattgcatattaatttcatgtattaaatttaattcgtcatgagatgctataccttagttttgcaacgacgagggagtttgagctggaacatgtcaaaagaaaacacatgtagtggtttaatttttccttaagtagtatgagtgaacaaagaagggtcacctcgaattattttttgcatttccagagtttcaaccttcccattttctgcagctgtaagattagttctgttgagattgtcatatgaagtgttcttttattgcaggttcaaaggcacagagaatacagacagagaatactcaaccattataaggttagcgtttcagcatagctgacattattcgaattatctctaaatattttgaaatgggggaatatgcatgttttttcttgtgcataactatatttgcacatagaaatatgcagtccaggaattcaggaattatatcatatattgtatgatttgttatttcttttgagcgttaagcagggtgtgatatgagatgtttatggaacaattgtattggtcctgtacgaccagccatatgtgatttcccaggtgattgcatgagcaaaatctttgttcttgaagagtgcagctggttcctggtacaaaagggcacaattggttggacaagaggtccgtgaagagtgtagggtggtaggatactggaagatcatagataaaagaattacaatccaggcatccagtatgcgctagtaattcaatatttacaactgtttgaatcaagtatgcatgactgtgacagagcactacaggtaccatgaataatttagttatggagagccttccgagatttggttatccaatcagcatttcctgtgttggttgccttgtgtgcatgatcttagaaagctgcttatggaatatttatcttattatgtcaaacgaatttggaattaaatttctatgtttacatggcaaaatataaaaaaatatacttcttttattaaatgaagtatacttcttttttattaaaaaatatacttctttctatgtcgatatggcaaaataaatttctatggcatgagcggtaatgaatccccagacaggagaattaaatgaattgtgagctgacgtgggtttcagtcaacaatatgtgggttccttgatttcactaacagctagagctcaagcaagtggaaatatcaatgaaactaaatggcaccatgtgtttgttacagttcattcatgtgtacactacagttgtagtgtatggactggaagtcatcaatcttattgagaaattgaaactaaatctatttgttttttgtgctagtaataataacttatattttttttattttcctgacagccacttcataaagagctatacaaaatgcgcccttcatcgttctttttaccaacattccttgaagctattaggaccaatacagaagaaagctttagaagcattatgactgagccagttcctggtgtttattcatttgctatgttacagcctaatttttgtgagatgctattacaggaggtatggtagcatataacatacaattttgatattgctatatcatgttttgttacaaacttacaatgataaaacaatgttttacaccttgtaggtagagaacttcgaaaaatgggtccacacaatgaaatttaagataatgaggccaaatacaatgaacaagtatggtgctgtccttgatgattttggcctggaagttatgctgaaccaattcatggaacagttcatagctccaatgtctacaggttatcttatcgactgctatccttgttaaatagaggcagaatcactagcattttcaaaatatatttcctatattgattttatgctgtgttaatcttcagtattatatcctgaggttggtggaggaacattagatacacaccatgcttttgttgttgagtatgggaaagacagggatgttgaactcggtaagttaccattataaatttataatattgttttatacttaatagcctgtaaaatcatatgaagtaaaagaattgttcttgattgatcatgtctgcattcagctattccatgtaactatggatactatttgtattgttgttcctccctgttgagaaatcaatcacatatcagtttttgagccaatggtttggcctttcctacttaaaatggcaatatgttgaaactagtttcaatgactagatgataaatcaatatgaccaactttcactgtcaggaacttgtggaactgctatcaaaggtagaggtcacatcttctctatctagtctggagtctggaatttctcttctctctctgtctactatattttggacagagggagtatcttattgtgcactatgcgcttagatatatttgtactactatcacctaggggtgttcatcgacaggaaagattagctatcatgatgaaaaatgaatgctatgctgtctcttaatgaagtagaacaaagaccggggctgatagaatggcatgataaaaccgttttctttctcagtttttttttttgaggagggggggggggcagta

SEQ ID NO: 30306 - DNA, 15985 bp, Oryza sativa
tatcatgttaccagaaactttaaggtccttgcctattagtcttaaattcttttcagagccaatccaccttcccaggttgttcctgcatcgcacatcgcacacattactagaatttctggatgttaagatggtttcacgcttttatttacttcttttatccaggtagttaaatatgaaacattaaaagcatgtcagaaaacttcattctattcgcgtgaaattttgatatggtatatttgtcactgttctaaaacaatacctacaaggccacacacaaggaatgggtgcgcaaccttgtaatgcttaagccgcattagagttccataaagaaatgttcttttgtaattaacagagttccataatttcattaattttcttagttgcacttttttttaagtatatcgatttgccttagttcctaatgatacttttgccatttttcattctcagtttttgttcaaacatttcttttctgttctaaaccgtttctcaacattataggtttccacgttgacgattctgaggttacattgaatgtttgccttggcaagcaattctctggtggtgagttatactttcgtggcatccgttgtgagaatcatgtgaattcagagacacagcatgaggtagatgaacttttatgttttagttgcatttaatatctatttttaaatttcaaacccacctcttttcttctcttctgtgagtgcatttatgtggtgttgaaacttattttgttcagattttttttttgcatgaaacttgtcatttacttgcaacatattctggttaatttgttcacggaagttacacaatacataattgaagatatatatttttttacccttttcaatttcattactcatgttgcaggaaatgttcgattactctcatgttcctggacgagctgtgctccatcgtggtcgtcataggcatggtgcccgaccgacatcatctgggctcagaatcaatcttcttttgtggtgcagaaggtatacaagtcttacagatcttcccatacaattttgattgtcaaagatttcagtgaccttttgtcttgcttgtttaaagcacatactgggcatgtattatagctaccgtttatgcggacatttgaggtttagttcagtgaaatattatgaccatatatatgtatgcatttttttccttaacttatcatgttttattggtgcttgtttcacggaaagttgtgttggtattgcgtagttcatgtcaagggtaagaaacctgaaactacaaaatacacctgatcaaaggcctctcatgagtgctgtggaatcaaggtagttagtggaatctttactgatttaagattttgctgttacagcttgcaaaagttacggagtcctattgttttgaagggattagctatttccaacatggttgtagtctcaacgaagacattcctcatagtcaaatgttgacaatagttcctggaaatcaatttgtagattgattactgataagacagctcaagcgagtctagcctgagatataaaaccacactagccaataaaaaaggtagccaaacaaaactagggagttttcatccaggcgaacaagtagaaagagcttacttggtagtggggagctctttctgcattatctgttttagcagctcttatttctattgagtgctcaactagctcttaaacattaaaaaggatacttatccagaaaggtcagttgccccttacttttactgacagaacataacaaccactgatgattttattttattttagtatttttcaccaaataatactaaagataatgttcttcacctagcataacttcctcatgaaacttttaacttaatactccatctggttgcaaaaacatgtttcggacatctctcaattcaaactttgaaaattttaaacatcaatatcattttaattatttaaaaaggatgcaggcaaaccatatgtatatattttgttgggctttacagatgtcttagttgtagaagttgtattatgaagatcatgttggtgtccaacatgacattttttttatggtagaggtaattattagatttgtagtgtacgtaactctataatagatagtgtaatgttgatttctttagattgtatcacctgtgcactatcatataatgatgatgctaaaaaggttcagattcgcacgcaaatctgttttgtggttaatgatgaagtgatggaaatttggtaaaccataatagacatacgagcatacgactatatgagctgttgtattgtatcattagatcaaaattccaacttatggtatgctttggtgaagtatcaatattttatttctgttcctttttgttttattagaaccgtacttgttctttagcagtgatttgaataaaattgcacacggatgttttttattaggactaagattagataagacatatggggtagtttgaatggagaaaggtggagcaatgttatgttgtttgaataagatgcagccaggcgcaatagtaaaatttcaggaacaaaacaagatgcaaacataggaaaggtttaagaggtcaacataagttgttccatgaaaaacttctctttaacaatgtatcatctccctagctatgtatctgtacgtatgctactttctgtgcaatttagggagggattttagaaagattttgcttccattgacaaatccaaaaactgaacatatatatggaactccataaggttgagttcaaatttgatttttctgtaaacaagatagacatacattttcttctgatgtatgagattccactgtctgtccatcatactgaaagagcctagtgcttaccactcggatagcttaaggttagtaaatcaacgaaacattaatggaactagaagtttgagacaacaaagcattagtgcaaaattacaaatattttgagataatggtcatgattacagatttaagatgctctattgcatatcttaatttgtaacaagtttggtgctaaatatgtagatctgtgatacttcgtgttgaatctgtagttatgtcaaaatatatgtggttttgctaaatttatctttatatttatgtcattcaaatgcaatcccaaaggttattctttctcttgacatccgcaaagagaacttgttactggttactggctactggctactggctactgaaaagattatctttcttgtggctactggctactagcaagctaacttgcagctaaaattaatagttcctgtgcacagctctgtgttcagggagatgaagaaatatcagaaggacttttcggactggtgtggtgaatgtaaacgtgagaagaaggagaggcagattcatgctgttaaagcaactaagctggtaaattatcatttctccaaaacctgtacagtacatgtcgctgttaactccatgttcaattcttagatgccttttgtttggtttactggttttttgtttgatcaggcgtttcttaggggtgctggaggggcaacgatttaaattatatctgctttatgtatttatacaatcttgtattatattatactttactgtcatttgggaagcagctagtgtgatcttcagtttttctggtcacaatcattagtggtcacaggtgtatgtaaattgaacttgtgatcaaatcaagctgtaacttagtggaggatcgcatgttagtgtgaaaggagtgctagcagaatagcaactccccccttcaatatcgtctaagcctgatattgtacagataagtgcatctgcatagaatgttctaatctgtcatcaaatttgggtgatgcaaccttttatgcacctgttgccttgttgcttcatttagagcaagtctaactataagcttatatgtgaataagagagaacaagaaaaatgaagtgttaggtctcgagatatgctacaagctaaatgcattagttacataagtgagagaaagaggaaaattagagacaactttattagagacaactttatagctatctagattcattaatatcaatatgaatgtggaaaatgctaaaatgacttacattgtgaaactcaatatgaatgtaggaaatgttagaatgacttacattgtgaaacggagaaagtatatgttagctttaatactacttagttagctctaatattaaacaaacttgctcttagtgatgttctcacagaaacgagagattcgcttaattgtattttttccgaggaggcatttgtggtaaattgtgtttgcctctttacgctcccttctgtaccaatgcttttctagaaattttctattcttgcttttgtattttaacataatagaaaaaatgtattcattcctattttctaacattttcatatttgttctgactatttgcttgctcgagaattgtatacagatactcttgaatcaaacgacatgcctaattgagctccagattgtttaaatagagtaattagaggttatcgtttgcacaagatagtgtctgttgggtgaaacgcacgagcaactatggatttttgcaacaaatacggagatagagaaaaaagagatgtccattcacgtgggcctcactacttttagtttttttttactagtgcgccccactgttcccaaaccgttgccaaaattgctggtgggggtcgtgtgctcgatacctgattttaaagtctaagggtgtattttatatagagtgaaaagttgagggggttaaatgaacttatcactactagaaatgtcttcttttatgccagtttaacttgggaacatatcctatgcgcataagcttcccgtgcacactaagggcctgtttggcacaactctagctttagctccacccctcctggagctggagtttagccaaacagtttcagctccaccaaaactgatagtagagctgggtggagctctctcacaaaatgaactagagttatggagctggatataggtagctccacaactccactccagacccaacttctgaagctaaatttaggagttgaaactataacaaacagaccctaactagcaaatgccataaaaaattctacacaaaattgaacatttactcctattagtattacacatatctaaaagtcttatatttaaattcattatattttagccgtaacaaaaaagtaaaaaatctgacagttttaagggtaaaagtctgtcagaattttgtcttttttattatggctaaaatataatgaatttgaagataaaatttcacatgtaattgtaatactattcgaaatatgtatacaattttttgtagaatttttcgtgacatttgctagttggtgtgtacggagtgtgcatgggaagtttgtgtgtaaaggatatgttcctgtataatttaaacaaacacttggtgagctaatttgggtgattaccggatttgattgacaaaacataactaactggagagggcttaacatcaactgtcatggttagtaacgtcaaaaggacacaaacagctagtttctttcaaacatgcctattttgaacaaagaatttgtggaagaattctatagggattttgaacaagaacaggttgccacggattcgatatgttttgtgaaacacgataagcgcacgggtcaagcctgaaatagatttaactcgtgatggtttgaatgagtgaaataaaagcaggttttagtaaaataagtttaattcaatttttccaaaaaacaaaaccagttctagcttattactctctctgtcctaaattataaagcctgtattttttaatacacggtattcaatgacatattttgattattaatttatttcatattatattattaataactgtaaaaataatatcacataaaaatattttaaaatacgaatctactaatataacatacgtaatattgatattattgtaattaagcgttaaaagttgtacggaaggagtatcgtgttattttagatctcactttttggctgggtggtttaagtgcgcgcatagcataatgaaaccagcttttgtagaaactctggtgtctttgtgataaaaacgcgatttccagtttagagcaaatttgctttcctatccagaagattggtacaataatcaaataataatttatctaaaacaagattaagtgaactataattaacagcacgtgagatctaaacaaccccgtcgagaatcataaaactataaaagcatttacaattttttgcagcctcataatgtttttcgactatatcattcataagacagcatgggtttaaattaatttgatcttttattaattcattcataagatagcaaagcaagtttgaattaccatatggttaccatgtactggcaacatgaaattatacttactacctacgtccgttttaagcatagccatgagtttatgtgtctaactttgatcattcgttttatttaattttttttatgattagtatttttattgttattagaagagaaaatatgaatagtattttatgcgtgacttatgttttttaatgttttcaaaaaaaaataaatatgacgaacaatcaaagttgaacatagaaactcatggttgtgtttaaaatgggacgaatggagtatttagttactgcccttcatatggttgtgtttaaaatgggacgaatggagtatttagttactgcccttcatgtgcaactgaatttaccagtaaaggttattttactagtactgtttagaacatgatgacaattagttcatttgaagacttatttaccttaatttgaggatcatttgttggaactacgcgtggctctgtttattactctatttcgcattataaaacgcgttgggctctcatctcgtttagatttattaacatccaatataaattagatagatatatgaaatatgaatctattcaaaacctaaaatgtcttatactgtgaaacacaacaacgaaacaaaggaagtagattttcttcatgttttatctttaggcgtgtaatgctaacattttaccttttctttttaatttaaacaatgcagataaatggggcgtacccagtgaactctctctttcctagtcagtgagcttatgtgttctccccttctttcattcatgtcatgattctgtgtaaatggatttcagcttgtagcagaattttacaggtatttcactcaaacaagtttacacgcaacgctagtacttggaatttgtttttctttaatggtagctaggatagtaatccgtttgtaatactccctctgtaccatatttctagctatgaatatggattcatagctaaaagttgttgtattttaggacagaatagtaatattcagaaattgcaaaaaccgcacaaggtatgaatgtttcttatattgtttaatctttagtaggtatgcaggctctctgtggagtgaatatgttggatatatttgaattcccttccatgttctaattgcactttggtttttctttgtttggcaggtgttcaatctcactactgctcactaaactgcatggaaaatgattaagccaccaactaaattacattctctatagtctaacaatgggaagaactattagcttttgttcgtgggtttaccatggatatatatatttggatgagttttggctgcacaaatggcaacattctacctgattgttattgtttattgtgaaataaaagataaataagcaataaagatagtgatttattgtttttcaatgggccttgaaaactgtgagggtctcacagtggggcagccatttcagccttgaccattctgtctactttgggcctttttggcaaatgggttagacaaatgattttcctagccatccattatccatcctcatttcattgtaaacctttacccattttcctatcccgatcttactcttcttatcccatatctaaacaaacccttcaagtcaagggttccttaagcatgacacatagggcatgaacgctttccccttagcttgtcggcccatgtgctttctccccccacacgcatagcaattttattaaaagatttcttaattttcattaaatcttatagaaagagatataatttcttctttttttagggattttagggaaaatgaggctcttgtcattttttattctattactgaacataatgggaagacagggttggttattcttcgtctacgaatatccaaattttaactcctaatactccatagatagttcgaattgaatagcagcaataatcaattttagcacgaattgtttggaggggaagtctaccttttttgatgcattcggcacgcgcaatttcttttcccgcgagacggcctgcaatttttacttttactccctttatatccatttttttagttaattcaatgccttttttcattgcctttcggaatgaaactctatttttttaattggaaagctatatattctacaagaatgataggttgtctataagattctttcactttttcgatcccaatattaagtctctggtttacagaattaacttcaaattttagaacaatttattggcacacaacagatttcttgaatagtaatggtattttttttaaatcaacatatttgtaatggcatagatccaattaacccttgattctaacagggtctacccctagtcggtaggggtggtcattcggtctaaatgaaaatttcggtctcggtcttcggtctttcagtcttttcggtctttgaaaagtaaagaccgaatttcagcacaaaaaatgttaggaccgacaaattcggtcaaggtcttttcggtctcggtctcggtcttgatcgaaattcaacaacattttcatatatgcaaagaaataatagaaattttcaacaaaaaaatcacaaaaaaattcgtaagcacttatgagtaaaaactcttattaggttgcatgcatagaagaagtagggatgtgaaaataagagtttaatcctattaaacatagtggattgtagattgcatttagacttttttttttggataattcggtctttttgattcggttaaccgaggagactaaccgaattgatcgaacaaaattcggtctatcactaccgaggaccgaattgatgaccgaatttctcggtctcggtctcggtcttttcggttcggtctttttctgcccacctctactagtcggtttggttttgtgtaacatcccgggttttatctatagtcttagttgtcctaatgacttggtcacactagctgatagcggtgttgatcgaaccatgatgctaactaggacttattaatgtattgaattgtagtttctgttttggatttcttggcttatttatgttggtatttcttatgttcacagataaatccgcaaattcacggataccactatagtacttccccttagagtattccaatggtatcgaacaaaattcaatccaaggacaacaactgatgatagattgggtagagataattcctctatcttttaattagctacttaaattaaaggtaaaactctatcgaatgcttcgggcaccggtcctcccctggtctgccaggctgagtccggtcttgagctctatgatgtacccaaacattgagggatacaagggatggacaaggctgtcaccacttgcattctacctcactttccgtggagcacacaacaaacaaagaaaatttctaacctagacaccacacctatgttattaattactactctaaccttgcgcaataacttccttctttatctaaagtcctagtactagaacatagtttcacactaagcgatgaaccaacatcgatgagaatatatctcacttaaataaactaactaaagaacataaagaaactcgaatacttaccttatagaaggaagcatccgctgaaatacaattgagagaagaaggccaacagtaccggctttctccagaactccatttgaagaatgccgactttctccggaattcaatttgaagaatgccgacagtccggcactcctccataaaattctcggaggtactccaacagccaacatactaaagtaatgtctaaaagtgagttgcactctattttgttgtgcaagttgaagtgtgtatgaactccttttatagtgtgccaatgacaatcggaactattggaagggcggttattgtgaacaacggaattttgcatcaagatcgaagaataataaaacctagatttatcaaatatataatttccagatgtaggtcaatttacttaaatatttaattgaaacttattattactcgcaaagtagataaactaatattggctatgatagtttaaatcgtaatcattagcaatctaaatttattaatcacaatctagatagatcggacctaactaagacattgtagggaaagtaatgaaggcagcagcttgacctattctgacaaaatctatgtattagccgatacagtagattaaattatgataagcaaataacttatcagctaaaactccgataaaactatattgaatacctatcagtttgagtaaatatagttaatatgttataacctagaagattggactcaaccaagatggttctagattaataacaagtttagtatatttaaacgggtcgatcgatacttttgatagtgtttgatataaaaaccctgactatgattgcaaaaacgatcaaacaaagagtcgaaccttaactagtatgccggacttaactgagaaagtactaattccgctgttacaagcaaagttgacaaaaacttactttcttgccagagattgaaaccgatgcagcctaaactcgaaacaagaactcgtcgaaagtaaaactagggttggtgatgcatcgaaatttgtatattgaactgttgttttacaaagaccctgggtgtacatatttataccaataggctatagaaagtccgactccactacaatcggatcgactcaggactgtacctctaagcaaggaaaatactattacaactccgactcaaacacgactctgatcggttaacctaaaagataaatcttctaagtctgattctaacacgactccatcagcccagaaatctatctataaaaatagaaacttaaaaaccttccttatcacggaagtaatttacaaaaacccagataaacttgccaaccaaatcaactaaaatcatggcgtgaattccatctttgactcggccttaactaacaataattgccaaattttgccgtttacatctgcgaattgttagtataaagagtgaattgcactttatggcaggttttattacccaagttgcaaattggagcagcaatcagcagatcttttcacctttgactaggttttattaccaaacttggcatttttaatcagtggcccatacgtcagcatcaaatagtgttcttcctctcctctcctccctaatcacggccagctacttgtggttgatgaggaagccgagatgagagcggactcaacggatgaaggagatgagaaggatatacgcacaaaaaaaatgttcaagaatgcaggcctccactagtatgccgctgtccatgtattgctgctcgagctcgatttccgttggtgccgtatgcgctctgcttgacctacacattctgccatgccctgcgtatcgtggagcattggagcaagcatagttgatgctttggtgaactggaccggtgaatgcccccaatttgtggaggctatagcgagcgcctactgctcatcgccaaggagcatctcctctgagccatgccctctacctgacgtgaagctcgaggatctcccattttcccagttcccaaaatcaacgtaagaagcgagcacctagctagcagatcattgattggtagtagttgaatcctgcattcctgctcatgctgatatgatgcactgaggatttgaggagccgcatgctgctgccttcatgagctcaccaagtttcctatatggtagagaagaaagtgatgagagagctggagagggaagtggtacaaagtgactcattttacaaacttatctagtccaaagtgaaaatattttcttctccctagtccaagatgcaaccttggtaaacataagtggcccattgtgcaattaactctagtataaattatgacttaggctatgaaaagtgtaagaacaaagcaagaaaagaagataaaactcataaattgttattgttttatttcatcaactatgtttagtattttgtcaataatttgcacaaggcccccgaattcgatgggacaaccctgtagtaaatattgaggtttcaactattgaaacataaaaaagggttgtaagatcaaaagttaaaaatataaaaaatagtcaaatcccaattaaaacattcttgtaacactcatttaacattaaattttaattattgaaacataaaattaacagtaccattccccacctcttgccatagattccatgcttggaaaggatgtgggagagtgtttgcaggctacctcagttttgccactcctgagcacccaccagagtccaattccctccaacctataaaaatttcttggaagcagctatttttttttaataataaaagcttttatacaaggagaaattgcaaatataccactactttcaccctctaactcaaaatagccattaaaaacacgaactgtaaatttgccactggttttggtttaggttgatgcagtttgccactatcgtttgatttagtgcaaataagcagatgaagataattcataaaaaagaaaaaaacatgataagaccgttttgcccttagccagtgttaatcctcactgcccatctctttcgatcagtgctcttcactccaccgtgaagaatcagctcctctctctctaatcccaaatcccctcgtcactttcccctcatcaagagcaaatcaaccaaaaaatgggtcacactggaataggagatgacaatggaggagctcagccgtggggcagtagcggcggtggctggggatggcagcggtaggggtagcaacagcatcatgcggctggggcagtggcggcggtggctggggaacagcggcggcaagggggtggcagcagcatcaggctgcaggggcggcggcggcaagggagtagcagctgccgacggcgaccagcagcagcagcaacacgcgccaggagctgcaaggaaacagcaggagcaccatggaacggtagatactccaccgatctactagaacattcatcaattttcttcttatgttgtaggaatcaatggtccggcttcttgacaattatggttagagttgaatctcatttggccacatcatttttggaggacaaaccaatatgtaagctttttatggcaaatatgatgtcaatcttgcaatttcggggtaggggtatccttgtcctaatttttctgaaaaccaaccttctaacggtgttagtctaatctgtcaatccagtggcaaatatgataggttctaaccgtttttgatggcaaatatgcaattacatcttctataatggtaaattcacaataccggttcaaaccagtggcaaatatgcaattggccctttatacaacccagtcgactacaacaagatcatacaacagttttgagaacactcctagcctttgcacaactaggatgcacataaccaaaacatacaccaaccaatttcgaagaaaacaagtacaagaagcattaaggaccatcaattctagaactagatcgtcacccatgtccctaggtaaaacacacccttatcacatgctccaagcgtagacacgccacaataaccatatcctgtgatgacctgcataggcgaaggaataacttttttgtagaaaccatatgacgtgtttaattgcctccttaatgtgacgaaaacaaaaaatttgattgccttgccaattacgtttagatatattgttcttagttaacacaactccacaacaaagataccgaaggaaaatctttaccttcagaggcacttttagtttccagatgcgtctatttatacctgggatgtcattatggagtagtgcaagggaatgatacttcacaatgaactgtctataagaagtcaagttctatcgaaactcatcttgctcatgaattagatgaatatcggtaatacggtaataagttagtccatgctactaatttgatctaattagatcccttcttcaagaaaaaaaatggaatatccattcgatatgacatctgcaacagtcgcctatttatgcctagcattatttgtagggacactgatactattttcatagaattatattttccaaccatttatcttcctgtaacctaatttaagagccatccttaattacgaaggattcaaaatgaaaagacatccctttccaccttcactaggctaaccaaaaaatgtgagtcccctgcttttcattgaacttgcaagcgggttgtgaacataaatacctattccatattaattagccattaccaaacaccttatgcactaagaaacctgaatagctactcccttagtaggctatgtttttaatatccagatcatgaattcctaaaccctcttagtcaataggcccgcacaatatgtcccatttgacaagaagatatttctttttatgaccgtcacttcgccaataagacatagatcgaaaatagtcaggctttttttaatccagacaagagaacgtactggttatgaagtcccataaagccttttatccataggcatgggcttgctctacacaatctgatacaacctaaaaggaaatgcattgtaggaagggtgaatagctaatttaatccctcaagtttcaccgaaggctcaatttggtccttcaggtttcattttgtccacatagttcctctaaatatttgttttggcctaaaatcatccttgggcccacttaatatgccatatggctatttttagtcaacaattatgttagaaaatgtcccttttgcccttaattgtatacagctatagactagaaaaaaaaaaccaaaatgaacaaacaacattacatatgtacttcccattatttcaacatgtgcacatgaaaattaagcctaatggctattgtatacacttggaagtacataatttattttatctataaaaagaattcattgcatacaatttttttcatatatatgtgaatggggggcataagtgtcatttatcaggaaagttgttggttatgtgtgttcaaggataacactacaataatctatttaatctatgatgaaaaaaattcgccatggatcactgaaaattcgtcacataaatttgtctgtgacgattctacttatcgtcatctattgagcgtcacagattaaatctgccgacgttttctccgaaatcgtcacggatcagcacaatctatgacatttttaactgtcataaaacgcttttgggctcatgtagttcagcccaggcccaacttttgtgacaaaattaaacgtcacagatggttgccacgtggcggccaacatggcaggtgacgtggtcattaacacgtgtgatgacgtgtcactgatgacgtggtagataacgtcagcaaatatttttaaacgacctattatttttttaatggcccattattttttttacaggccattaaatttttacattggtccattaattatttcatagtggcccattatttttttagaactggcccattttgttaaccaactattagatcaaagcccactaaacaggcccattaaatttgagcccaccaaattcaatccaatttctcataccatgtcacattcaaacctaataacagataccatagtggtttatcctaggtgagcttattacaattttgtaaaacattagattccccatggagggtagatatcaaccatccccatcctctaatgtgtgaattcaccacgggggatcggtgatcgggtccccattgccatctctaggtccacatggttttacagaaaaaggcagcaaaaagtttgcttcacatgatttttacagtaaactagccaagttctcgatctgggttgaacataaaataatataaatccctacttagatggtgtttgaatcttctgaagat

SEQ ID NO: 30307 - DNA, 1330 bp, Oryza sativa
ttttacactgttcggggcccgcctgcaacagggcgacgaggccggcccccttgccgcccttagggagggcggttttacactgttcgggggcccgcctgctaaagggcggcgaggacggcctggaattttgcaggcggccccccttgctgcccttagggagggcgatttttcactgtgctaggggacaagggcagccccaggtgtttagctctgtttatttagaaaatttagtaaatcatcacttaaaaaactgtgaaacaagaaaaacattattacaattgaatggtacgttgttttcgcagtttggagcccaacaaggggtatttttacatcaaaataattaattgttactttataaactacgtaaatcatcgtttcgaaataggaggaatagtttcaaattattcattacataaatctaactattttgcacttaaaattttacaaaataggtgttttacatagacctaattttgtagcacttaaaattaggtaaagtatagttttgaaacgaacaaagtacgtacatttttataaaatttcaataatttaatttttcatatagattggaggccaatgagggggtttgttacctataaattgtaagttacgtataattcttacgtatgttgaatcatgtacacaattgaaggtgaaagttataaaaatataagcagatatttataaattataaggatacaacgtatcgtggcgtcaaagaaactttggaaatcggaacgatagagcccattaatttgtaattcgtgacgcatataacaacacaccataataatgaaacattataatgacaagatagcatggataaaagatacaaatttgtcggtcctgacaaatcgagcctgagcttatctaccgaccccttctgcgctgttcaacatgtattgcattttgatgctccttctcccgttggtattctacctatgtttcagactcagttatcttttggccatcatatgttggattgacattgtcgatccataaagtgaatgtgcacctccttggattgccctaagaaataaacatagttagtcagatatgatagtaataataagcagatgctagttaaatttggaatttgttatacgtacaacgaaatcgtcgtctacattggggcagacaaagtatctcctaccaattgtttgttctgcaaacgaggtagccacctggcagcgatctctacaaccacactttggacactctgaccatttaggtaaacataatggattgttcctccagtctaagcttgcaatttgtacctgacattcgtcaatgagaccgcaccaatgtttcactgcctaaactctctcat

SEQ ID NO: 30308 - DNA, 859 bp, Oryza sativa
agcttcccacccgctccggctcggccggcgtccatggctagtctagctaagctggttcctgctgcgctcgaaggcgtggaggattgtttttctttttttttccttttcttgggtcgtcgaatgcgagtgcgcgatgtagacgaggccggtggggtggcgtatttaaacggttggggaaaggggagggtggtgggcccgtcgatccgtggcaggggagatggacggtcggatcgttggggggatgaactgatctctctgctgattagactctttacaaacaactgcattagctggagtacttaggccttaggccctgtttagtcccaaaatttttttccaaaaaacatcgcatcgaatcattgaacacatatatggagcattaaatatagataaaatgaaaaactaattgcatggttagaggagaaattgcgagacgaatcttttgagcctaattagtccataattagccataagtgttacagtaaccctcatgtactaatgacggattaattaggctcaaaagattcgtctcgcggttttcaggcaagttatgaaattagttttttcattcgtgtccaaaaaccccttcagacatccggtcaaacgttcgatgtaacacctaaaaaattttatttcgcgaactaaacaaggcctgaatgaaaaggacaatttgcctgcagaactgatgtacctaatttcaagatacaatgtgttgcattgcatgtttgtaatcttggcataactgcatggtgtggaacagaactaattttgattttttttattttgaatttttttattaaaatatttataaaactaattttgtgtttgaaaattttacaaaactagtcgcccgccgccc

SEQ ID NO: 30309 - DNA, 652 bp, Oryza sativa
  unsure (1)..(652): unsure at all n locations
nnnnnnnnnnnnnnnnnnnnnnnnnnnnnnnnnnnnnnnnnnnnnnnnnnnnnnnnnnnatttagctctagcttaattaaaacaatttcttcggacgatttaacttggaggcgtgacaccacccacccccctcgttgtgggcaccccaccaccaccacgtcggcatctacacctggacgagcagctccccatccccacgttgcacctgcgactgcaacacgatgcgctccagcatgctctgcagccgctccttcaccgttggctccacgcctacctcctgcggcgcctccttgatggtagcccaagtcaatatatactgtggtagtgtggttaactagcaaatgtcttgctagttaccatcaaggttgagccacgtgaaataccgttggctccatagctcctgttgagacatgttttctaagcagatgagggaggcggaacattaggagtttttctgaatgactccacactttgtagcaagacatcgcgctagggttaccatcaaggtcaggtattgaaaactttagtatttgaaaatgttgtttgaagttgtcataatttgaattttaaatttaaattattgaaacagagtcatatagtaaaatgaccaaaccaaaagttgtatatattgatgagttgtacaactttgttg

SEQ ID NO: 30310 - DNA, 7274 bp, Oryza sativa
tttttctttttattttgttgtaccattgtgaagtaacacaaaaaaatcgtattaaatgaacttatgtgaaaaggttgtcaaaaacaaagttgtataacttattgagatctaccaattttattttggttatttctccatatataatatttgaatttcaaattatgacaacttcaaacaacattttcaaatactaaatgatttcaactgaaaaagtcatcaacaacaaagttgtataaatcatcaatatgtacatcttttgttttgatcattttgctatatgactctgtttcaataatttgaatttcaatttcaaattttgacaacttcaaacaatattttcaaatcataaatgatttcaactgaaaaagtcatcaacaacaaaattgtataaattatcaatatctacaacttttgttttggtcattttgctatatgactctgtttcaataatttgaatttgaatttcaaattatgactacttcaaacaacattttcaaatactaaatgatttcaactgaaaaatttatcaacatcaatgatcatttcttcatccgataaagtgatagtagtatttttcacaaaatttacgtatttaatattatatttgtaaatcgcaacgaaatttctataacgccacagattttgagtcggtttatgatgaaattgataaactgttacggtattacgggccttgtatctatagttgcatatccgtgatgatctctgatcacaaaaatttcgtcacagattaaatagattcttgtagtgtaagtttgaattaaaataaaaacttgaagtagtaatatgggtacattgaaacattaaggattaaactgatccttgcatgaaacttgaaggaccactttagctattcacccttgtacgaatatcgatgctcatgcgatttgtatagggaatgattgaggaagagcaagtatcttgaacattaatgttacgacatctatgtgaataagggataaaactaagtgatgtcaatatgtggataaatgggctcatggcgggggccaccattggtgtagtgtcaaagcctacgaacacatgattatctgtaatgtattttcctaatccaccagtcacttcttgatggctagattacaacaagatatattgtgtagcattttataaccttatcttaatccacttcctcctcccatcgaaccaccactgccagtactcgctcccaacgcgtgcattggtcacccctctccaccgcctccagctgctttcccttccttcaatagctctggcaaattctgcatcctttcccccgccaccctcatccattcttgtggctccaatggtactgcctatgcctcactgccagtgttgagattatgggcatataatgatttaatttattccataaataagtcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaaaggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaattccgaatttgcagcaaaacaaaactgcaaaaagaggctgcatctgcgcaagggtgaggagccaattttttggaccattcgacgcgtacgtcgtgcacgcgcgccgcctgccctgcccaggtcaggccaggccaggccagcgaagcgaaggcgagcgagcgcgcgcgtgtgtttcccctcttctctccaccacacatgcttcaagtggctaggagggcatcctcccttttaagaaggtccccctctcctagaataagaaaggtggtactaaactccacatgcatgccatcccatgaggtgggcttttgtgattttccaaagaattaatcttcgagtgggctaagacccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatggactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttagagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaattattcactttgacaattaccgtttgattgtcacagttcataaggatagccggcaccggtttttcaacaacaggcagatccattaatagatcacgcaaccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcgacaagctaggatcataaggtgttggagaaggcttactatcaatgtagccaaagcgattcaagatcttctccacataatgagactgcaagagtgtaatcccattctcacctctaattagcttaatgtttaaaataacatcagctactcccaaatctttcatatcaaaattttgagacaagaatgatttaacctcatttatcacctcaatgtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaagtacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacctctgccttataaattttaaaatagtctagagcctcgtctttcgttttcaacaagtacacatagcaaaatctagtagcatcatcaatcaatgtcataaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcgacaaaaccagccatagtaaaatcacagtgcctataataaggtttttggattgttgagattatgggcatataatgatttaatttattccataaataagtcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctcttccgatcgctggtgcacgccggcgagcgggatggagtagtctacgagcgacggcgcagtacagagtaggaggcaaaccctagattgatt

SEQ ID NO: 30311 - DNA, 7086 bp, Oryza sativa
tgtaatatatcgcatcacaaacatacaagtttaaattcaacttatacaagttataacaaaaataataaatactctaactacaatattcatagtcaaatttgtgatttttcttcagaaaatcaaatttgaatttgcgtgtttgtggagtaatatattatatattaatctatcttgtcatcttttttaaaaaaatcataatcaattaattgacatataagaaatggatggagatccaccgagtgtttaattaaaagagtttcccgtcacctgaccgatagaaaagctgatatatgagtgatatcagtgatcatcagagtgtaagatcccctcatccagccacaatatccgtttcctacattattgagcattgtgccgcactgtaacaattcatctagagagtatttggcacacatgacggaccaattgactacctcaacatgtagcaatttgcgtggttagacttggtcaaaaccaacggggcatgggtacagaaaaaaggatattaccaatggtcccgatcagaccccttaacttagctgtctatagctagctagtctctttccaagactttcttcttcttttttcttttttttttgaggggctttccaagactttctgcattgcctagagtatgtactttctcttgttctttaatttgctcttcttttcaaaatatgatggagaacactagcacatagtttagtccgccagtgcttgactactccacaaatgtcttcaaatggtgccaccatctgctagtccaaattccctgtggaccttggtatttccgtcttagtgaatttgacgcttttgatgttcttgctcaatcgtactacgtacatattccatgccctgcttatcctacccggccggagtggaattatctactggaaatcactagaggtacaatgttggagttgtttcttaatcatggatagacgatgactcgatccacttgactacaaggattttaaatcctgctgctcacaatttcgtacacataagtgtgcttttagtagcacgatgaaggatttaccgcaagtttccgtccccttgagtaggtgttgataaaagcacactcatgaatgtaagcatgttagtatagtgtacgtcgccatgtaaggaaggaaaataatggaagttatctacaaattaaattattgtctcttctttagtcatctactccctcaatcctataatataatgtattttgacttttttcttgcactgtttggccattcgttttattaaaaaaatttagaattattatttattttatttgtgatttactttattatccaaagtactttaagcacaatttttcgttttttatatttgcacaaattatttgaataagacgagtgtgttaccgaccaaatttggtaaaaccatagatcggattcaaaaccgcattaacagagtggtcaaacagtgcaagcaaaaggttaaaatttcttatattatgggatggaggggatggagggagtagttacaatatgttgaaagcaactaacgatgacaacaaaaagatagattagtatgtgtgtgtatatatgatatatcgtcaaccttatcatatatacgaaatgaacacccccgtacgtcctaattgtgacgactagacgtacatgcatgatcatggccgatcaacattgccactgtcgttgcaccaccgccacagaagggttggaaaacatggaagacgtcgacttggaggagcagttggcgccaccgccgccgtcgccgctgccgtcgtcggcagagccgctccatgggctgtgtaggaagccaggagcaggcagtcaccgggcgctcgtcgccacgccggtgcgcgccctatggatggtggttctcatggtcggcctcctcttcaccgtgcacctgctggtgcacgacgtcaggacgttcgtgctcctcgtcgccgagtcgttctgcatcttcttcgtcatgtccggcgtggcggcgtgcgagagaaggcagcacgacgcctctgggggtgcctgccgcgggtttagcacggtggcagaggtggcgctgtggtcgttcgccatggcgctcacggtgacgatgacgttctgggtggcggctggcatgtctctgccggctgtggcagcactctacttgctttcgctgctagttgtctccgcgtgcttcgctgttcttcttggcgcttgattggttaggttgatccttgtgcatggcacctgctcaatttgatctgggagggatcgactttcatcaatattttgagttcattctagttttccatccctgtgctttgcttttgacgcgatagagtggagatggattctaatagctcgagtggatgtccatccgtttattgcatgtcaactacttaattacgaaaaattttcaaaaaaattgacaacatagattaatatgtagtatatcactctacaaacatgtaagttcaaattcagcttctacaagttgtaacaaaaataacaaatttaattgtaaatatacatatagtaatttgagttttgtttattatttttgttacaatttgtagaagttaaattttaacttgcatgtttgtgtattaatatattacatattgatctatcttgttcttctttttttcaatttttttcataccatttaaatgacatgcaataaatgggtagacgttcactcgagctgttaaacagtttcccgcgataaagttaattaaatgcatgaacaagttatatactgggagccggtggtctggttagatgtggtagcgctatgaacgaagcatataatagtcggcagggttaggtcggggtgagaggtcgactcgttaagataggaggtggtagatccagcagtacgtggctctaaagatgggaaggcaatgcactgtggggtgtctagccgggaaagaagaaagagcatatcagagaatgtgaagtgaaggaaggaaagggcatagaagcctgataagcctcgtcgacgtcaaagaggcactggaggagggacgaccctagtggtgagggaattgtgaatagaggggtgacaatttccacgttggggccatgtccccaaaggatatccgccccaatgcggccaggacaggcggaggtttctacccacgggtgagtggggacagggcagcatttcacctgtggccattgggaaatcctatgaggccacaaaatttaaatcacatgaaaatgacccattacaaacaagccaattagagccaatataacgaagggctagactaaccttgtctcaatccatccatccagccaccactgttgtggccccaaactacgcagcatcaggtgtcagcgttccctccccatctcgcttaagcttctttgtcttgcaactcattttcgagcatatgtcacaccacgtcggcatgccggcaagccgctaggtgccagaatggtgttccgccgaccgcatgtctccattttgtagctcgccgctggctgttcccacctccccacgctctctctcctctccctccggctgccggaagctaccgctcgctcgggggtgcagggacccagaagggacggggcagagattgatttcgctccattcttcacttcaagaccagggccaggggcattcttatccaacccgcctccacccccgccctattgccatccctaatcgggaaggaatgaagcgtcgacagcggcgtaagaattctttccataaaaagatctactatgttcctattgagcgttaagaggtaacgctttatataaaacggacggctgattctatagcactggacattcacgagttcagatatgcaacatgaaaaattttgaacttcaatagtattgaaaacttatttcgttcctctatttagtgttccgtcaataacatagcatttcgacaataacgccgttacccttcccagcttacccatctttcttcttcctctcctctctcttccaagtgcacatgcaacagctagcttcttccaataataatcttaatccttcagtagcactaacttcaagaatttctagagacaggaaaacccagaaacaaaacttagatgtttggggctgtcccaagcagggcgtaaataagtaaaatgtgttgatgtagacttggagcaaattgtacactgcagggttaagatatttgtttcatttctattaagaaatggaatccagctttgccctttaatttgatttcaaaaaactgcatggttattagactatgccaattgatttctttctcatagtgctcaaataaatagaaaagcaaatcctgcagaatctaataatataaatcatcactctttgctagagcagcgtgcgcatgcttccaaagcaaatgggcctatcgctattgaagttgatattttccatttcaaccacaaacgtgagaaatttgattatggatttcttctttggtgttaaggcaaaccatcacccattggcagagcaacgagggtatccatcaaaatccaagatattgctccaaaagttcagctgcaatgatataatgaatttgtagaacgcatgcaccaaatgaaactaaattcatgtagtcattcttaaatttaacaagtcgagtgaccgtgaacactaaattcatgtagtcattcttaaatttaacaagtcgagtgaccgtgaacacttccttgatccgatggagtcacctgctaaagctcttcttattatgctattgaagtgtttaggtggaaggatggtgtcggagggatgagccccggtagatgtggggaaccatgacccggtagatgctctagggcatcttggtgtgctcgcagctgttcagggaacacataattatagatgttcgggccttctactggataatagttctagtcatgcggtcttactatttcatcaagtaaacaagctctcgagcaatacatagattttgatgagatatgagagtcaactttttctacagagttctagctacgcctttataccctaccacctctcttttgtactctctgctaaaagatattttaaactgtttacaatcatgagcatcatttatgtctttcaagccatgtgcctatgtagcggctgaagcaactatctatgagacgtcacattatgcccacttgcatagtcattgtgatttctaaagcgatagtaaaaacctaacattggagatatgataatcatgccacaacatggcaatgcaaaagcttgatagaatccataattaatgcgatggataggctcagtagccggtgcaccacatctgtggagacgtgggacccataggacacgaccccatttttagactggtgggagcaccaccatagcccttcccaggatgtcgagggttcctatggcaagccacgtggaatgaaggttcttttccctccttgaagtagaacacccgtctagctccgaggaggggtgaaggtgacctacctgatccaactagccatgctcaaaacacagcatacgtggttgttcatagatagaccaaacttcgagaggctcatctctcacagagcccaatgttagttctcaagtagccagccaactggtcccgcacacccacgaacatgccaccactactagaaaaatcatttgttgccacaaaaaaaatcgtggcatcaatactaaaattgtggcaatagatgcatgttgccacaattataaaatcgttgctagccgtggtaataaacagcgtggtaataggttattgcaatgattttgattttgtggtaataaatttagatgttgccacggaatggatgtggcaaaaagtcatattgcaacacttcacatcgttgtactaaaaattattgccaccactccatatatagcattagttttacgtaccaaattcaaagttcaaatattagtctatcatcctatctatttatctacttttttttattttgtgtcttggctaggatttgaacccaagacctatccttcacgcgcactctcctttaccaactcacatacgcatcaattctgttggaaaatgcatattgttccatttaagcctagctaactgagatttgaatcatagatttgaatatctaaaagatttcaaatgaaaaagttatcacctataaaattgtagatctcgtcgagacctataatttccatataaaatttgtctcaatccgtgtcaaaatgaaaaaattaagttaaattatgagatgacaatttttttattgcaacgaatttgttgatcgtggcaacaaaaaatagtgaaatgtaccatgtactatataaattgccacaaaattaaaaattgtagcgatagaacatgttttttacaacagtacgattttttgtggcaatatctcattttctattgcaacaaaagtactaaataaaacaacgattgtagatcgttgcaataaaaaataattatttgccaccgaaaaattatcattgcaatagtataatatattgctacgaattattttttgttgtaataatttggtggcaatagctcaattatcttgtagtgcacgtcgtcatatccaagtagctcttgtcccccgccatggttctcgagtgtttcgacctagtggtggagacaaggggacacgactagtggccctccaaaagttttttaacacatataatcacctcactaattaggtaattaaccaaagtaagtagcgtattaggccctttccgtatctaaatcttagttccgcctctgtttcagccttatcgtggttccgtggtttgtgcaacaaggaggcacgtggaccctctcacaaggctatgggttaatgcccttcctaggaaagcgctggcccactgtcagcacaatgtaatgcccttcctttgaaacgaagtgatctggccaagtagggaccaccttggctaacaggctgacagtagcccctaggaccacatcaaggcgaggagttactgtgagtgcatgctatccggtcaaggtgtcgcatcctccgcaccacgtgccattgttaccactttttcagagggatttgtggattcctaccaacaaatacctaagccagatttcttcttccttccgttccccataggcaaaaccctaaattcacaagctccttaaaacttaagtctcgcctcaattcggccgatcttcctacctcttgatgcc

SEQ ID NO: 30312 - DNA, 10603 bp, Oryza sativa
caacaaatacctaagacagatttcttcttccttccgttccccataggcaaaaccctaaattcacaagctccctaaaacctaagtctcgaatcaattcggccgatcttcctacctcttgatgccgtggctgcaaggttgaggagttacgcaacatagcacccccctcccctcttgccgagtccagctccgcaacaactaccacgtgcatccccagcccaaagaggtcatcatcttctcattgttccttctagtggggcttgtttccccgtttttgaattcttgctggcgatcctagtttactacaagatccagcttctccacctgacatcaaactccactgtcatcctcatgacattcatatacttgtttgagatgtttgtgggagtggcatagagcatggctacgttttaacagttcttcatcctatggtggctaccgaactcgtcgttgattgggtgttgctacttccagctccgagacaataccattgactggtacatctctgcgccaatcaactccaagtgggagaacttgcatcaaaattggttgcacctaatttggtgaagtgccctggtgcttcaagttgttgaccttgcacgctatcacccaagattcgtggaaggacctccagtcgttgacacactccagagcatcggattgatcggacccatggtcctaggaaacgcacttcgtcgttggctcagtatcttgcgcaagacaaaatacttggcagcatacaccgcacccacgtcgacaacagtgacaacatccccccttctcatgtttttgtaaattgggatgggctattgacaccgatgtccgtcgacaccgtcacactatcacctaggttgcgccccttgtgagcttgtgagcaggtcaccatcatcagggtaagttttattgttaaaaacctattgaccttcatggtctttttgatcactaactgaaaatttcatgtgcaagggcgtccaattctagatgcctttgggccagcccatcgggtccactacatgtcgatttctatcctggaggccttcactggtcccgccacctcttcccctactactgggcacttaacgaccgtcaacaacacccccacacttatcctttactcgttcctaagtaaagctaatagaacttagtagagcaaagacttcctgtaatgatgcaaacatacaaagtattccaagccatacttgtacctgtgaacttttgaagtttctaccgtatcatcttgggtggttgaagaatagaacaaccttgattcaatttgtctttacttcctctacttgaattaccttggggttttcgtcttgctcataaaaatataactttacctttactcctcaattgactctctcataacactcattgtatttaatcctcaccaaggaattgatgttgtcttttgttatcctacatttctttatgtagagctcagggtagagaataagaatggcatatttgcatcaaacattttgtaaagtcaaaaagtagattcaagaagaatactaatcatacaaccatgatcaagcttctgcacatgtgtgtggaaaggaatatgtatgtgcaaggatgggaaaaatggaatgatgactcatttttgtatgattctcctccctatactttatttagagaacctagctattttatatatcttttttttttatcatgctcgagaatattttgtctccttctcatatgagcatttgattttctaacaagagtctcaaccatttgaccaaactcaaaatgatataagcagcatatgtataaagtttataatgaagattgacatatggctttggtaggaataaaacattaattaggagaaggtaaaattatatcttttttttataaaattccaaagggttcaatcagaagaaagcaagggtcattttaacaggtgacctctcatttaccaatcacttagatggcatgtgttcctaatgatatatgttcacaagcacaaggtatcatgcgaggaataaaagagtatgcaagacatttgcaggcaagttatatactctagctagaatatctaagctcattttaaaagttgagtttaattttcagatgtgtccatgataggaattatcaaactcaaaagttagggagatgagaggataaacatgcaaacacactcgtgggggtttgcaccgggagattgtggtcttgcgagatgcatggcatccttggaaacccgtctccaagaaagtttggtggaggcagtcgtccttggtctgaccaacgatgggcaagaggcctggctgccatcccaggctgccaacatcaggaatgagcctctactcagggtatcctttgaggatatttccaacatgcctaggtcgctctcgatgcacttggagcacaacctggtttctcgcaagatgatacggatgagaagtatgccatgtcgttcgggagggtgaccgaggctttagagaggattccggccaccatggactaaaataaggagtgtcgctttgtgactgaggctgcgatggaatacattttcgctggttactttagccgcaacttggacttcaacttctagctagtggaggagggtatccaggtagggagccaggtggtacatttctatgctcaggcgatagtcaaagatctcaacattgggccaacctccaccctaccatgcatgcaccacaccgctagagtagaagatccaagagtgacaagtggttaagcccttcaatagatcataatcaacatttaagacctatctcctttcatggtaatgtctttgtacaaggattttacaataggatacatgtataaaactcccactcccactccccctccaatctctcatgtcaaaccccacctccgcccccctctcggtgcagggcacctttcgtgcagtttcatccccatctctcctcctcaccagatgatgtggtgtgttggctacgacgagcaggacagctctgacatgaagggaggcggctgaggtggcttcaagtctaggcagctttgacggccttggctgcgatgacaagtggtcatgacggcttcgatgttgccggctatggcggtcggctataggggaaagtgcccagtacagctatggcgacctcagatgtggccttgagtggttgggacaacttccgttgtgtggctacgctgatcccgatcttgttgcgtggcaatgtggatggcattggtgttccctccgatgtatcgacccggttggccattatcgtcgcagccatgcttctatgtaagtagcgacatgggtgacgcctgtgggcaccacataccttcctggaggcgatgttgggatgcccaatctctcatttgtgtcatgggtagactctccgggtgaaaaccttgttttggatgtccaaaatagtgatggattcattatgtcacaacttcttgaagacatcgtattggaggttctctgatggtgggatattccagtggcgttgtccccatcggacgggttcgatggcaaaggtgctagtaagatctggtgaatgagaaatctacggctcagatactatctgatgttttattccactttggttcaacattggttagtcgatggtaatataggagtgaaattcaaccgacaaaggattggttgctggttttcggatagtctgcttttctggtttgaggaagacaagaaatacgtataacttgtaatccgttggtagagacaacggttatgcataccctaaccaactatagatatagaattatgtctttaaggtggtattcttggtagttttctactacctccgtttcaggttataagactttctaccattgcccacattcatataaatgttaatgaatctaggcacacatatatgtctaaattcattaacatatatatgaatattggtaatgttagaaagtcttataatatgaaacagaggaagtagtttataatcaagctataattttgtaattcgcaattattcgacctgcaaacacataataattgattgcaacttctacgaagtaaaggccagaatgaattccattatgttaaaaaacatatttgcaaaacagggcatctgaccattgttccatgcattttgccatatacctatagtaaagttcgtcacacatttgaatctatggcgtggaagagaattttatttgatgagcaattaacgaaaggacaacacctatgactagaaaagttttgctatatgcctaattgtactgaacatacggttgctagctagaatgtttctaaatgatttcgaggctttgagctatatacatcttcaaatgaattgaagtcccaatttcagtatatgctaaatacttgatgcatgtccagagaagaatcacatggacggtgttaccttttctattcataaatgtacacctaaatcttcctgcttctcttgtatttgtatgtgttgaacttcaatctcaccagaaactgaattggtggggaatggatctgaaaggttaacttttctgaaagccaagtagatcagagcagcaatataggctgccatgaaagggaaaacaaggctgctaattattgcattaacaacccttggaaggtcgctatgaacaagccaagcgacaaagctagtacagaagaaataaatattgattccaataatcaccaatgacagtatccacgcgattcggataatctacataaaagagtaaaattcccaagagttaagaagaatgagttcaatttgatgacaaatgtatgccattttaagacaacacagggaataatgaaaactatggtgttattgaggaagtaaaagttattctatgcaataatgcaaattatgttgaagatttccgattatctagtaattaaatggaaataattcttcaagtaactgtgattcatttgaagtaaaaccattgtctaaaaatatggatgcagaatataataacacaacaagaaacgttactaccttgaaattactctcactctagaatttgaaccataattatatactccaatgtttactgaaacaccatgctatgaggtaattttacaaattgaaagctctaacatagtaacatgcattcgtgatcagcctacagttctagttgagatttcaaatctcatatattcactcttacaatgggatatatgtaacgcccatgttccaacatgcacatgaacctagacttgatacaccagaactctacacatggatagccatatagtagttcttagactatcataacaaagtaattaaattatatgttgctacatttggtccctagttgatatagtgtttcattctaagagtataactatgaaagaattacccataaatcattttgatatgaatgaaagacatagatttgcaaatatatttcaaccatagagtatcagacagggaagaaccaacaatcaccactgtctaccaactccattttatgcaaataaagatatacctggctggaactagaatctaacattattttttctttctgttgccatctatacactagctcgtatttgcaccccttttctaaaaagcattggcatgttattaagtggaaaaatatattatatatatatgagagatgctaattattatttatccaatgattttatggtttacatgttggcacataaaaatagcagcagggacatcaatttatcaataagagaagctggggaaatattgtgtgtcaaactcaatgcaaagtggacactgaggaaatgggggtatgtgcacaaaagaaaaatgttcatgaaaaggggactatcatgcttatagcttctatttacaactgtttagaaaagaggaaaagagtctgctaattagtgttttttcccagcacaaactactttagagttgtatagttaccagtggtaagtaaggcgtataagttatttacatatgtacagcaatagctggtcacaaaagtgaaatgaattgtgtaagtggcagtggggaggttgaagaaatttggttggtcaaggccaacccactgcactgtattcctttccatgagtgcttatttgcccttggcacattcacatgttgagcttggacccacatgtaactgagagaatgagggacgtgcatatcaacttttaggggcaaataaggttctaacattttggttttttattgttccatctgtaacttttagatgccctggtaagagtgtatcatacaataatttgtagtgtacgatcctacatacatctagcacaaaaatatcttttttcttaatttacaattatccgctaacatacataagggcatttagatttctcgtaaaagatatttttcatgttatatatatatcataaattctctaggacataattatacatacaaactaaatgaaagttatgtaatggaaatggactatgatcgtgtccaaaatgactagtataaccaaacagatagagtatgtcataaacaaattgaatagtaaaaactgttttagcaagcttacagatgttgcattcttgtatggtcctatatttgtgcagctgctactgaatttaatgagtggaattagagcaaacggcagcacaaatgatagtacaatctgcatcacaaaaaatcacattacagaacatatcataattattacactcgtttaatctatggattttaaagttcctattagtgaaatataatatgttttattcaacattgtttgaatttttgtgtcattgtgcctatacctagcttatgttagttgataagaagagattatcaagagaaattaccgcagctatgttgataattcgatgcactcgtaaagtaccaccaatgctgcaaattatcaaactaggtaataaggtgaaacaaggagcaacaagatatatgatgcactttctcattccggagaagccctgtaacaacatttggtaaatcttgcatgaagaaatttagggaggaaaaaaatacagaaaatccccatttggatactgatatgaaactagagcttggccagatttctatctattaccagttgtaactaaatattttaacacagaagttacatttcaatttttctaagcaaagttacatttcaaattcagtaggcatgcaattagctcgaaatattatttggtaatattgagatgatacatcttctgaaggtatgtactactaggtttatccttgaggccctaatctaatctactccagtaattaggtaaatgtacctgcatgatgtattggccagcataactcgtagccaccatgcagctctgtccagaaactaataaggccacaccatacacagttgaacttgattttcccaaaatattctgcatcacaaacatatcaaagatagagaatgaggaagaactagtaaaatggtacactttactagtttaggtttccgtttatataattttgtggcctggtgtttccttttagttgtgaaacatgtatacagtaagattactgcatgtattgctacacgttcagtattgctatttagctccacaatactaaaatactgtcagaagtcagaaccccctaaggcttatagttttcaaatgtaaggtcaatgacatcctaaaagtgttctattgaatacaaaccttgagtagtacataagttgaattcaatgttagactgctgcacgtgcttgtgtcggcaaatgagagattgttggcacatatagtaccagatattgatacaatagcgacatttacaagtagtgcaatgaacagagctaatgcattctcaagcaagaagaatgtagaagcatcctgcaagaaagtgaattcaaattatattacgaagaaataatgactgtttgaacagaaatataaagagctagaaaaagggaaaaaaaaacctccttttgaggattgtcatagactttctatagaatactgaaatactgaaattattaggtagagttcattgtacttaaaaatagagtttttcatgttatatatgcttattcattcatggttgaaattcctcaataataacatgaaagtaaacgaaaacttttgttcaaatatgctatgtctcatacgaaaatgaataatctagaggtactggtatagaattatagcccatatactaaggggcactggacagacaaaatcaacatcagtttagagaaaaaagtaaaaagaagtagcctattccagaggttaaaaattaattttaattttaacataaaaaatatccttttaccttgcgtcctttggaagtatatggcatttttctcgttagcaccaaagaagaatgtaggaagagattatgcctaatgttataaaagaacagagcaagttagtgaaatataccttttgctttacatctgacggggtagccacaataataccttttaaagagtgtgaaagacctttcaaaggttttttttttatataacagatatataacttttaaattagtaaaacctgaattataatcgttaactaattgaaaaaaaaatgaaaataatgatgtacaactaaaaagtagtggcaatgaaaaagaaaattcatttgaattttcagagacaaaagtataatcatagttctaagataatcattaaaatcatttaatgtgggagtgatacttacggaacaacaagagaaccaaacatagcaaccgcatctgaagtagaataatcccctttgggccttgggataaaaagcccctcaattaccccaccagcaggaggattaactttgccaagttccataaaaaagcaagtagccatcaccaacataagaactgatatagtgaactccattttccgagcctacaaattaaaaggatgatatgcatgtcaatctgctggctgatacaatctaaaacatattttacctttcataatgttaataaggtggaaataatgtacaaaaactatataccaaaaaaaaaaaatgtgtgatctctctctcatcgaaattcccattcattcaactatctgaaatgaatgccagtattatttatctcagatagtatatagttatttcggacagtagaatgaatgggaatattttgtatatattttttagcggaaattattttaagtacaattttgcatattccattagtgaatgtccacttctcacacataccatttatttttgtgagatcaggtttatgccacttctatcaagccacattttgcttatgccatggaggttctggctgattcagtcaaaaaccattgtctgtcaactgactattttgccactgtcttctgcagtgtattttctccctcgtcttctttcacattctctacgctcacatcagctttctctacctccacctccaccaccagtcaacgctgacaagttcctccatatttggatgcttcacagcacaatggcgttatcctccattttctccatccttcaaggaaaaggtcctggctaatgcaggtggagagggaggaagcagaagattcacggagggcagtgatagtgcaggctgatgaatgtggggaaatgtggcttgatggaagagtagaatcaacaagaagtcacaagaattagtgacaaatatgaaaagtggacattcaccgttgacaaaattttcctttacttttttcctgaaaatatcatatttagtgagctccttaattgtgtttttttattgagtaaattacactagcggtccttaaacttgtaacgaggtttcacttaggttcacgaacttgcaaaacgagcatcgagatctctaaacttagtttaatgtatcatcccggtctaaagcctcgtttgaccgtggtcttgcctacgtggcatgccacgtggacgatgacatgtatttttttttattttttctcccttcttccttctttttttctcccttctgccgctgacagcctgtcagggcctcactactctcccctcctctctatcctctctcttcggccaattaagtgagaccagtgttgtggataacggttggtacggctgtatattcggacgtcaaaatggtggcgctgacctctccgtcacgttttagcaaaacggtgtacattagtcatttcaggatgtataatcaccatcattagcgactaatcggccgtatccgactaatcggccgaataaacgggcctaatcacgtgacaaggcaagcccagccaggccacgataactatactggcccattagttatgtaacctagcactatatagctaacagaacgtcgtttgcaatcccaaaatcctcgcagctcattcctaccgctacaacctgcaagtctatggttagttcttttcatctaaacctctttcaaatccaatctaccatatttttatgtcgagttaatgtcatgttatccttatttttatttaagaatagtaggtatatatgtagttatatgcatttatctgtcaaaaataataagctattatgatttatgagttatgtacatatatttgtccaaaacattaaatttcggtcaaattccgattactcatctaatgatatgaaacttgcacttgatgttgaacccttggaatttataaaggaaaataaaattactttgcatactcctcaatgttgttcctttgctaccaaaggcatatgtcaatcttaatgaccaaaccttatacatatgctgcatgctatcattttgagttttgctaaatggttgggacccttgttagattattttaatat

SEQ ID NO: 30313 - DNA, 7211 bp, Oryza sativa
  unsure (1)..(7211): unsure at all n locations
nnnnnnnnnnnnnnnnnnnnnnnnnnnnnnnnnnnnnnnnnnnnnnnnnnnnnnnnnnnnnnnattgcatcttcgacaccgagctcgcgcgctccatggccaacacctcccctggcacgcacggacgcagtcggcgacccctcccgggcgtggtcggcgacacctccccccgcgtgcccgtgctgctcctatcctctccggccgccgaccgtgtacgcacaccgctactctcctcccgtcggccggcgcccgcgcacacgcgccgctcctctccttccgccggccggctcccgcgcgctgctcctttctcgtcggccaccccgcccgtcgccgcttcggtcgccggcgaaagtgagggaaaagtaaggtaagagaggccctgccagtacctgtcagtggcagaagggagaaattttttttaaaaaatccatgtcatcgtccacatggcatgccacgtaggcaagaccacagtcaaacgatgctttggactaggatgatacattaaaccaagtttagagatctcgatgctcgttttgcaagttcgtggacctaagtgaaacctcgttacaagtttaaggaccgctagtgtaatttactcttttttattttataagcagagaaaaattcttaccccatatccttgtaacccgagaattaggaaagtgcatgccccacatgctaggacaccggcccagaaagggatgtggagtagcatgttgtaggctaaagcagttcctaaaactgcacaaagaccacagaaagcaccatgaaccttgaagaatttaaatacagaagataaaactgtaaagttctgtaagatttataaaggagaactgtagtgtatagtgcagatcttgtaagcctatgtcaagaaatagattataaaaaatgtgatcaagatagataagttaactggcacacaagaaaataactcccaccagttacataaacatgttatcttggacattgacatggtctccatagtgcaacattagatggtaatttctaatacaatatatttattataaaccagcaatataatactataaggaactttccacaacaaatctatttagaaagaaatatgacaatttaaagttttgaaagtttgacttagcacatgtccaaattgatttatgtgaccagtgggagtatttgattaagaaataaagcaagataaacacatggaaaccctataccgtgagagtaacattctcataaaccacactattggtgtttctatcttcaaaatataattagagttatatgcaataatcatcaatattttagataatggaatattttattatcccggccactgcacccagagatggacaaagccatgatcacttatttacaagttttccatgccaagaagaataaaccaaacataaagcaacatgctacagatgttgatgaaacacaaaatttcagttcgcttacaacctattgctcaaccaccagccgtagttattgaatagctctattaaatttataattcaataaaacaaactctgcacaaggaagttcattcaaaatattaacctaatttatggattacccccatggtttatacatggacaacaaatatgctgtaaaagaggatactatttttccaagtaacaagtaaaaatagtatttcaacttttatagaaagcaaagacaaacaacaaatactgatacatacctcctggtatagtggcagcaataacaccaagctctgctagtaaccataggcagtacttgacatactttggatattcacccatgcacaactcagcgaggtgccttcctacaatatatttatatggtaagtttcatagaacatgtatttttgtcaccagcttgataatatgggtagttagtttcacctgtaatgatacccaaatttgctgccaatgattgtacagtcaacacaaatatgaacccaaataggagtacccatagcaactgaaaattttaaaaatgaatgaaggagaagtgagatggcaaatctacaatcaattgacaaaaatgtataacataatattccacagaaattttgagagctttataccgaatatctgtggctggatccagctaccaaatcagtctgcactgttccaattttcaaagtgaagtagttcaatatattagtactagaaaaagaaaacggtggtatatgagcatgtcctgcctaggaattctagtggtatccatccatgttccttgatcctattgttgaatttaccaaagccatttatgacttaaaaatgtctttttctcaccatgcatggatggatggacacaaactggtgagcagagacaggcatagttctagtccaaggaagattgaaggacaaaggggacttacagttactaggatcaaggtatgcgatggagataacaaatccaggaccaacatgtgcaagaaatctcttccaagtgggtgcctgctctcacagatataaattactaaatggactcaaaaagttctgaaaaaaaaagttgcatgttgcagtatttacaacttaaatattttttccctggtggaataaagttcaattgtcttgtaatagatggttttacactgttttaaacattagtttttccctacccagttaatcttttatgtaggtaatgcatatatcagagaactacaagtgaaatatttttctaaaatttggaagacatctaattttaaaaattcaagaattgtttgatccttgagctagattgccacattagagccatgttaatcaaagcaactctaaatttgggccaaagttgaaaactgaatgaaatacaagttcaagggtatatacttcatggttttgaagtttacgatcgataattgtttaactctatgaaagatcatgataataaaatggtttttttcttttctttcttttttctcgaaaacgtaggagaattgtgtttcatttcattaaggggaagaaaaaacaaagtagaaaatatttacaaagtaggaggacccgagccctcccaccgagacccacgcacccaagaccacaccgaggagcgctaactgcctaggttagccatcccactgaggagcttttgaagtgccaaagctcctgcggaacaccaaagattactcttgttttctaccacttgcaagaccgagacaccctcgcaatttttgttgaacccatgttatagtaggggtgaactgtacttttgcggcactaaatagagaaaagaacatgtcactgacaaatgacggtataaaaggaaagaaaagccattgtctgatattatattgtgaaattcatgttcgtcgatggtattttgtagaacacaacatttgttgatagcatattgtagaataagtcataatacaaagtcagctacaccaacgtgaaaggaatgacactaaaatctcaactcggcaatacgcgagtgagttgaattggcttactcctaaatttttttttggggaatacggcttactcctaaattgaagcccaagagaaacatgcctaaccgatgtcggttgataatcattattgcaagaaaacatccttgccaactactcgaagaataatcaaaccatggcaaaactaagtaatataccacaaaaagggtctattattttgtaaccagacgaagagatgatacgatctacggtcgagccaacagatttcctatacaaaatattctagcaaagccaaaagtcctcattgttatcagaaattttgattagtgcctgtttctatccccgtttgaggaaaagtctgtgctaattttacaaagcagagtacatagagatcatcaaccgtacatattcatttcagaaatcaatcaaacggatattcctcagatgtctgaattggctgaggcaatcgtgctacacatggtttgcttcctacttgtgcggacagcaggagagaagaagaaattgacagcaggcagcctagcagaggaggaagaaaggaagaagaacaaactaacctggacatcgccgtgcagaccgccgtgttgccgcgacggcgaagcccctgcggctgcggcgacctcaatctcaatctcgtccccgccaccgccgctgccgccaccgacggccgcgaccctcccgctaccgttcaccctcccgtgctgctgctgctgctgctcgtgctccctcccgatcttcgccccctcctccattgctctgtctcagtagcgcaactagtggtggtggtggttgaccattaacctgaacctggcgaggccagcaccagctccggttgccgcaagaaaagcagcagctgcctgcatgcaatacgggtcaactccgcgatccctctgcatatctgtacttctcccaacgtacactcggtgtattcgagatgcgacgcaagcatcgaggacgaaagtcgtcggcttgggggcaggaacagcactcacctaacccattccctctctcaaaaccccctccaacccaaacaaatgcccattgtttaatgcccgccgatggcctctcgcttccgacgtacagctccccttgtacggcatgatgcggaattgcggattactggtgcaatcgacggtacggatcgaggtggtgcgtcaattggacatttggattgcggaggaggctgacagcgaccggatccgcggggtccattgggggcgccggtgggtgcgcggtgtgcgtctctcacagctggacaaggccgcgacagccggccgggcgacgtacggcaggcagtccggatcagcttcttgctctgctgtggatagaatatagatagggatcgcgacaaccagttgaggacaaattgtaaacgccaaaaatttacaaatgccgtcgatgtcttcggtctctctagaaactcgacaagaaagcggcgacgctggccgcaggctccgcaagaaggcggtgtcggcgccgacgaacctcacgaggaggcgatgaagatttggggattttgggacgatgggtgcgctgattggttaggagcgatgacggaggggatcggggtgatgcggctatgaggcgtagacggatggatcgatgaacccgtggacatcgtcccggacggtgcatgaagggtgaggtcctgtagtactgtagcaggctttctgggctgagaatcgtcgaagctgagaatcgtcgattcactgttggtagtgggtcacaaaaactaaagatttaatatgatctcggtgccctatattgataatagttgaaaacaatctgaatcattatctgaagcgttcagatttttttttctaccaccatcccacttaactgtagtagaaatatttaggggcataattgttaaaaaaagttacggaggggtaaaatcatcctttaaagttgactaaacttagcacttcccctcaatcagccgtcgcatccgccaccgatgccgagcatccggtgtctagtgtctcctccccaccaacgcctccaccaccaaaaaattgcttatcgtacccattcatgttaggacgcttgatcaaggcgcatgcccgatctccacttcgtgtaaccaaaccggttaagtcatgtataacttatctggactccacgccatttcacgcaccggatattcgaagtgtttacaaaaaacaaaacagaatttactgcagcaaaacaaaactgcaaaaaggagaccacatctacgtaagggtaaggaaccaattttgacaaaccatctgacaccgtacgttgtgcacgcgcaccgcctcgctaggacaggccaggcgagcgagtgcgcgcgtgtgttccccttgttctctccacctcacatgcctcaagtagctagaagagtatccttccttataaggagatcttcctctcctagaatgagcaaggtggtactaaactccccatgcatgccatcctatgaggtgggcttttctgattttccaatgaattaatcttcgaatgggctaaggcccatctattaattccaacaaccccccaccaaatctaaaaaacccactgaaatttgcctttttcaatgtattgtttatataccagcggttcgatggagaccaattaaggttgaatatccacctaaaactccaagctacacttactcacaacttgaacaatggattacgccttgaagcaaggcttatacaagcaagtttcactcagagtcttatctggtactagaccgtcagtcatagtacaaaaaaccggaccggaccggcggttgaaccaggaataaaccagagccgaccaccttgacggctcagttctgctaaaagaccgcccctgcaatcgaacaagtaaaaaaccgtgaaccggccggtttttgcttgaaccggtgaaccggtggcaggttttaaagtatcgaaccggtttttatttttcctatggcagtatgacatgattaatttattatgttaccataccacatttatttttttatgttgtgaccatgtaataatagatatattggtttatttatgcatattttcaccaatttgtgatggttctatattaaaaataatgaaaatcaaatataatagtaataaataaaaccagtgattcaaccggtgaccggtgaaccgacagcccaagcgggttgtcctccggtccattttttgttactatgatgtcagaagaataccccttgggtggagcgtataagtcatattctctggtctcttagtaagcttactagaagattcacccaaaatctccatcgactgcgaccaacagtcaatctcacaaaggtgcattctttcaagaaagctctgcaggatagcatcttcgttaattaaagccaacaaaactcatcacgacatagccaacctgtcttgcagctcatgagagtacatgcatcttcacttagttaactaatagtctgtttacaaaacctccatgaaatagcaccactacctagtgttaaaacatatccactaggtgccaagtttctcttctcggcaaccttgtgaggcttgcaaggttgctttgattgcacacaataatgacacttagaacctttgacaatggagaacttagaaatttatcacataccgaaaagccgagacatcaagccaaatttaatatgacatgaacgtaagtgccgaacattagcctcatcatccacactgccacaaatatggttcacagacttattgcagaaatcagaaagggaaaatcggaacaggcctccgcactcatagccttttccaataaaatatccaagtttagacacgactactttattagactcaaataccaacttaaatccgtctctacatag

SEQ ID NO: 30314 - DNA, 3353 bp, Oryza sativa
tgaagttggtggtctgtgaggtttgtatttctttttattcttgttttgggccttgtgcacaacattgacactagactgcccatcatcgcccttagacgcggctatttttttcccaagctttctcctcaacatcaagagatgctatcaacccctcaacggagtattcttgtctcttgtgtttgagtgcagtaccaaaacttctccaagatggaggtagtttcgcaataatttacccggccacaaatttgtcaggtaagacacacttaaggagttcaagttccttaaccatggtctatatttcatgagcctgctcaactacataacggttgtcaaccatcctatagtcataaaactgctccatgacgtacagatcactgctagcatcagtagcaccgaatttgttattcaatgcattatcccacaactccttagcgtcggtcatgtgcatatataccccgaccagacgacactaagaacgctaagaatgcatcctacaaagagagtagtggcctcctcgaattctttctgcttttgagtagtgagaactcattcaggtttgccattactaacccagaagcatttcatagccatcagccacaaagtgccccttgatcagccctctcttaaagtacacaccggtgaatttgtccgacctagtacatcggcaaaaccagctatagtaaaaccacggttcctataataaagtttttggattgttgaatatataagcacataatgatttaatttattctataaataaatcatgacattgtagatgtaaactagcataatcgcatcatacgatctacacgtgtaaactagacggtaaaccatgaatagattgaatatgcgaaacatgctaaatgcgtatcgagggttttggaaaatcggttgcccagcaagaaggactcacggtaccatgcgttgatgacggcgcgcagcacgtgaacgaagaggaaaacgagccgttgtggacgaacaggaagcagtcgtgcgaagcgcttcccaaaatccttattgtcaccttctcccagtgcaagacgtcgaaggctatagttccgaagacctgctctcctgatcgccggtgcatgtcggcgagtgggatggagtagtctacgagcaacggcgcgatgcagaggaggaggcaaaccctagattgattttgcgtgcgttgcatggaggcggggactcaacttatatagagatatcatgtcacttgatcagggcgcctgcacgctctccactccgcgtaactgaaccggataagtcgcacgtaacttatctagactccacgccgtttcaagcaccggattattcggagtgtttcccaaaaaaaaacaaaaaacaatttcatgcatcaaaataaaactgcaaaagaagaccacatctgcgcaagagtaaggaaccaattttgacgaactattcgacgtgtagtcgtgcatgcacctcgcctcgtgtattcctcttgttacctccacctcacatgcctcacgtggctaggagagcatcctcccataaggtggcttttgtgattttccaaagaattaatttttgaataggctaaggcccatctattaattccaacagcctcatgatgtgttgttttgtgcaccttctatcctcaccggtagtatggctctatcattgatggtgacatcttcttacatagatctgtcaatcgaggtcagtttgagcatgtagcagccttgcaggcaattgagcttattaacctgtgttttaactgaaattttatcttttcaggttgtatgggaagataccagggcaaaagtaaatctgcatcccatcttgtagttctatggcttttctgggagaggttaaataacatgtacttgtaatagtacggtttgtgttaagtatttgccagtttattggtccgttgccttctgctcatcgctgttaagtatttactggatattgcatgtattcgaattggataaaaccgcgttattttctcccagaagaacttgcgagctgcaaatctacaactaaagcagatatagagataggcctgttatagaggcgggcccaaggtattcaaaataggaaaaaatccaatttgactcccttaaatatacgtcgaatcttattcatatccttaaaccacaaaaccaaatatgatgacttcttaaactattaaaaccgtctaaaacgactccctcggctgttttaagagtggttttcgctgacgtggtgtacatgtggccgcctagtcatcaaataaattaaaaaaagttaagctggcccacatgtcatcccctccctttaataacctctctctctccctcctttcttcttctcggccccttccgcctcggcactggcgacggcggcgtccggcggcaagtgtacggtgtcgagggcccgacagcgagggcgtcgcttgcggctgctgggcccgacgacgagggcgttgactgcacagtgagatcgacgagatcctcgacctagcggaggcccagcctttccccacggcgtttctggccgctgcccgcctcgacagtgccctccgtgtcgccatgtcgcgcatgacctgcacctcgccgtcgacaagctcacggtcggtgcttccgccaacgccctgtggacacgccttagattgtctccaacagagaaggcaaaacgcaaaacagcctccaacagacaaagcaaacagaggaggcattttgcatatgaggagagagggaacgcaaaattgccgtctttttcaagacgcaatcgtccacacgatgtggcggtgagctcgaagattcgcatcggggcgcggcggcagcggacgatgacatcaaggcgagcccgcggccggcgtttccaggcatgtctacgacggggcgaggaggccaacgacgaatccttgtcggggcgcgtcggcacagcgtggtgagcccgcggccggtgcttgcacgacggatccacgtcggcgaggaagcaaggtatccacgtcagcgaggtggcaaggcgaggaggatctgtgttgacgcggcaactaggcgaggagaatccgcgtcggtgcgaggcgcggcgaatgcccgtagagtgcccctggcgatttggtcggcttcttggacgacgacttcttgaaagacctccgttgctccacagcgtcgaagtcccgcgggaagaactcgatggagccgaggcggcggcggtagagcagaaaggcagccgccgctccctaccgccgtccccaccaccgtccaccgctcccgaccgccgccgccgccgctccccaccaccgctccgagcaaggtgaaaaaagagacccgggagggagaaagagagataagggggagagagagagggagagagggaggaggaagaagggaaggagaggg

SEQ ID NO: 30315 - DNA, 3018 bp, Oryza sativa
ttccacatgagctacatgtcgacgacacgtgggacgaagaccgggtcaacaccgtcacataggcgccacatcagccaaaaccgcttgcaaaaccacctagggagtcaaattgcatcagtttcaatagttcggggagccatcttatccggttttctggttaaggggtacgaattagattcggccaatatttaagggagtcaaagtggactttttccttcgaaatatgaagggataaaaaaatacaatatcaagcctaataaatgatatgtatgtatagtttcgcatagttctaaactatataatatataatggctataagtatattttcataaatttatagaactggtcatgaaatgaattgtatgtattttaacatatagccgaatgggctgagttgtggcccaaactcagtgtgggctgagaggaaaggggaggggagtggggtatttttttcatttttagattttttttaatatttacagaaataatctatcggccaaaaaaaattgcaaaaatagaccctgccgtccagaggtgggcggcaagctgacgtggcagacggcgggtcgaccgcgccgtctgccgccatcggccaaaattgtaattagccccttgccgcccatacagagggcggcacggggctaattgcaattttggccgcccataaagaggttgcgctcgtactttgtgcatttgggccccttgccgccccagtagagggcggcaagggacccagatgcaaaaagtaccgccaaacgatttttctatgttatgttaataataaataaagaattatttattggtaaaacttgttaatattgttataaaaatgtattgaagttggttgtttcgcaatttcatatgttaagtaaggtattattttgtaacttattcgacgtattagtactcggataattaatataggcctatcgcagtctcggtcgtagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaacactgtattgctctgatagttcaagctgcacaacacggctaggtggagttagaacccttatggtgtctatccattctctgtattgacatcttcttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggctttatggaacgaagaacctgacaacgatcaccacacctacatcttggacgggcttcccatggagggagtgccgtagttagcacccgccagtcgctctgttgttcacgacattgtcgttcataagccgttttctctgtaagtattgctcagtactttcggatgcgaaataccagcgaccttcttgtaaacaagtggttaggtcgagaacgggattatctgtatcgacccactcgatgtatgcgcaagccgtagtgcgggtttgccgaatagagtagtgttacgaagaataaaacgattgcccgtacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagttcgaatcctcaacaccccggcgtctagccattgacgaaagccggtaggatttgtaatgaagcaagtagggaagagagtactgaatgtgactgagttctgaaagattgtgaggcctcactcgttaaggcgacttatataggcgcaaaaaatgagtgatatccctgacatgtgaacgtggaggggcatggttggtacgcctgattggggctgaaagttacatgcctgatcggcgccgaaagttacattggttgtatgcggcaaatggcaggcaaatactcgtatcgcacgcgaataaaggaggctacatcggcgtggcagaaagtagtcgtgcatgcgccgaaaggtatcgtgcacatataacaacaacgtattcattacacaagcatacagtactggaaagtgaagcaaataaacaaagagaagaatgctctactggccctaccccgcgccgcgaccacgcttggtcctccgggcctgtgctcgcacgtggtcctaggagtaggtgaaacgatccggtggcacagcacgggtagcacgagtgtctggcggcggagtggcctgcgcctggtcctgcgtctgcaccggcggtgcgcctcccagctgtgaggggccgatgacgtcctccgtcgagcctgaagcgaagtcaaagtcagtgatgtcgaagagcaaggtggaaggcaccaagtggtccgacgaggtcccagcatggtccagtggtggaccctgactcgacgtgccggctacctgtgacgaagtcccggtgtactgccagaactgcactgagtgcgaggtcgacgcagctgcctgagacgctgaccatgcagcctgggagaagtgggcggcctgcgtcatagcgaattgggcgaaacctacacatcgactaagacgctgaccatcgcatttgctgcaacacttcaccctgccagcctccgactcatccatattgttgtggatgcgacgagtcttcctccttacagccttgcctcggagcttcgatgggtcaggaatattgagtacttcatcgttagtctatgtgaactccccagctatgccgaacccataaatctc

SEQ ID NO: 30316 - DNA, 3267 bp, Oryza sativa
cctgcgcctggtcctgcgtctgcaccggcggtgcgcctcccagctgtgaggggccgatgacgtcctccgtcgagcctgaagcgaagtcaaagtcagtgatgtcgaagagcaaggtggaaggcaccaagtggtccgacgaggtcccagcatggtccagtggtggaccctgactcgacgtgccggctacctgtgacgaagtcccggtgtactgccagaactgcactgagtgcgaggtcgacgcagctgcctgagacgctgaccatgcagcctgggagaagtgggcggcctgcgtcatagcgaattgggcgaaacctacacatcgactaagacgctgaccatcgcatttgctgcaacacttcaccctgccagcctccgactcatccatattgttgtggatgcgacgagtcttcctccttacagccttgcctcggagcttcgatgggtcaggaatattgagtacttcatcgttagtctatgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaaaagcaatgacatgtgccgtcagctttgagaacacattcctgcttcactctcttgcggtagatacccctgcatgccttatcttgacatagtatctcaaacctgtgttgttgggtaccttgcactagagctcgatgtttcatggcctttttacgcaactcctctagctttttctgcatgaaagttccaaacaaaatgctgttgttcggcatagagggaagaactgcctggaaccgatccctaaaatacctgcatgtcccatgtaaaatgaacttcactatgccaactagtggcagtccacggacaccgcgcatcacccagttgtaaacttctaccaaatttgttgtcattattccatatctagcaccacctgtgtcatacgccttggcccatttctcttttggttcatgcagaatccactgagaaaatttctgaatctccaatctagttcttctaaccaatgttggactatccgttgggagaggtccaagagcttgaggagggtcagtaacggcagtcaatggagccactgcacgctgatcactgcatttggctgtcaactcatctaatctattccaaagctcattgaatttttttctcctggttctgattgcatagcctcttaaacatgttcatgagctccttattcttgaattgcttgaagaaattagctcccatatgacacatgtaccacctactctgtacatcttcccacacaccagggtatcctcattccatactcccaaactgcaactcttctatcgctcgcagaatgctagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaatcgaggggaatttcttcactgcgtaagagctcccagggtttctttcctcgataacaccaagcaggcgtggcaaattgtcatacgaggcttcgtaagttccaaatctcatctctattattttctgtttggccctccaggccttggcatagctaacagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttggacttggcaacccaaaactctctatgaagtgacattgcaaaatgttttaccgcctccttcatatcttctgctctactataaatcgctccctgaaaaacctcattttctttgtactcccatctcacactatcctctttagagacaaccagccaagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccatagctagaggccacccgcgttacaatgcattttccacataccatctccatacttgagaattttgaactggcattagttcccaataaaaaccctcagttgcccgacttactataacattgattgttatgtcacttgtctgtggatcaactctcaagcctctcattaaccatccttttatagaaggtacactcctctcaacaggtctatcaattcccctttctgatacaataaaatctgacagatctaccccagttggcctgtaacggacgtttcctgggccatggtaaacttggaatatttgtttgttcgacatatctgtcaacgaaataactagatcatattactctttcatgcaataaacatctacaacgtaatatcttcttgtgtatgccaatgcaacggtaaagtattgattccaaactagcagatctacgtagttaccgatatctacaatacgcacttctagattagtaaaactaaaaccctaaaaatataatgcatttattcaaacaaaattttaaaaaatacacactatttaactcaatagtcacatataggatctatgaatattacctgaaatcggcgtctgaatccggcagggcttcgccccttcttctcttctcctcccctttcttctttttcttttcactggatttgaggggggaggaatgagggctgggggc

SEQ ID NO: 30317 - DNA, 2031 bp, Oryza sativa
caaaatggccggccccgactggcttttttttattggggcccctttccgccccaacagagggcagcaagggttttcctgcaaaaaaacctccctccgtcaccgcccgtctctcccccgtttgccacgtcagcttgccgccccaaaggtgggcgacagggtctatttttgtaatttttttggtcgatagattatttctgtaaatatttaaaaaaaatctaaaaatgaaaaaaattcggggagtgggaaatttaggcctaatgcagaagggacgatgaaataggacccaagatgagtaatttaaggcttcttctttatttttttaatacatatgcgaagcatagagtatatatacttttttttcaaaaaaatcttgagtatacatcttaatacccttgaatcactactgggcccgcccattggtgcagtcgaagcaacgactgcaattttagcagctgcagtgattgtcaaactgaagattgaattcgatgttgttctaaagaatgggcgtgtaaatatgagcactccacgtacagttaaaaatatattgcatgtaaatatattccgggagaaacgaccattttcacgtgcaggacaatcacagtcagccacagggcatgttcagaactatttcattttgcaagccgaaacgtggaaatgaacaagcatatcgcttacagatcataccatttatcttacaattatcattaagagttatgagatcactaattcaatgagaaaacaattaaaagaggatctgaattaattttcctacttcagtaaactataaaatccttaattttccaactttacaatttcattaagcatggccagcacaaatctctatggttgatgagatcttatgatattgggatttcgatccaaactatgaagtgccataataaggctgagttcttttcccaacttttccaactcacctctcttgttttccacacgcacacttttcaaaccgctaaacagtgcgattattataaaaaaattctatacgaaagttgcttaaaaaatcatattaatctatttttctaaaaaaaagctaatacttaggtcttgtttggttcatgggactaatccattagtccatctattttagtcccaaagaatccaaacatgggtgactaaaagggactaaaagtgcatattgagactaaaatccattagtcctcttagagcatccccaggagctagacatatttcatcctccaaatacccatatggatagtcatctaaaaaagattcctcattcatatcccttcccactccaacagatcatccatatcccaccctcctatattttaatatcttccaactaaacttacttttacttttgtatttttaagggacatattttgaactactaaattttaacggtgttatttatcgcgataatatttcaaaatgagtatatttaacggatatatttttaatagataattttttaatttatatatttgaattgagtgaagcattttttggatatattcgcagcaacatcaataaaatgaacacaacaaaaatatatcaacatttgtactctattcctatttccttttctctactcaggcagcacagtcatgaacatactgctactactctttctgtaaaggaagcatgtggctagcaagcgcggtggcgggtgagctggcgaggggcggcggcgggtgtgtggccgatggttggcagcggccgggcgggcaaagggcaactggcgaggggcggccgcgggcgtgcggcggagggtctgctgcggtgggtgtgtggctgagggtcggcggcggccaggcggatgggcgaggggcggcggcggacaaccggacgagggctcggatgggcggtaaggagccagacggcgggaggagaagctcgagggcactgctgcgggtgttcgacggtgggaggagaacctgggcgcgggtggctgacgacgggagctcgtgctatcgcgaaacctccagatctggtacgcctattcctccccaccttcactgctctatggctccagcagccagtgtacca

SEQ ID NO: 30318 - DNA, 12304 bp, Oryza sativa
  unsure (1)..(12304): unsure at all n locations
taatatggagcacacgctatttttagatgactagatggaagatctgctggagcatcaatttccttaggacggagtacgggatggagttgctgctggtcatgctcttagagttatttataggaactaaagtggcaacctctcttctctctcccttggtctatgtacctttagttcctggatccaaacagtaggggactaaagtttttagtcaagagagtaattttagtctagagactaaatgatctaaacatgaccttaattaatcatatgctaatggactgctccgttttatgtgcgcagaagatttgtttccaaccagtaggaacgaacacagcctaaggtatcatcagtctgttacacatatttttaggagcaacccaacctgtttatcatcagtaatttgccacaatgtgctgtaaaaagtgggactgtttaagcagagttccagcatgtgggctgaaggtatgtgtctgaaactgcacataaaattcatatataaggggataatgaaaatgtcacataagattcataaactcaaaggttgctaataatttaaaacaagatctcgataaatcatactcccttcatcctaaaatataagcatttttagtatagcgacaagtcaaacgtttttaactttgactattaatagcaaaaaaaaataaaaacatcaatcatataaaattgatgttactagatttatcattaaacaaactatcataatatgcaaccctttttatttaaaacatcttacttttatagatattgttgatcaaagtagtatctcggagactgttcagaatccaaaaatgcttatatcttgggacggagggagtagcataactgtacaagcgaaaatattcagcacaactgtaaaatcctaagttcactggttgagttcaatattttcgatgccaattttttttttgacaaagggcatatagccgtgctttactgaaagtttagggccccttttgaatcataggattgaaaaaatagaggaataggaaaaacacaggattttgataggaatgcaaatgtaaaacagagaattgcaaaacacaggaaaaacacagaaatgaccgtttgattggactgccggaaaaacgcaggaatcagatgagagagatagactcaaggaagttttccaagaggttagagtggatgttaaatttcctatgattttcctctagaatcgtagaaataggaaagtttcctacgtttttccttttttcattcatacgaatcaaaggcataaatagtgtaggatttcaatttctttgtttttccactatttttcctccaatccaaaggggccttaaggtttgagatacagcagttcacaactgggtttgccagctaaacaaacaaagcccagaaacacaaaaaggccttatcctgcaaagagaagtactacaaaaccaaaaaaggggcagaaacggcaagcacccgacagctacagaagctaaagcacaagattctcacacaacttcagcttcccacgttcatgttttggtttaacaaattgtttagtgtgccccaatatcaatacgatctaaaattacacaattatcgaacttcaatacaaagagaagtggcatacaattaacaaaacaatatgcagatttacactagcactaatacttttcacacgcaaaaccggttgaaggtgaagccacaatttttacctgaacttcacggaatcggcgacagcgcaataagacatcatcgaatcagggttcagcaacggcggggatgaccctggtgggggcaagatggggcaggcatgacgaggacaaacagcgcgggacactgtgccgacaaagcctccggatacgattttgctaaacgttagatggccataaggctcaaggctcggcacggccatctggcccgacccaaacatggcatggcatgactggtgacgggttcgtgccggcccagcccgacagttgagccatgcctgtgcagatgacttggcacggtggcgggccggcccagcatggcacacggtccaatgagtagcaagaaaaatagtagagggacccaaaataaacttagttgccatataaacttatcgcctaaagagaagagggatgcaaaataaacttataccaaccatataagacttggaaaaagtacaccgaaggtccctgaacttgtcatcgaggtaaaaaacgtcctcaaaccgcaaaaccaaatattcggcgttccttaactaatcaaaaccggtcacaataggtccttcggtggttttgaacccagttttatccgacgtagtggttgagtcagcgtgggatccacgtgggcgccacatgtcaggatgccacctcatttctctctttcccctcttctctcgcaggccgattagcaacgggcggggctgagcggcgcccgacagatgtggcgtgcgagcgcgcggcggatggcggagcatatcgacagcgggcgagtgcttgacggatggctaagccgtcgtacttccccactgcagctgccgttatcgggaggaggagccgccctccaccacgcgaggacgcatccgatactaatctacaagacaatgatggacgctccgccgagcaagcgcacttgcatcaccgccggcagcagcggcggcaacgacgatgaggccgatgccgatcggctaagctagctaccactgtcggcggcggcgaaaacaagatggcggtgcagtgggacaagctcgagtccatcgcctacccgctgctgctcacccaccgcaccaggacactcgagaggttctggatgtccgtcaacgtcgcccgcgggatggacatgggatgccctccgccacgtcgtccggtgggtgcactgcggtgtccagtgcttctccgcgccggtggaggtggaggtggtggcctagctcactgctttgtcggcgcccggcggctcgtcgacctagacctccccgctgcctccaccggtgactgctactactaccgcctccggaggctgcacctcaccggcgtctcgctcggaggccgcttcgtcgagcaagtccggttgcgacttccggtctggaggacctgcggctcagccattgcgccacgagcttcgccgatatcgcgtcgcggacgttgacgaggctggtcatccacggcaatgccggccgcggcagcggaagcagtggggagctagcgtcacggctccccgactctcctccctgtgcctcctctctcactggcctccaccgtgcctccgtcgtaggcctcggagccaccgtgctttcctgctgcagccgccgcccgccaccgcccgcggccatcgcagctccgccctcctcctctcccgcgatagagaagactgagagagaggaagggagtgaagagaggaaagagagatgaggtggcatcctgacatgtggggcccacgtgggtcccacactgactcagccgccacgtcgaacaaaaccagggtcaaaacagtcgaaggacctattgtgactagttttgagtagttaagtgatgccgaatatctggttttgcagtttgaggacatttttgtaactctatgataagttcagggaccttcggtgtactttttcctataagacatagcccaaagagatgagggaggcgaaatagacttattctatggagaagcataatgggctatcatgctttcgggctaacccggcacgacccgagtcttattgggccgtgcctaggccgttggttcagcttgtgggcgggcacggcccggcccgacgtgtaggtcgagccgtgccggcccgattgacctcgattcgggcccagtcgtgtttgggctgtgctaggccggatggcccatttggccatctataccaacggaactgcgattcgagcaggtctcacacgtagagtcggtgccactccttcagatcaatgcattagatcgcttctcagctgttgaatgaaatgcagcatagttagatgaatatagagctctacccatctcacatacaggcaccgggtgaggcttgtaccacgggaggccattctattttgtactataagtacagcactaatacaaggcaatcatctttgtgtgctattctctctttgcttgcactctttcaggatagaaagactggaaaggcatgtgaaccgtttgaaccggtagaaccgggcgattttgagtgaaccggctattaaaccacctggttgaaccgacaaggctggaccactctcaaaatgggccacatcaaggcccaattacttaactagcccaccttaccatggttcttttggcaaaaataagaggaaaaagttgctccatgaggactcaagttgagtcactcaacccctggtctccatgttcaaagcgagctgcgctagccaactaaccatccaagcaactatattttacaacacatatatagggagcatatattttgtgaatcgtggttaaacggtctgaccaacggaccggtgaaccaagggatcgaccgggtcaccagtcggtctggtttttcatactatggcaagtacccgtgcgcgtaggtgctctcaatagagaatataaatagaagagagagttcactctgctatctatcccggagatgcgaggttaaccagcacgagagaaacttaatggctcttctgtaacggctctccgccaggtacgttaaaaaaacgtaacacctagaaggagagcaccagtctcgtcttggcgcgcgtgtggcaatcccaccaccacctcaaccgcccaacgggtgctcttaattagcaacctatttaagtcgaggtccctccacattgctttccaatatgatattaatcccttaacactaattatgaattcatgaaatttactagaattaaattggacctagtccatttaattataatgtttcgtgaattatgtggtgaattagaaaaatgccaaccatgtcatttgacctgtccaatttctagatttatatggttactatgtagagatgcttttatctggaataataaggctcctttaatttctgatcagttctttgaagatgctcttatctggaataacaggagatatcaaaagtcaggaggataaagtgaagatgctgcttgctggcaactctggattaccaggaatcggctaatataaaccgtggaagaaggctcggctgctgggtgcttccacgtcagaatgaaacagtatgggatttactgttttcttccctttcagttgcaattggtttagaggaggggaagtgtttacacctaaatttggcacctagaagtaaaataggaaatattgccaaagtttagaagtatgtcggtttcctccgagtaggctggtctaaccgccgtgtgttggcaggtcagaccgccggttgagggccggtcagaccggcggcatgtggccggtctgaccagcaggtccgagtctgagtgtgtttcaccgggtctcgaagtttccttgctcgggaaggaatgtttcaggtttcctttggattctatcccgagttggacgtggatgagggtttgtagagggcaagaccaacccctatataagggacatgccggttcaattgtaactaatcaatctacaatcaatcaattgaatcgtttttcatattgcttttagttttctcttagtttgtccatctctgttgatttgcgccgtaaatcatccgccgccgctgtgagagtgcgacacttctttgtaggtttgtcctgaaaaccttccgttttacccacgagacgggtagttatctaggaatcggctccgctagccggtttagttatcaaaacctatcttggtatagcttttgctagatcgaagtgattggcgactctagaatcaccgcaaggcgtttaggtgttgtgatcgtgcttgtcaacttgtcatagaaagttgccaacaggaagcttacgtgataagaaatacgatctgctaattctagaattctacgcaacttttcatccgaggcatcgctactcactccgcttttctggtctctcttcacgcggcgctccgatcctcctgtcctctcaccgccgccaccacctgctttggcttggtcagtgatgatgatggggagctccggcgccggatcaagcaccgtctgtgagcgatccctgtattgatccctgtattaattcttttatgttctagggttgtgcggtctaacccggttcttggtccgacctccttctgctgcgcttcttcgcccgatctggtttcgcctgttgttgatgcaaggtacgaattggtttggattgattcagtgatgtttcggcgtggattgctgataccgattcctattgctattaattttggcaggaatattgatttgatcaagcgtggtactttcttagcgctcgatattcatgatctagggatggcaattgtgcccgtttacccgtttgtagaaaccccattaagattgggtatgttcttgggtattttgttgggtcaaatgctatacccgatgggtaaacaggcatgtgcataggcaaatactactcattacccactttgtccgtttacccgctaactaatctgtcatgtggggtcatgagttaatattatcctcatcaatttataacacatccttgcgttactatgatcttatagtagggtcatgagaattctctatagccatcggggaggatgccagagaccatccccaaatccaatctctccttactcccttcctattcgctcgatgagaaaatggatcatatgccactatatatgtggggtttcgtgaaatgcaactcaataaaatataatgaataaaataccacttagtatgttgcctaccagataaaatgccactttgagttctaaccattttatgaccaaaatacccctgactatagagaagggggagcgccagggagggccggccgggtagcaatggaggcctcactgggttgatattagtgatataccctataggcaatcatagagatgattgtatcatcgactttgttccttgaaatagataactcattattggttaatgaatatgtgattctttcatgagactctttatgttatgtgttgctatttctaaaggatcctgatcaaatatcatatgtggaacaaatatgtttagatgatcagcaaatgtattaattgatgatcatgtctcatggatcatggtatagagataccaaattaataatgtggacacatgttagtgaacatgttgttggatagacccaacatgagacactgcaagagccatatgtgttgtgtcatcagtgatctcatttagtgttgatgttgaatccttagacctgagattatcatggttcccaacatgtgtagtagcttacttagggactgctaaacgctactctgtaattgggtagttataaaagtagttatcggatatgctatgaaacatgtagtggaatatgaataatcaagatgggatttgcccctcctatggagagatatctctgggcctctcgatgttgtagattatggaagtgcatggccatgccaaaggtgattgaggagtcaatcacaagttatataatctatcaacaggttcgagtgaatgattgagctattagaggatggcacatatctagccttgagcttaatcgatatcgtgaggcaaaggagttcatacaagtatacactagagattcagccaatatgatctttatgtatgtccggtgggtcaatacgttctgctaggggccgctgttgtcgcgtggaccgaaaaggagttttcgggttacagccgaatatacatgaacctacagagtcgcacgcttaatgggccagaataaggggattggatgtagatccaatataagcttaattcggatagggatccgaataggagtcctacgggccttggaggcccgagtgatggatcctatatattcgtgaggggtgtgaccggcggaggcattgcatcacgtgagaaaccctagccgtcacttccctccccgagcaaaaccctagccacgcgcgggtgctagcacatctgcgtatggcgttccggccctgtacgtgtggataccggtagaggcgctgctggtttgcggtgctgatcggcatgggagtacggcgaggagaacacacgaggaggagaaggtcgagccggtgcgatcgactacttcctctacatcgacgcgcgctacttcgcaagaattccttcgacttcttagcgcatttttccgctgtacagcgcgttgagtggtaatgatctatgatctaatactttcatggttactggtttatgcgatagaacattttgatttatgctatcgtagcctacgcatatcccaacagttgaaccatcgcttgtgtggggaagccacgtatggccgccatggctagcccatgcacatgtcgggccaaactcaacatggtcagcgttgattcggttacaacacttccaaagagaagggcccctacgtactgtccggaaagatcaagcatctcgatcacggatctacctgtcgcctaccacctcaacctcaaacagaaggtgatcaccattgctgccttagccccaaagagaccgccttcgttgcggaaaccagcggtcatcgtccccgtatttgacaatagggtcagtagatccatgtcatcgctgccactacagccgttgtcatttagggcctcatcgtttggattttttcgtaataagccaaaacggcttattagagaataagaatgaatttgtagctaaaacttttatatatatgttctcggtgacttaaaagccaatgctgaaaaagaaactacgttgaaaatatcttaaaatcaatgtcaaaattaagtttgaaaattcaaattttggctttttctttggtgaatagaccatccgatggaagcttacatcttgctgggacttatggaatgagaaggctctactgccaccacggtccttgcaaccgcacagtctgctccagtggtggcgaagcagggaaaggactggaaggaagcggtggtagtgcaacatcgtcgacacccgagtcactcgacaagagcgacacgaggacaagatatctggtacaggggttcacaatcccaataccggatcaaaaatcactcatgggcgatatctttagattttgtggaaaccattgataaatcgacaaaatccggataaatcttgtcaaaaatttaaacttctgtttgattctttttaacttaactaaaaacggagcggtttgtttttccgacctggttcaggaagttcggaattcggattgtaaaccctaatttggtataactctgttaaagtgtaaaatagatatgattcaattatttagaagctctgaaaggaaggggattattttgtttcgaaacacaatacgggtccaggtaccaatataaacacgtgcacactcacccttaaaaatgcacatacacatcctacctctatgagtatcttcaagattgagctagcatatcacatatcttcatattcacaaagtcaccattgggtctcgcagtcggtggtatgtcgtgtaccagtgaaagaatacttagtcgtaaatgcgaatgctcatgttaagacatgtacctaaatggatagattttaccaaaaaaaatgaactagctgagctacgttcactttgtgaaaagaagaggattataattagagatgaaaactattggaaacggaatcattttttattatttttaatgaaacagtcggaaatggtcagagaaattctctatatttaagaatttcactgtttagtattaacttcagtgtgatggtgacaaaaattaggaaaaactaaattttaaaaaggtaataatcgataaagatatttctattatattaattatttaattttatggaagggagtagctatatttatggactcatattttttttaaaaaaaagtcagcatacatttacattgtaagtctctaaattacctatgtaattttagtgtgtttacaatgtaaataccaaaattacaagtaaatatcaaaatatcggtatcgatccggtcagaaaatttcctaccgttttcatctttaattataattcatctaagatcagacttcttcctttgttacacattcttatatgattcttataatagtgttgctttccactttgcctatcaactacagcttgttgctccactaagccgttgactatagcaggacttgtaaaggtgtacaaaagatatacacagtggcagacacaaaatattctgaaccttggcgagtcgtcgagcccggccgattgctcaggatctctgggcccctaggtctgccgctgaatgcaccctatctgaactcttgtcaatagatacaccaatatcatgaagaggtcctaggaacgtggaacagtaacaattggtgggaagaatatcagatggaatccaccaatttagtgaaaccatgacactaatactacactaaatatgcctacaacttaaaacaatttaccaaatgcaagattgatagtacactgtattatgtaaaatttcaagatcaatcttaatttcgctgggaagttatgaaattgacaaataacgaagcgagcacggtcgaaacaatttaattcggttgcttacgatttgatatcactagttatgaatttcatatatttcaaagaattgcgtagtattaaaattagcagattacctacacaacacatggtatgttctataactttctgaaaattcttcacagtttgtacagtggttttcacacattgattgggctggtggttccgcggtacttgacggtccctgctgagtgcccagtgcacacggtaccatcgagctggctagccacgatgagctgccgattcactattgctctcactcacgaatttcgattctgtcagcgaaatataattacactcagattaacagatagccagagagggtcattaaaaaagctagtaacttttcacattatgtgcatggtggttattcacatgaaagggaaaaaaaaagactagaagtgctttctcttctttctttttttttcttttttcttaatctgatctgaaagcaaaatttagacccgatccagaatcccttggtcctcctcatttgccatggccttgtcccctttcttgtactccccatagacgtaggacgagaaggcccagaggcagagcagcatggccaccgccttctccggcccgaactcgtcggcgaacaccaccacgccgtcggccacgttcaccgccaacagcgccgtcatgcagatgccgccgtgcagggacgtcgtcaggaacaccgttccggcggtgccaagaaagcacagctgccagctaagcaccgccgccccgaccaccgcgtagtaggccgccggcgacagatcccacgtggcctccacgccgtcccacggccacttgccccccgcggacgacaccatgccggccgcgccgacggtcgtcgccaccgcctccataatcacctgcgcctccaccaccatccggaagcccgtcaccccgccgtgccggtacacgagctcggccgccggcaggtagagcgcgaagagcaacgccgcgccgagggtcgccgcgacgccgacgaggtagtccgggctggtggcgtccgcgccgccgccgccgccgcccgcgccgtggcggagcgcgaggagcagggacgagagcgtgaggagcacgacggcgttgaagttggcgaaagagagcggcacgcggacgagcgccgcggcgagcgccagcgtgaaaaccacctgcatggagnnnnnnnnnnnnnnnnnnnnnnnnnnnnnnnnnnnnnnnntgccgcacgagtagagcaggttgttgagccccatcaccagcccgagcaggacgcagtacatcaccaggcgcggcgtgaacccggcgaacggccgtgacgccggccgccgcgcgcacatcagcggcagcaggagcgccgggaatcccgccgactggacgagcgtggccagccaccggtcggcgccgccgtgcgcgaagtagaaccgagagagcaggctggacgagagcgacccgacaaacaacgccgcgtagttcgccgccagcagcagcgcgccccgcgccgccctgctcttgagcacagggaactccacggccgccggcggggagcagagtaagaggcggtcgtcatggtgggcgtgggcgaggaggggagtggtgggagagtggagcttggcggctgtgtccatcaagagtggaaggtaagggagggggagagggacaggatgggggtttgcagtttgctgccttccttgatgtttatggtcgtctgcaaaggcagagaggcatatttcaagggattttgcaaggtattttctgtgtannnnnnnnnnnnnnnnnnnnnnnnnnnnnnnnnnnnnnnnnnnnnnnnnnnnnnnnnnnnnn

SEQ ID NO: 30319 - DNA, 3493 bp, Oryza sativa
caagggattttgcaaggtattttctgtgtaaattgagcaccgttatattaaacccaagttggtggcacacgacatggactcgtcgatgatggatcgtactacgggtactccagtggagtgcaattatttgctctcaaaaggatgccgcccttcgctatcactgatgtgtcccttcttctttttttccccttttcttttggggtcctacatggcaacatcctccgtatagattaataagcttgtgtctgaatttcccttgaatagttatgtattagtactagtctccaacgatcaatcatcagctctgtatgtattactagtaggagtatctctgtactctctgaagaacgaacgatggagtatgtagtgtgtacaagtattatttctttcccctctgtttttggatgattgctggggaataatatctcgcttgtctcacatgtgagacacaagggggagagaaattcctgtgtctgtgtgtcaggtgcccggaaaactcgctagaaacgtctgtgctatgcacccagcagagcactgaaacagcacattttttctggcatccggagcgttgtcgttaccagggagtgttgggggcgatttttcttttcttcacagctatgacgacatcgcgtgatgaactggtgacagacaagcttttgttattggggggatattctgtgctgccaggtctgttctttcgtgcaaacatcttctgaaagaagtcccctatagtgcagtgcaaaattacgcagaacatccgtgtgcatcaaagtataatttagcatcaaagtatgcataatttatacagtatgcttccaaacacaagctacagaaggcttaaacaaacacatgtacacgtcgcaatatagtactataatataatagagaaaacaggacgagaaacagcaggcgtacgttggacagggagaagctttggtggaaggtttcggtgggcatgaaatcaatcggtcagatgggatctactccctccgtccttaaaaaaaaaaaatcctaaatttccgtgtccaattgtaattgtccgtctaatatgaaatttttttataattcgtatttttattgttgttagataataaaacatgattaatattttatgcgtgacttgtttttttaattttttttataatttttttaaataagacggacggtcaaacgttggacacggaaatcagggtttgtcttttttttttttttttttttgacggagggagtatatctgtatctatgtatgcagaagaagaagaagaagtgaagaagaagatgcatggtccatctgccggcggaggggcgcgacaacaaagtgatcgaaaaggcagcgacctacctatgcagatcgtaaaacatgatcggacatgggcccagccgttgcagcttttcaagagccgattgcccacagaccgtgggacaaaaacctgcccacttgatggctttccgcatctcgcttctctcggagtagctagtgggcgcagcagcagcgcgtggtggtgggtaggcgatgaatgtgaagttcagtggtgtaccagtacagccgcgcctgggtcgtccctatcaacaaatagaaggggatttaggctctgaaattaatttaggctctattctgtgctactttctttttttattccagcaaatcaatttattacgcctaagaaaatgtattacgtccatctgcgaaaatattcccaccaaattttctaatagtatattttaatcaataatgctacaattaattaactaatacataaatatatggtaaattttgctataggacattacgatttcgtgattttagccgtaagacactgtacaaactcccttttgggagaagacactctctaaacatggttatttgccagcgaacaccgtgccgattaaaatagtatattcgtgctgacgaggcgaaagctgaaagggggctcaaatatttacacagagtgaccaaattgcccctcatttctctccatcttcttctcttcttcctccctccccagcatcaacgcaacagaggagccggcatcgaggtggcggcctagaggaggcgagggtggcagatccacgggcaaagcctcttgctgcaccgtcgacgcaccacctcaagccatgggcgcattagcagcatccgctgccgctaactccggcccatgcactgcatggctctgatgctccgcgtccatccctgcatggcgccctagctcctcccagcactcctccgcgccaccgcttctccggatcgaggacaacaccaccttctccgtcatcctcctcaattctgattccgattctggccagcgtcctctcctgcaactgtgccattggccgactcattcctagcttcctcgtggaccccatcgtccaccccatcggcttcctgctcggcatgccggttttctccaccccgactcgtccgcaccgcttcaccacgccggtcgatgccgcccttgcctcctccaggccaccttggatccacctccaatgccggctcccctgaaagaggatataaggagctaactgcggaagtggaggagtagtggtggagccacgttaaaactgtagggtcagctgaccccacatgtttttgcaacatacaccttgatcatgtgaaaaatagtgaaaaagtacataaaacaaagaaaatttgtatggattgaccccacatagttgcatatttatgcattttgaccccacagggttgagaacttggctccaccaatgtggaggaggcgaggaaggagggctggccagggagccagggcgcgtcgctgcttgcgcatgctgaagggagtcgggccaccatgctactgcgacggaggtagaagggggggggaggagggaggaccgaccccttagcgtgagcccgggaacaggatcgtgctgccccgccgcccgcgcgtgctaaggggagcggggccaccacaccaccgcgacggaggtggaggaggcaaggaaggagcgtcgggtggttgccagcagcgagcggaggtggtgttgtggcttgagtgtgagagggagtgagttgtggggaaagaatatgtcaagtgggcccagggctatttttgacctttcacgctatttatctctcctattcaaccagaaattaatattttaatgtttgcagtgtccattagcaaataaccatattttgagagtgcattcccccaaagatcgacttttgacgtgtcctaaagctaaaaccacaaagtcgcagtgtcctgtggcaaaatttgcctaaatatatctagcaactaatagacatgtaatacggatataatacacatatattgtatgcattagtgaaaagtgcaggccatacaataagatttacagtaccgtcataattatggattatattgttaattacacaagcacatgactccactccccaagaaacttggactcttcacttatcgctaagctgccttcgaggttgaagaacagtccatctttatggtagcactcatggtggatgaagtggtagagg

SEQ ID NO: 30320 - DNA, 5897 bp, Oryza sativa
  unsure (1)..(5897): unsure at all n locations
nnnnnnnnnnnnnnnnnnnnnnnnnnnnnnnnnnnnnnnnnnnnnnnnnnnnnntttgcagtgtccattagcaaataaccatattttgagagtgcattcccccaaagatcgacttttgacgtgtcctaaagctaaaaccacaaagtcgcagtgtcctgtggcaaaatttgcctaaatatatctagcaactaatagacatgtaatacggatataatacacatatattgtatgcattagtgaaaagtgcaggccatacaataagatttacagtaccgtcataattatggattatattgttaattacacaagcacatgactccactccccaagaaacttggactcttcacttatcgctaagctgccttcgaggttgaagaacagtccatctttatggtagcactcatggtggatgaagtggtagaggtcccgctatatgtttttagtgccttcatcatcaaagctagttcgatattcgattctagacaacagcatgcacgagaatatatagcaatatcaattagatgtgcattctatcattaaacttatactttgagttgagagaattacattaacccggaggaacacgcaagtataatatccacaaaggacacaacctttaggttccttgtgacacttcattatgacatacatatagaaggaattagttatacacgcaggcaaaagaaagtaagtaaataagtgtgtagagtatgtttagtaattatattctcatatgtatgcactagcaacttctccctccttgccagttcttcctcgccttttgctttgtagttgttgtacgcactgtacacataataggataataaagtttgtattaatgaacacaatttaataattattaacacttcatgatagtacacatgcaaggataagaatatcttactattaattgaaagattgttagaaattgtctatatgacttgtgattataatcgagggagtcgaggactgtaacagtcccatgcttcgggtagagcaagaataaatgtaatgatcgctacatagtaatgatgatttagttaatcatagattaaataaagatatatacacagatctaccagacttacttaaaattttatctggctattatgactcttctatcttgaaaatttaggaatgcttgtccaatatagatggccacaataagcaacttggttttgtgcaagccattcttatattcctttatctctttaggtgtcttgttcttaagctatttggaattttcttggagagtgatgatatgatgtgtttgacaaatccttgttcggtccaggtaaccgatgggttgtcgtgtcttctcatcatccatgtattgcatcctaaaaaaatgattattaatcattttcgggattatattgtctatttatttctttgtatgaatgtgcatttatactcacaggcaccatgcaaccacaaagttcacgtccatctttttacggcggtacacgacgtgaaggtcagcgaaatcgagccataaaaaacctacaccgctcatgaaagcttggggcgatgttcgaaacgttatggacgtaagcccttttttgctagcatccctgtaccatttatgtaatcttctcatctcctgtggaccttcttcaagcatgtgattggaccagacgactttccattttcaaacttcgccggtacttcatccgttggaatgtattcctctctagcaagttcatcaaccattttctgatcaatcaagcattccttggcatgttttatcccaactcggaaggtggttatcatccacttctccttttgcttattctctgacttgggggttgtggcttcgtagcacactaggcactttggacttattgttgctgttgtcatcatccttgggtgtgtctatgtcctctttggtggggcattggtcttcatacacatcgagttctatttcttcccattccatacccgttgtgtcttctggatcatgttggacataggacacaagttgtacttcggtttctggtctgtccatcaattgatactatggctgatacagctgcttccccttggctatttgcttgttggcctgcaagttgctcacttcaatgtgtccatcacaaggtgccacctcatgttctttgctatctttttcaacctcatgaggggccgatttcttttgtggaggtgttggtggtttcagcggagcatcgatggaggtcccaaagattatatcctttttgtgccatagtattatatattccaccgcatccccaagtacagctaaaccatcacatgtcaggaagtctaaatcgtatgtcttgaacccttcattcacatgttgtggttgcattttcgcataatcatctggaatataatcctcatgatgaatgcggccagggatagccattcattttgcctcgatacaacgggccaagtgcaattatctgaggaactatataaaccatgatgtgctccatcatattaaaatatgatgcaggaaagcacatctcaagtttgcacttggtctcatgtgagaataaacaatttagtgataacacttcaggattgatgagcttctgtgatattgcattaaaaaagtagcacatctttgtgatagcaacctttacatgttctgatttaatggcccttatagcaatggcgagaagcacggtgaatatgacatcaacaaatcttatagtcatgtgaattgtcacaggatatcaacaaatctttcatgaagactagtcgcctgatgtttgatgagaaatctatgggcactttaacaccgtaaaggcacttgcaaaatgccttcttctccttaggttaatgtaaaatgccttcttctcctcagatgttaatgtgaaataggctggagggagatatactttttaattcttctcaccttctatcgggtgtagctcttacttgattcccatatttattagataggtacgtgatagtacactattctttgtcttgtttggtatgtcaaggacaattctgacagtgttatcaaacacatttttttttcatagatgcatgaaatatatggcatagcaaatctccaaatctttccagtaccacatgtactcaaagaaaatcgatgcttcttgaatgtgggacatgatttatcatctggtttcttacgctttgttccctccgaacattttttcagcccttttccgaacacgcattgtattttctttgtaatggcatgtatttccttcctagttttatgttttggtggtggatcattctcttcgataccatcgaattctgacgtcatcttgcggtatttatgatttatgtgtaagaaacgccggtgacgcatgtaaacaagcttgttggaacctagaaggtaactgtagtaggacccatttaagcatatcacacatcatgttttcactttaatctgccccggaactgaaacattgcggggtaattgttaatggtaataaaaatgatgggcctttactgtaaagtattgtcttaaatactcgtcccacacattcatcccagcttcccataaatcttcgatatcttccgtcaatggttcaagaaatacatcaatgtcaataccaggctatcgtgggccttgtataaggacatagagtaaaatgtacttttgcttttgacaaagcccatgtaggaagattttacatggtcagaaacactagccaagtgctatgtgagctgctcatgcctctaaaagatgaatcgtgatatgcaactgttgaattagcctaaaaccagtaatgattataattccatacctcagtaggtgtggaataaatttcttccaaatccctctcaatccatttgtagcccagcccaaccgacggacgggcccacttatactttcatcctcgcttcgtgtaaaagggttaacccgggagtagcatggttggagggacaatgccttataagcttgtttcacccgtgctaaactagcaaggtggtactgttaacagtgaatttgataagcccggagtagtcatcggcttagagtcagcatcggcttcgaagtcctgagattagccgatgagagttgtcaagtcgtcagttgtcggattcttgctatattcggttaaagaaattgatctactaaagaaagcttatccagaagagaccgagttcaaagagaatgcggcatggcaagttatctattaattaggaatagtttgttagtttccttttatctttaggaaagtgtgtttagtgtcctataaggactttatcttttccttttatctttaggaaagtttctttcttgtccgacaaggacttttatcaacccatgggtataaatatgtacacccggggtctatgtaatctatcttcacgatcaatataattcggcgcatcgccaccttttaccttttctactttattttatcgtccggcgggacttggcacctgacgcggggctgcattggtgttcgatctccggctaaggggtaagtccaatgttccgtcggcccaggcaattgtatcgtttacgtcggtgtcgttcaaggctgcatcagtacattcgacctcttggattgctctggtttggatgatatatttgcctaccaatttatcaaatgtctctgttaatctagtcttagcatatcaatttagctctatcggctgcttctcgttttagggtttctgccggtatcggctaaatctcgttgctagattagattagcttagacatctaccaccctgaaaactcagtcaacggcttgattgtctagatattatgtttcttttcatacttagtgctgcatcaattaagtttggtctactaagtcgtgcttagaaccgtaatctctagcctgcttcttgattgccaataagggtttcatcggggtttcagccggtgagttatctggacgttgcatcggctcataaggattgcatatacatataaattggatttagtcgatgacaacaaaggtttcactgtttaatctaatcttgtggatttcatgacatcggacctccagccgatgtgtgctttaaccttcggatcgatgcttatttatcatatcattatttgccgattggtttctactcgactatattgttattacatcatcatcagccgattgcctttatattattatctacattggacatatagccgattgcttaaaccctatcgctatcggctggtatcggcatcggttattatcgactatcggctggaactactccatcggcttgtcagccgatcgactgttttgatctactatttgcatatcttgtcagttgcaggatcaaactgactggcacactcgcatctcatcaagatttggacctgcacaggagctaagcagatctcccaggccggtgtgttcgaatttttcgtcaacacaaattggcacgcttggtgggaccacgaattttatatccacatgtatgaagaagaagtcaatgccaagatcatggtcacggtggagaatttaatggaggaacaacaatattggctcggggggcaagcgcatcagttttagcatggtggagcacatcagtatcggctcatgaaactgttcaaaaaaatgttatatagaaaaatgaccaaactaaaagttgtaaattttgataagttatacaactttgttgttgacattttttccatttgaaatcatttactaccctgaagttattttgagtcataaaatgaattattatactgcacttaattattttgctatagttcaacttacaaatataaacatttcatacgaaaaatgaaaaaaaaaaactcatcggtgacgggctttagttaatgcccgatagagattaagtcatctcaatcgggaattagtatatagcccgtcaatgatgagtcatctgtgatgagcctagttgttatctcaaacgggcctcaagttggtgcacgtcacggatgatggtcatctgtgacgggc

SEQ ID NO: 30321 - DNA, 3882 bp, Oryza sativa
ctattgttgtcttgggagctttgacgttatggaaacatcgtaattgttctgtcttcgacggtacttctcccaacatggctgaagcattgctacttgctagagaagagttgtataaatggggtttggcaagggctaagggcattcttgcccttgtgccgaacactgaatagtgtttgcttgtagtaggttgaggttgtcttttggtatcgtgaaggtctattgtgtgtgttgtaagggttcttaccatctcctttattcttcttaatataacgatatgcagctctcctgtttgttcgagaaaaacaattgaatttgacataaacatccaaatctctaacaataccacggtaactaatctttaacagttttgaaggcatgaacccactacaccatgacttagtatgatgaggacatccgcaccatgcatggatataatcacgccaacggcaagcacacaagctgaaccagtgattaaggatcaatcgctcgagctcgtgtccgtcaacttaattaccatgtagggttgcataagaatgatttactgaattgggtagtactactaaatgctagtggtgatgttattgtgattaggaatgacggtagagatgaacaaaagctcaacgaggatgcaagatagaatatttcggttcagtttgctgcaccaccccaaattcaaacgagcatacccgttgatctaaaaatccatgtggggatttgatagaaagatctcggaattctctttccgacggatccaaccaatctgaatcgtaagagtggtttgttcctagaaaccaaaaccaatggtgttgcatcacctccacttgggcagatgggtctggtttgtcgtagggcgacgtgccatgtcatacacactgtcctagatcacttcatgtataaatactaagccacccccttaagttcatttggtgttttgttagatcataatttaggcattgttacttcatcatgtaattgtgtgcagttggctacatcacttggttacttgtctttggaacatcttagtaatgagtacccttaagttatcattttttgttttttatttttttttcttgccagttctcgattgctcataggaatgagtaccttcgtggtttggttgattgttctccatcaaaatcactaaccttttctgaagttggtgtactggacgctgaggcgcaacgttcttgaaatcatgattagtgagcatcgtttcttgcaatcaaatttatcaacatcttagtacaattcatctgccatgaaaatatattcttggcacctactaattactgcatcattctttttttacttgtcaatttggcaatcgacacaatttctaatgcgtatatatatatttgattattacttttactaactatatgtttataaaagatattaaactagtatataaaagtgcatttcatgaaaaatctattaatatctttttttggcactttgaccatactttttcataaattctattaagtttatgagattatgaatgctattttcaacataaatattcatctaccatctttatattctgaaactaagtattaaggaaattgagcgtcaatgtttcaaaaaattaacatgaaaaagtcaaaagatttttatttgctagtctgacatttagcatttttgtcgtacaaactaattatcgttttgcagcaacgcaggtagtatttgtgtaggaaatgattaattacaagaataattatgattacatgattcatgtaatataagtcaaataaatatatagtttctgagaagaaaatgaagagaaataacttaaattattatgaggcaggaatgatggagattccaggaaagtgattcgatatgctgcagaagctagtactaagatcgccgacaatgatcagctgatggatcagttagctctttttttttttcgcgtactgtgtagtgcttctccacattcttaattacctaattaggtttagctgctctcgggaatgtcgacatgaccaaaaaagaagtcggtacggcgcaacctaacagactagtgtgatgtatcagagcgaatattaaagtgcttagtatttagtttaggggcttaatctgacctcacgttgtacgcgattgccagtctatagttctatactgccagtgagccatcagctgagagcgtatgacttcacatatttgtttatgtttcttcttattttaaaaaatatcgtatgacagcaacatagatacacctggtggtagctactgcaagactagctagctagtacaagaaaaaaatagggtaattttaccatttctgaggaggtacatagcgatattattattttctagtataaaatttagtacatatagagtatctaaagatataaaaaattttagtgtaaaatttagataacttaaagatactttcttctcaataaccgtaaaattcctcaaaaaataattaagcaagctacaatagtcggacaatgagtatttgcatggttcacacggtctatatgtttttattttccttctgtagcatacaccacacgcacacttaataattttgcctcgtaatggtttcaccttctctcgatgggctgggcaggtcggcttaaacatgccccatgggcctcctgttgccggtcgttaaacccaactcgaccgtcaattgttttcaataaaataaagaaaagacaacatatgctattgttcttactttttaactcacatattttcacaagttttgttggtttaacatgtttcgcaattttaagtcataataagatcatcctcggacaaggagatcatcaggaacttgggcccaaagttaactttggtccctaaacgttcccatccaaagcccctagaaacacctgatgaaaatgcaagtattaaacaaggcagttgcattagcatcggaaagaatctccacaatgttcaaaattttgtatgaggaacaacgaataatatcaaagtttgtatgagaaacaagcactactaaagccatgttgatgtaagtcacgtcttgcttgttgcagacatggcttcgtaagccttcatacaatcagatatgaagaggtaagtattggattgtgcattttttttatttgtttggggaagtatatacgatgcgcattttttatttgtttggattgtgcaagagcttattttggtgtacttgcaagaacatgatggacatcaggacatagaggcttcacttaacatggcagcacttacatttacaagtggattgtctacaccttacaacaatttacgaatgatatacaaacagcaggtactagtgatgccaaaacaatcatgacttaagccaatatgcgtttcttttgtttatatcgattttatattttttccaaaccgtatggttccaaccctggaggatgtttgcgctgcaatcagatgttcgttttccagtatactttgctccttgttcaacacaaagattatatatgctttcctacagagaagtaaaaaagatgtaacatcacatctttcaagtcttcctgggacttgactaactcttcgagctaagatgctacaggattcatttgccattctgttactaatcctcaagaaaaaaaaaaagaacatgtaccgtacaggaaaaatttgaagattgaatccaacaaaacttagtcaatgtggttagactgactgtgtcggaatcctttcctcaaatactctgtccctagccttttcagcctgcaagcaaataaccaacagaaagataagaatgtaaaacgttcagaacatagtataaaaaacaaaatcaattttttatatatatcaggtatatgacttcaagaggacttcgttttgtagactgaaacgtggaaaattggttcatagaccattgcaatataccaagacaaggaaacattgataatg

SEQ ID NO: 30322 - DNA, 449 bp, Oryza sativa
  unsure (1)..(449): unsure at all n locations
nnnnnnnnnnnnnnnnnnnnnnnnnnnnnnnnnnnnnctcaccttgttgcgctcaccatggggccaatagtgcccgatgacctttggcatgaactgcagcttgatttcccggttggcatcaaggacactgggtgggaggagcctctcaagggcactgtatacaggtggtgcgtactcgccacggacgtcgctgtagacctgcggcttgtgctccatgttggggttcaaccgcagccgccgatctgcgcacgccggcgccccggagggccggccggccggccgcaacggcggcggggccacgccgttgccattacccatcgcggcctgggcctcgtcccgtcgatacgcggggccgtctagagccatggggcacgcgcggcggatcacagcatcgggaggactagggtttgggtgggcgaattgggtgtggtgtggggatctaggctttg

SEQ ID NO: 30323 - DNA, 540 bp, Oryza sativa
  unsure (1)..(540): unsure at all n locations
ttgggccacaactcagcccattcggctatatgttaaaatacatacaattcatttcatgaccagttctataaatttatgaaaatatacttatagccattatatattatatagtttagaactatgcgaaactatacatacatatcatttattaggcttgatattgtatttttttatcccttcatatttcgaaggaaaaagtccactttgactcccttaaatattggccgaatctaattcgtaccccttaaccagaaaaccggataagatggctccccgaactattgaaactgatgcaatttgactccctaggtggttttgcaagcggttttggctgatgtggcgcctatgtgacggtgttgacccggtcttcgtcccacgtgtcgtcgacatgtagctcatgtggaattagagtaaaaacaaaaaaacaaaaatttgtaggaccaacatatcatccacacacacaaaaaaaaaaaagtgggacccaccgacatgtgggccccacatgtcatnctncctctccttcccttcttcctcctccct

SEQ ID NO: 30324 - DNA, 330 bp, Oryza sativa
tcggctgcggcgcctcctcctcttgttgttgctgcttttccccccttctctctcgtgtttgttcttttctccgtgtctttgacggagctatgggctaaaataaataaaatttaaaaagaaaaacaaaatcgacaaatactctctctgtcccatagtgtaagggagtagtatacaagaagggggcggcgttgcgtgtgcgtgcctgacggggatagggccgacaacgttgttggcgtacgtgaggcggcggcagctcggtaggcgtgggcggaatggcggcggcgacggcgcggcggtcgaccgcgtaggtggtggtgtaacaccccaggt

SEQ ID NO: 30325 - DNA, 452 bp, Oryza sativa
ccgtgtttaccacaagcggagtgggtaactgcttgatctgaagtatagctcgaccctttcctaggcatcggtggcgagggtgggcgtgatgtagttgggtcggccgggatatccggttgtccagctgccggattcaccgcggtgcacgaggggattgctcactgccttttgaggggtgggggtgaaaccttagcgtggtgtggatggttaggggagggttatgcggagggtcttgcacgatttccccctttgtagtatcatggtgatacttcggggcatggtgacatgtgtggaatcgtgtcttgtgggtacagctgtacacctctgacaagagtaaaactattcgaatagtcgtgcccgcggttatgggcgatcaaccagattcaccatgatagtctcacccctagattagcttaatgaactggtgtcgttcaggtggttggttgggccta

SEQ ID NO: 30326 - DNA, 1579 bp, Oryza sativa
cctgcaggcatgcaagcttattattattcactgtcatctagcaatacctgaagcgaagcctatttcaagttcaaaggtagcagacgactgactttgcattcttacaaacttacaccaaggtccgaacaagaccaccgcaaaaggctagggaaattgcgtcatatgcttgccaccagtcttatgcgtcattaagagcaaggactcctgggagggtcttgccttccaacagttccaagctcgcgccacctcccgttgaaatgtggctcatcttgtccgccaacccggccttctcgacagcagcaacagaatcgccacctccaatgatcgttgtaacacctttggcggtgatatcagccaatttcttggcaattgcctgaattgattaagaacacatttagcttcaaacacaaaaacctgtgctgataaatctgttcaaaaacagtactcacatcagtgccagcagcgaatttctcaaactcgaacactcccataggcccattccagatgacagtcttggtagtatccaaagtttcactgaaagtcttgatggagtctgggccaatatcaaggcccatccaaccatcagggatagcagatgctggaacagtctgcatatggtttcatattgtcagttctacaggataactgcagaattgtagtcgcaagtactctctgatattgtttgtttgctgaatccatttaccaggcaactggccatacagaaggcgaatgctgaatgcagatatttggcatatgacgcagtgaatttaagccatgatttatgaatgactacttcaaaagaacattgccatggcagcaagttcacatttacaatgttgtgctactgaaaaaccattttcatatattcaactatgattgtatgatgcagtgaaatgaaattcttatgcagtgccattcacgaggtaatgaacaaaccttgctctctgcatccgcagcaaacttatcagctactacaatatcagttggaagcaatagggagactccctttgacttggctttttcaataagcgaggtagccaattcgagcttgtcttcctccacaagagattttccaacagcgtatccctgagccttgtaaaatgtatagatcataccaccacccagtatgaggatgtcaacctttgccaaaagactctcaatcaccccaatctttgttgacaccttggatccaccaacaatggcagcaaatggttttttggggttggcaacagctccaacaagatagtcaagttcctagattggtgaggacagttactacaaaattttaaaaggattacatatttcaaaaaatctcaaggaaaaacagcttgaattcattgcggatacaatttaaaagacaatatgcaatttggcaaaaagaatgtagttgatttcaacatgtcttgcaacttgtcactcaagtactgctgcaagccatctgctgcttgcaacttgaaggagtttcattgttctaaatggagtatatcagtaagtaaacaccaaacgaaattatgttcaccaaacagttatgtcaaaacagttcagatggtgaaaatcttgagcaatgcacaaagtaagg

SEQ ID NO: 30327 - DNA, 27995 bp, Oryza sativa
aagatcattatcccaagcatagaatcgcaggttatgctgctgcccttttttgaacatacaatttcagtttcatttaccattttaacataacccaattatatggcatggggatttttgaggactactgcactttaaacatgtggctctttctataaccaaaatgttacagaggtggattttgcatttgacttacacaacataggagaaccaaagtttaaagaaaccgtggtgcattacagtgattttgtaaaagggaattgtgcctcttgcaagcaagtgttgggcattgatggaaaccattaataggtatttgtatcaaaattagatatacataataacaacacaattaagtaacaaatgccacattctggtagtaaaatcgcaagataaataaaagatcactcaaaacattactctgtgaaatcatcgctcactgtaatcagtctaaaaatacagtattaaatttatattgacaccttaacctcctatcgtaaccatgaatctgcacatagttaccacttaaaattcactgtgaacctatcaccctttgatgaatcataaaatcgatactgtttatatagcatgtcacatcatccaaaacggaccaccaatctcacatatcacacaacctcatgctcaaacacattatagcaacgtagtaatcctcaccagatggctggccaggatgaccttggcgcccttccccatcaagaacttgatggtgggaaccgacgcgcggatgcgggtgtcgtcggtgatcttctggctgtcatccagcggcacgttcagatcggcgcggaggaacaccttcttccccttcagatccgactccgtcagggtgcccacgctcctcttgctcgccatttctctctcgcgtcactacacgctgcaccaaatccgaccccgaaaatctcaaaaattcgcacgacggccttgcaatccataaatcggagcgatcaggggagatgaggtaagatttacctgccaaaaaaaaggatcgaaatcggtggcaaagttcgtcgccgctcacgagattggggtaaaggagagtttggatacgaggaaggcacgggaaggtgctgggcttttctttatatcgtcgttgcctgcagttgtgccacctgtcaggctccttgatacgtgtgccagtggcatgtggagccagacgaaatgtgggtcccactgcacgtcaaaggttttggacctttcggggtttacgctttcggcgccgtgggttttggatgaaaggatttgttctggtatggacgagtggacgactcagattgtactggagttttgaacaatttttttcattaacaactaatatgagacggtgccatgatttatttacgggatagatctcaatagaaaactgttgaataatggcagcaagtgattgagttaaaaaaaattactagactaacatcatataaaatattaatcagaaaagaaaagaaaaataaccacccgagcagcgtctatacaaaacctagaagaaaactaacacaaaactcatcactagactaacaaagaagctacctataacatactctttttataacaaattatactccttttataacagattgatggctttgggcatgcctttctagtaaccattaaaataaattatccactagagtaagatatagacgtgtttaattcgtagtagcacttcagttaagtaagtttgactaacatatactccattactttaatatttgacttgccaacttaaagtactttgagtaagccacttagccacaatatttagctagaagtctctacttcacttttctgtcaaaaattgctggcatatggttgatttcttaggttcaaaaattgcaaggctagcaccctgtaaaacattaaccaggaaagaaaaaaaccaccaccaccacaccaagcccgatagtgcctatataaaacctaagagaaacctaacaccagaccagttaccgctaaaccaacaaagaagctatcttatatgttgtgaactatatgatcaatggtggattttatacgttgatggacttttcatctatagttgctatgacacaagtggatcccacctttacactcttgagaaattatacattagacatgctctcactacatcaagcatcctagtgattttcatatcctgagaaattatcctacaattgtttgctttgtctgatctattccctatctccctcctttttatatcgtgttttttctaaaagtcaacttcttttagtttgactaaatttatagaaaaaactaatgagacataaatagcagtatgacttaaaaaaagtcaaaatgttttttcaatatgaaacggagtatgcattgcgagtctgcgaccctaataaacaatatgaaagggagtacgcattacgagtctgcgaccctaatcaataacatgaggaaaggtcacatatatagaaatttttcgcataaaatacaccgtttaacggtttgaaaagcgtgccaacggaaaacgagaaaaaaatatgtatctttataaagttagaacgggccaaagtaaaaatgatttgaaatgcgagaaagataaatattttttttaaaaaaagttaaatgctagaacaataaataaattaaaactgatggagtattgtaattgggaaaattcactattttcttcttcaaatctcgagctcgcaatactcaactctatctaggaacgttgttctatcccgtacatgttccggttacagaacagttaatttgtacctcagaaaaacagccactagaaggtcattcagagcagaggggcagctatccatgagaagcttgtaaccctccgttgcagcgactgcgtggaaattctcctgagaagccaagatgaactcgatgcacctagccttgagcttggtacatccatggcgctccggcagagccaacgccatcgcggcggtgtccacgctaatgccagcgtgcaccttctacgcgcagatcagcatcagcctctccacgccgtaccgatccgcggcttcgagaagaccatacgccattgtttcagcctcgacgtcgtcgtcatcttgctccggcaaagtgtcggtgtagatgaagtggagcagggtcctgaagacctctgcctccatgtccttgatctcgatgctctgcgagtctttctccttcatgtcgccgaacagctcggccatgaacaccggcgacctcgcggcgagcacgcacctgtgcgccgcgacaggctcgccggagacgaggaacgtgatgtcggcgccattcttgctcgtcagcatctcgccgaggtgcttctgcaggtcggagagaggcgccggaacgcttgccgccgcgttcactggtgcttcgagcagaacggtgatcgcgcactcgatcagcaaggagtcgtctggttggacgtatctgtattcagacgcatagctcctcgacaccaagaacatgtcctttggttggccattggagaagatggatgtcactatcacctccttgaaagagctggatgcggacgcggcggtttgattgatctgatgatcatcgacaaggcggcatctgaacgtcgccgacacggtgcgctcgccgtcgctcgacaaggtgaagcgcagctttatgtaggggccggagttgcgggagctggtgccgtggtagtaagcggccgggaagacctcgatcagccagtcgtatccgcccacggcgatcgtacacgacgtgaccaaattttgcctgttcgcggtcgccgagtacccgttgatcctgagcagctacacgcgccgcgccgcctgcgtgaggttgatggcggcgttctccatgtctctgggctcaggcgtcgatcgagcgttaactaccggctatatatatatcccttcgtggatttcaaatcgaaacgttttatcactagatttacaaagagacataacttgttacaggagtctgttttagtacccaccatctacaattaataacaggtatagttcgcaaaagcaaaccagaaatatacaaatgtttcggaaacaaggtaaacaacaagggctaaaccatcaatccctaaaaatttcaatgaacatccaactaatttttcgttttttctccttttaatttgtccccttgatgaactgaacttttagacgagccggagatttgcaatgatattgcaccgccgcagtgtcgacgaattcttatgggattctacaaacggacaggtatctgtggaggttctgagcccaaaaaaggagagggctgctacgggatcccgttgcaacaggatagacatattaattattctcttgcacgagtatcataggtatcagatcctaggtattacaggtgttgggtaacaggtatcacagttatcgggtactatgtagctggtaccacaacaggtatgtcttatagaagagtatcccgttccaacaggataccgttgtctaggttttctgaaaaaagaaaaaaaaacctccattgaacattgaaaaataaaatttgagcttgtccaatccatactgtcgtggcagccagcgatgacgtggacatcgcgtcggccgaatccttgatgtgggccgcgtgatcctcggttgggccggggatgtttcgttcatcaagagttcaagacctgctgtgtccaatctgctgtcattaacacgtaccggtatattattatgcaggttcaaaggaaaataaactccatcgtacattgaagagcaaatttctttatgagaaatgagaaatggaataaatttgatcctgagtcagcagttcaactgtgcaaaatcaggttttgcaacaaaacaagttttagcacaaaattttcagaaccaaggtttatcattgtttcagatctccctgccaaaactgaccggcaatgagcctgaaaactgatcactgcattgtgcctctccattcctaaatgtcaatctattttccccagagggatttgattctttgaaggcgagaactactccaatatgtttttctgaaccgggatatacccgtttcaattacagattaaactgaaatgaaaggccctacacagacagagtagcagagggattagacagggttgcgtctaattactacgaattgcccactgcagaagagaaccgtatgatcatgggcatcacacaacagatccaatggcaaaatcacaaaagaaaaggatagagcaaacatataagcaaattgaagatttgtttgctctcagcaagtccgcagcagctcatcgccagcatccaggagcaacttgaaatcttctctgcttattacctgcacaataggaaaatttttgctcagatgccaaatggcccataaataaatattaagaacagagcgaagctagtgatgattctgaaaaaaaaaaaacaggttctcctgcttaaagaaatgtttctgaaaaataaacgtactgattactagtggcaacaggcatgttctcatagcctgaaaggcttgaaacgcagaagcatatttctgcagtgcagtagtagtattgtactaacacgtgagaaaaatacaagaatgaccaaggtaatactagctagtactagtgagtagtgacaaataatgggcttgtacaaagtatgcactactccatgactgggaagaatcaatcaaaacttctagcacaaacagagatgatgcattgccaaatcctagagaaaatttcacaatagaacagttcagctatgacatctctgatacgcacgtacctgcattttaattctttcttccacgggcaaccttgacaaggtcagtcaacaccgagggacagctcgcctccagatgtttgaacccatcagtggccaacacagcatcaaggttttcagccgtgccggcagcaatgaactcgacgcacttggccttcagatgcgagcagtcgtgctgctccgccaacgccaacgtggtcgacaccgtgtcgacgtcgatgcgctcggcgagcttgctctcgcagatgagcttgagcctctccagcccgtacctgtcggcgccggcgagcagatgctgcgccatcgccgtcgccgtcgacgctgcctccgtctcctcgccatcacggtggtcgagctctggaacggtgtcagtgtagacgaagtgaagaatggctttgaagaccggcgcctccatgtccttgacctcgacgcgctccgaggccttcaccttcatcgccccgaacagctcggccatgaaaaccggcgacctcgaggccagtatagccttgtgcgcggcgaacgactcgccggacacgacgaacgtgacgtcggcgccggtcttgctctccaggagggcgccaaggtacgcgtgcaactcggacgacggcgccacggctgcattcgcgctgtcgcccgccgctgccgccgccgcggctatctccggctgttctcggagcacggtgatggcgcactgaacgacgtaggaatcgtctgtgagatagcccgacgcctccagctcgtcccttgccatgaacacggcacggggcgagtagtcaccgggcttgtggaacttatgcgacacggtcttcatctccgacggcctcagcttctgcgtcggatctaccaagcagcagcttagctgggccttcacactgccgctgcctgtgcggggcgcgccgcgcaggacgagcttgagcgtgagcggccggtcgcgcctgccaacccagggatccttcggccgcaggcggatctcccagtcgtgtccgccgacgcaataccgcctggaactgaagaactcgccgtcgtccatggccattgtcaaggagtggcccacgatcttgagctggatgtcgttggagcgtgtcacgtcggtgagctttcccatggcgatcgatcgaatcgtatggctggactggacgtatcgtggagagagggctaggtgaggaagcgagtggaattgtttttcttcagtagctgagtgcttttgtattagagcaagtttaatagcatagtcctccaattcatctatagccaatttaagagcttattcatacaatatttacatactacactattaatatctagtcctacctgtcatacacacactgcatcttggagtccgtgctatagctggctataaatttatagctcactgcttttctttctatttatttatctctttaaaatatatttgcagctgacttatagtctgctattgtatctactcttatactatatcggtgtcgttcattaaagtgagctagtcgatcgttcgatggctcctcgggtagcgcttccggaaatgaacaggcgaattcatcagaccgagttccctctttaattaatttggataatttgaccgatggcttcagtgcaggatagaaattgattccccacttgtggcatgatcgaccaatgcagcgtttacactctaaacccctcccctcgtttttcacgtgtatgtttttcaaactgctaagcagtgcttttttttaaaaaaagtttttatataaaagttgcttaaaaaatcaaattaatacttaattaatcacgtgtgcggtccattttccatgtacactgtttgggtcgggaaaaagagtgtcgaacacagctatgtatgtatggattgagatgtacaacagcactggcaagaagtcaagaacaacccacgacttttcgaacacacgagcgaattattcgccgttgctctagtaatctaatactccatattaatatccctccacaccgtaacgacaaaaatatttttgtaattagcttagaggggtttctaggtccatcaaaaagatgattataattagagctagtgttgtatgttggtcaatttaacattgttgtaatgataaagttttaatggtaaataactatctaaccctatacagcttatcttcatgtcttcctactggctccacttttgatttacgatgttaccacagaaagagcatgatactatgcacaatggtgcttgtcagggttacgggtcaggcatatcccctacccttcgatatacgatacgtatcgacatggcatacccacgcgcatgcggatatttcctttatgatctaaggaaacctttcacgaaatcaatatacgggaaaaagtccttttcggacaagaactgggttacctacgtatcgtgctaggtctgatatgttcgagtcctactcggagagtaccagacttgcgatataaaagggaccccccggggagggcatagatcatcgaatctcagaatccacacagcctacgaagccggagcctatgaggagccaagtcgtcgagagctagtcgaatcgactcgactacaatctcgccggatctgacaagttccatcttttcctttgtaacctgtgttttccaccatataatcccacatcaactggattagggctattacctgtcaaggggcctgaaccagtataattcttgtcttttgattgctcgatgtcgtactacgtagatccttgtaccagcgtaccccaataccctctatatctggtctacgggtatcacccgtcgacagtggcgcgccaggtagggggacttggtactcaaggttctactactatgccatcaagcttcgtcgataacaatgtcaacaccagctccagccaagcattctcaacttcaacaatgttggtatggactcaagtcggtgaaatcgtcttcccggtttacaccacgatgccaatctcaaccggtcctccaatgactgaaaacgagaacgcagtggccacaaaccaagacggctccatgtcgaaaaatccacccgttgaaacggagaacggattaccgactacatccaaactcgggaaggattctgatgcggccaagtcttgtcccaccgacataaatcacgggccgacaaagatgacttccgaagctatcaggtcttggtgtcctatccacaaaaccaagaaacatacccttcaagattgctgggtattcatcaacgtccgtgctgaaattcgcgcctgcaaagaacgtggaattcaatgtatttctccgactcgggatgtctattgtcctatccacaagacaaagaatcacgatctctcgagctgcaaagttctcctcggcgccatgaaaaccccgtctcctaagtcatacgtccccgctagggataacggcaaggaacagggagcgactccagcctcagatcgattcgttggggtaatcgatctcgatcctcacgaaccatcggtcttacatcccctcgaagactacgggtcatcgacaacaagtgcgccgcgggaggtattagttatcgatgacgttggcacgtcagcgcaagccaacgcagaagcggcgaatcaatcgactactctagtccagcacatcagggctattcaagctatactgagggaaactccttacgatcccgttctgaacgacgacctcgagcgttggacagaatgattacgggagtcggtgactaacctcagcaatgcgttcaaagaggctgctaccgcagcacaccaagatcagccaccaatcggcgacgccaatggtgaagatccggagcggagggaattgcctcgacaggctacccctccacctcgtggcactggcgatcttcgagatcaaattaacaatcgccgagaagcacggcgcacacgggacgacgcaaatcgctctcggcgtcatgtttcttcatggcgccatgatcgaggaaaccgcccaaacgaggaccgagaatgcaacgatcgcgaacggcgggggccagacaatactagtcatggccgtcgccgcaacgacgacgacgaaggagatcggcgccgagataacaacgagagacaacaacaagattctcgggatccaggtcatcatcctcgtaatcgtacgccggagccaagcgacccatcgtcatcgtcatcatccgcgtcctcttcatcgtcagacagacatccacgaaggtcacgcgaccgccgacaacccaccgccccagcgctgggtgtagggctttcggtcgttccctacgtgatgtccgatggcctgagagattccgacccggggccattgaaaagtatgatgggagcaccgaccccgaagaattccttcaagtctactcgatagtgctttatgctgccggagcagatgacaacgcattggcgaactatttaccaactgcgttgaagggttctgcacgttcatggctgatgcatcttcctccctactcaatctcttcgtgggcagacctgtggcaacagttcatcgccaatttccaaggaacatacaagcgccacgcgatcaacgacgacttacacacgctaacacagaactcgggggaatcattgagggaatacgtttggcgctttaacgagtgcagaaacacaattcccgaaattatcgacgcttctgtaattcgcgccttcaagtccggtggtagagatcgctacactacccaggagttggcgacaagacgcatcacaactactcgaagattattcgagattgttgagcggtgcgcccatgtggatgacgcgctaagacgcaagaacgacaagccgaagactgggggagagaagaaaccagccgcagacgcctctgagtcaaataagaagaaaaatcgcaaaaacgggaaaaggaaagctcaagcggaagtcctcgcagcagaatacgtgaaccctcccaagcgcccagacccacaaggcagcgatacaaagaaatcatgatgccccatacacaaaacggacagacattctctggaggattgccttgttttcaaaaagtcgctcgagaagcacatggcgttcaaaaaaggcaagcgagtacgtgttatcgagaagaacgaggagacatcttctcacgaatcggattctgcgtacccagactccgacctccacgtctcacacatcttcggcggctccacaacgtactcctccaagcgggaatacaagaaagcggaacgtgaagtctgttcgacatggcagggggctgcacccaagatgaagtggtctgagcagaggatagagttctcggatgaagaccaccccaagacctctgttatcccaggacgatatccgattgtggtcgaacccactattcggaacgtcacggtagcgcgagttctcatcgacggtggcagctcgatcaatctcctcttcgccagcactctagatgcaatggcaattccgcaaagtgcgttgacaccaaccgatcaacccttccatggaattactccccaatcatcgtccagacctctgggcaagattacgttgcccatgaccttcggccaagccaacaacttccgaacagagcagatcaccttcgatgtcgctgaattcgatacagcttacaacgccatcatcggaagaactgcacttgcgaagttcatggccgcatcccactacgcatatcaagtgctcaagatgccgggaccgaagggaacaatcactatttaggggaacgcaaagctggcggtgcagtgcgacaggcggagcctcgacatggtcgaacaaacgcccaccccacccgccacgtttgagccaccggagaaagtgagcaagccaaacaaggcgccgaagccggacggcaccatcaagatcgttccgctctccagtgctaaccccgacaagactgtcaaaatcggggctacactagatgagaaataggaactcgcgctcatcaccttcatccgcgataatgccgacgtgtttgcttggcagccgtccgacatgccgggggtccccagggaggtgattgagcacaaacttatggtgtgacccgatgccaagctagtaaagcaaagactgcggagatttgcaccagaccgaaaacaagccatacgagaagagctcgacaaacttctcaaagctggcttcatcaaagaagtacttcatccagcgtggctagccaacccagtcatggtgaggaaggccaacggaaaatggagaatgtgtgtcgatttcacagacctcaacaaggcgtgccccaaggatcactttcctctccctcgaattgatcagttggtggattcaacagccggctgcgagctattaagcttccttgacgcttactctggctaccaccaaatcagcatggcaaaagaggacgaggagaagacagcgttcatcacgccgttcggggtattttgctacgttaagatgcctttcggactaataaccgccgggaacactttccagcgcacggtccagggcgcacttagcaaccagcttggcaacaatgtcgaggcttacgttgacgacatcgttgtcaagaccaagacaagtgactcattgattgacgacctgcgggaaacgttcgacaacctccgacgatatcgcctcatgctcaattcagagaagtgcacattcggagtaccgtcgggcaagctactcggattccttgtttctggtagaggaatagaggcaaatcccgagaagatcaaagcaatcgagaacatgaagtcgcccacaagactcaaggaggtacaaaagctaaccggatacatggcagcattaagcagattcgtcactaggatgggagaacgaggacagcctttcttcgctttgttgaagaaacaagacaaatttgtatggacacgggaagccgaagaggcatttattgcactcaagcgctacctatcaaacccacctgtactcgttgctccccaacctaatgaagaattattcctttatattgccgctacgccatattccgttagcactgtcattgtagtcgagagagagaaagtacatcgaccagtttattacgtcagcgaagctctccatgatgcaaagacaagatacccacagattcaaaaactgctctacgcagtcatcatgacatcaaggaagctacgccactactttcaagcccacagagtcacagttgtctcctccttcccctcagcgaagttgtgagaaacaaagacgttgtcggccgcatcgcgaaatgggtagtcgagctaagccaatttgatatccactttgtgtcgcgaacagccatcaaatctcaggtactcgccgacttcgtggccgattggaccatgccagataacaagtcagacaaccaaggcgacaatgagacatggacaatagcgtttgatggcgcactcaacagccaaggagcaggggcaggatttatcttgacatctccctccggagatcaattcaagcacgcaatccacctcaacttcagggcaaccaataatactgcagaatacgaaggactactcgccgggatacgagctgcagccgcacttggggccaagcgactaatcgtcaaaggagactctgagctagtcgcaaaccaggtgcacaaagactacaaatgctccaaccccgagttatccaagtatcttgcagaggtcaggaagctagagaagaggttcgacgggatcgaggtccgacacgtctatcgcaaggacaacgtcgagccagacgacctagcacgacgcgcatccagacgagaaccggtcgaccccggcacctttctcaacgtcctgacgaagccatcggtgaaagaagtaacggtgagtctggcccgagcacccccaacattagctcggaggtcaccgaggcagaacgtgacgttgctgacatcgaaaccacagacgactggcgtaccccattaatcaaattcatcagcagcgaggaattgcccgaggacgacacagaggccgagaaaataacccgtaaagcaaagatctactgtatggtcggtaacgatttatacaaaaaagcgccaaacgggatacttctcaaatgcgtctctaccgacgacagcagacaactcctcttcgacatacatgaaggcatatgcgggtcacacgccgccggtcggacattagtcggcaaggcctttcgacaagggtttttctggccaaccgcccttaaagatgcatgcgacatggtccagcgatgtgaagcctgtcaattccacagcaagcacacaaagctacctgcacaagcgctccagacaatccctctgacttggccgttctcgtgctgggggctagatatacttgggccattcccacgaggacagggcggctatagattcctatttgtggcgatcgacaaattcaccaaatggatcgaagcactacccactggggaaatcaaggccgacaacgccattaagttcatcagagggatatactgcagatacggactaccgcaccacatcataaccgacaacggctctcaattcatcagcgccgacttccaggattactgcatcggtttgggagtcaaaatatgttttgcctcggtctctcaccctcaaagcaatggacaagtcgaaagggtaaacggcatagtactacaagggataaaaacccgcgtctacgacagactcatgtcacatgacaaaaaatgggttgaagaactcccatcagtactattggccgtacgcaccacaccgacaacatccaacaaggaaacacccttcttcctcgtgtacgggtctgaagccatgctctctggcgagttacgacatcaaagtacacgagtacagaagcattccgacgaggaacagcgagacattgatgtaaaccttctcgaggagcatcgtgagcgagttgctgttcgagcagctagctatcaacaagccctccgctgttatcacgagaagcgtatccgagcacgcatactttcgatcggcgactatgtcctctgacgagttcaaacccaagcagggcaaaacaaactctcaccaaaatgggaaggaccctacacgatcacacaagtcttgcggccaggcgcattcaaaatcgcagacggcgacggtcgcgaattagcaaattcgtggaacattgaccaactacgtaaattctatgtatgagtcaataacaccgtacctgtaagcacccttacagtatcaataaagcctatttctaggtttcataccacgaccaaagtgttttcactcgacgatcccttactctgataacacctaacgttgaaacatatccttatgaccctttacgccgtctcgacaaggcctccgaggaacctaagggatcttcggctggggatgcccagaaccgataaggccttgtcagatccttcagagacgaaagaccatgtaagatctggtcgtgtaagagttctcgccgtgcgtattaaccaagccgtgtaatcggaaaccgagctttccaacttcacggctgggggctaggatcagagcttattcaacctaggcagatcaagtgtccaagagccttatcatccaagaaaatttctccgacgacaaggctgggggctagggagagtgtacgactcaaacagccgaggtcgttaactaagaacacactctaacacataacatccagagtaagatgcatttgtttaaggaatatttctttattcacataataattcttacttgttttttacatagatctcccactacattacactttttcctaagacatctatagcaggccacgagtattaccaagagggccaatgccagtccatagactggaataccttctcggctaacggcgtcatcgacctcgcaaggtggtctatctccgccggagtcctccgagaacgagcaaacccttcatggaggaattcgagatccaggcgcgggcggtgatctcgcaggcaagctagcacatgtcctccggcatatcgactcgctcgacgacactcttgtttcaaggcctcatcgatacgcctgccgatgccatcgagttgggcacaggccccgttgagccacgagatgtacccggtcgccgattcctcaggagtgttgcggactactcgaagctccccgcatacccgggccattgaggtacagcaactctttaaatatgacgcaaaccacacctcgcgtcctcggagcgtttccatggcttgctctttcttcacggctagcatggttctcgagagttccgccacttcaaattttgtcttctaatattggatacgacgatcttgggttgcaagggcatcctcgagatctgctaaacataacgaccactaagacaacctggaaaccactaacccaacacgggttaaaaaggctactcacttgaggtggttgtccccatctcgacctccacatcaagagtttggtcctcgacgtcatgtgagacgcgtggttcaaactcaagtaccggaattatcgctagtgactcgggctacccgcgctgctgaacatcctcgtcaccagcatctctacaatcgacaagaaaaacttccgaaatcaacactgaacaaggatggtaatcatacgcccgaaagcaaccagagttcaagatttgcaaattataaaaaatacaagaagtcctactcttcaaaaagggggaggacagactcccccaggtcactgacttcttccatcacctccttacgcgtgtcgcttgccgccccctgatccaagatatcacgcagatcgagttcagggcgcgacaaccttacacacgcgaggatgtgacacgccccggtgtagataccgttggacgtctcctccgcgatcctggccgaatgcttggaggggatttcccctatcaccgtcgccagctccgcaagagaagaagtcaacaagaactcgtcggggttcaccgggatcgtggacttgacgccgcactcctcggcgagctggtgaaggccggtgtaggtgacccgcagcgaaccacggatctcagagagattgtctccaagttccgacatgcggtcctcgagccctttgcgttggcgctcgttcccggccaccagctccctcatcttcgtgaggtcctcacaggcctcagccagttcccgcaccaaccgctcggcacgcgcgtttgccaccgccgtctccaccctcgcctctgagatctcgcggccggtgccgcgagcaccagcttcgagaaggcgccccatttcgacttggagctcttcctaggtgaggacggcctctgccagactacgaccctcagcgggatcgctaacagggccgcttggcgtcgcctcccgactcccgaccacgggcacgacatctgtcgacaccgtggcaggggatgcgctggacgttcctctggatttggcccgcgcagccttcgcccgcgcctccctacaaataaccacgaatcaaaactccatttgaatagaagacacgagaatccaaaagtctgtttactaacttctcgccgatcgtcacaatgcgctaacgtcgcggaggtggaggagacgcgtcggaagcctgcaagacaaccaatgtggagtgagaataaaccttccttgctacacaacatagcgacgaggtgaaattaccgagggagtcgctgccttgcggcgatgtccgagcacatacgagaatttcctcgccttggtcggagctttgccatcactggtggtagcagcgtcagacgcctccttgacgaccttctccttcagagatgccgccacctgatgatccgcgagcggtccgacggggacatcagtcgaaaggaagggcctacgctaaatcatatcataagctgatttcgagcagagaaggcgggacgctatcgaatgaactcacattgattgcttcgtcgcgctccgtcgcacccttttcacaaaggggtgcggggatgtcgctcgccgtggtcgggccgctgatcatcacctgaccaacacactgctccacggcttcgctgctcagacctgtcaaaaaggaatcaatttttgataagttgaagagtaacgcgagtacaagcatgtctaaatgaatgcgagaaagataccccgaggagaaacccaggtcgcgtcgtctggcccggaatagtcataagccggatgggcccgagcctggagcggctggattcgcctaccgatgaagtctgcaacgacttcatatcccaataagccctgttctcggagatcatcgatgatgtcgataaacggttggagagagggggtcaaggagggtttggcggtccagaccggaatcttgtccggttgttcctcgggaacaacgaggaccggatttgaatccttgatttcaaggtaaaaccacctgttccgccatttgttgcgagaagagggacattggaaggggacataatgcgacttcatgccatcacgaagtcggaacccgacgcaaccggataccctattggattccatccagcgcaactcgtagtaaaagcggaacagatcaagaaagggctctaccccaatgtaggcctcgcaaagatgcacaaagacgctaaggaaagcaatggaattggggttcaaatgcagaagagaaagcccatagaaattcaaaaccagcagaaggaattcggagggtggagggagaaacctgcagacaactgttgatataaaacacgaggcctgggagatctgcttaactccagtgcaggtccaaagctcgccttcggatgtatgagtgtgccagttgatttgatcctgcaatcaacaagagatagaacaaagaaaccgcaattaatcctataaatgatagccgatcggctaggtgctgatgacatatcatttatttcaagccgatgtcatgcgtacatcgatcggcaaatatcaataagcaattcagaactaaatctactcgatcaactgtagacattaatgatatataatccttatatcagtatatacttaaatcaagtgattgggatagatcggtcgccttgccgagacagtataaatcacttagattgaaatatatattaatagtaggattatatacattcataacatagctgatcaggtaaatctagcatgtatcggctaatactccgataccactctatactaagatattaaagcaagtagaatataccaaacataagcttaatatacttagatgcaataaaatcttaacataaagggcagatttaacgtatcaatcaagcatataaaataaaattagttaaatcagataagatcggctgaaactccgatattaccctaattggcaaccagaaagcaggctagagattgcaattctaagcacgacttaatagatcaaactcaactgatgcagcattaagtatgaaaagaagaacaatatctagataatcaagccgctggaagttttatagagtggtagatatatcacataatctaagttaacgtcattgtataacctaatcggctgccttccattagcagatgttagccgattataggttagataaagatattatcgaagactatatgagatatatgataactcgacgaattatatagacaagattagagtgtcataaagatggaagcactaatcctgagaacataagtcgtcatgacaagttttacctctttgttgaagatcgaaaccgatgtagctcaacccgagagcacgaactcgtcgaaataaaagtaaagcaaaaaagggtggcgatgcgccgagattgtattggatgtgttatctcttttttatatagggctcgggtctatttatacacgagaattacaagatacgtccataacggacacgactattatctctagcaaactctaagataccataagtctttacggcagactttttgcccaaacatatctctaaggaaattacatagaatatcctaattaatagatacaattgccttcccaggactctatccatgcatggcaatcaccttgaagcacatcaacttaaacccgatgacgttcaccgggtcatattatcggaatcagctgtatcggctagccccgtccaactcgaactctgccgatcctgaccttagctgatttagactgcagccaatttttactctgtctccgcaacgatcttcatcttggattccacttcgatctgatcttcatctccgatgccaatagtgatagaatttaccaaatttggtcgttaacaacaacataatcttcgatcgcaaccatgcgacctaagatgggctgaggattagtacctcctgctttcctctccgccttttcacggccaggaagggcgccgtcctcctggagcttctttagggtcgcgctggtggaagccgacttgccgagattcatcgctgctgaaagatcgccggagatggacctagagctggcgaagctagggttctttacggcagcggagaaggtgaggagtgctaacaggtggtgtgtttgacggagttggcggacttcaaaacgtgcacccaaaatccctttaaataagcgcacccccaacggtgcgaattccaaggaactgagagaaatccccgctggaaatttctaagtctattacgcgcggcagtttttggacttcagttcaaaattcactcgtgactgttgggcttcaaacgggatgctcgactacacatcaactccgcgattctcgcacccggaatgataacgttctagacgcccgaagtcgcgaatggtcgcatgagttcgtttttgagcaaaagtcggaggctactgtcagggttacgggtcaggcataccccctacccttcgatatacgatacgtatcgacatggcatacccacgcgcacgcggatatttcctttatgatctaaggaaacctttcacgaaatcaatagacgggaaaaagtccttctcggacaagaactgggttacctacgtatcgtgctaggtctggtatcttcgagtggtactcggagagtaccagacctgtcatataaaagggaccccccgagaagggcatagatcatcgaatctcagaatccacacagtctaagaagccggagcctgcgaggagccaagtcgccgagagctagtcgaatcaactcgactacaatctcgccggatctgacaagtttcatcttttcctttgtaacctgtgttttccaccatataatcccacatcaactggattagggctattacctgtcaaggggcctaaaccagtataattcttgtcttttgattgctcgatgtcgtactacgtagatctttgtaccagcgtaccccaataccctctatatccggtctacgggtatcacccgtcgacagtgctacacttttgaaatcggtagccaatagtctcttattccactataggtggcgtagttccattagaattgctagctaaagaacattatgtggtttaacgctagtccataataaagagaagttggagatttgtctcatcgccttatttctcattttaattttaattttatctttacccttttttattattaaacttatgactgtgtgtcttatgatagaagctggagatgtaatccattttcattatctcaaatccagtactccatacacgagtacatgtcggatgtaaataaaagcacagattgtgcactgcattagcacacccatcacaagttcacaactcgcgagtcacagatctaaggttcgttgctcgtcgtgactcgtgacgaagtagcaaacaacgataagaaaagagttctcaacggttggcagcatgcagagcatgcgttacatgacagcacaatctgcactacaagcatcgtcaaatccaagcatattctcgcaaatctgcttgagcctctccagcccataccgacccgcggcttcattcaagctcatcaccatcgtcctcggcagcaggggatcagaaccatcctctctccagtcgagctccatcaacgtgtcggtgtagatgaaatggagcagcgccctgaagacgccggctctcatgtcgtccttgacctcaacgcgcaccgacccatccttcttcctcgtgccacctttcaggacggcggcggcgagggacggcgacctcgcggcgagcacgcacctgtgcgccgcgatggacacgccggaaacgatgaactcgacgtcggcgaatctcccgctccgcagcagctcaccgagctgcaggtgaaggtcgggggacggctcggccgagttgatggtgttcttgctgagcaccgtgatggtgcagcgcacggcgaaggagtcgccggtgatgaaacccgacgcctccagctccctccgcttcacgagcagaacccacggcgagctctcgttcgcggacccgaacgcgtgcgactgtcgctcttctcctcggaagcatgggagcgcgtggtcgacgggtgcaccaggcagcagctgagctacgccttgatggcgccagcgtcgttgtcgtcgtcgtcgccgccggcgcgctgcgcctgctcgccgatgccgaggaagacgagcttgaaggcgacccagtagtgccagtgcgcatcgtggcctggggtgtagtggatctcccacgcatacccggccacggtgagacgcttggaagagacatgctcgtgtttggccatggctttcgtggccgagtagccattgacgttgaacttgtggacggcgcgcgcggcctgggtgaggtttgaggagggcgccattgatgcggatcccaggcaagctagcggaggcgaacgagcctgagcaaagggagcgttatatacagatgtctgcacggcttgggtgaacgcgaaccgttgtaccgctctcgagagtgtttcgcgaatcgtgcttgcgttttcccaggcagcgctctgttaaatccagagattttgagagatctttccgtttcaacgcgcccttctaccaacgcagacttgagactgactgtggaaggtacttgaaataagttcacttaaggtcccttaacttgtgaatgtatttgatgttcgtccttcaaccgaaaaaccagatacaacgggtcctttagcggttttgatgatggttttggctgatgtaacacatacatggctagtttaactctgccttcgtccttggtgtagatgatgtggcaacggaagcaaaatatataaaaaaataaaaacaaaaactgcgaggcccacatgtcagtaagacaaaaggaaaaatagtacgatctacatgttagtgggtcccaccctcctctatccatgccatggacgacgggagacgatggaccgccggaccgcgtctccttctctctctctccctcccggccatccttcctcggcggccggcaagcgcgcacggagagggaaaaaagccgacagccgacgaggggggcggagacggtcgacggccgccgctcgctgtgaggggaatgccgacaagggcagagaggccggggggctgccgctcctcttctgcccactcgccggctgccgaccccctcgcaccgttgctcctgtccctccctctcgtcggccggcgcgcattgcctcctccctcgcagcgctcccgtcggacgccctctccggcagcgctgcgcgcgcagccgctaatctccctcccacccgtcggccggtgtgcgccgccgatgctctcccgccggcagctgcgtgcagctcccccctgccgctcctctccctccctcccgccggccggcatgcgtcaccgctcctctcgcgtcggaggtacgcgtggcgtccttggcgaggtcgtcgccgctccgcttgtgcctctgctctgcccgctgccgccgttgctccgctgcgaggacgagggagagcagagaggaagaagagggagagccgagagggcagggaatgacttgtagggcccacgtgggccccaccagtatttttttgtgtagctgacatgtgggcccacgtgggccctgctatttttaaatgatattttgtgtagctgacaagtgggcccacggttttattattttccaagatataattgccatgtcaatgccacgtgggacggagagctagtcaaacctgctacgtagacgccacataaaccaaaaccactgagggacccgctttggttttgatagttgagggacccgttgtatctagttttctggttgaaggatggaaatcagattcgttgacaagttaagggaccttaagtgaacttattccaaggtactttgacgcgagacgaagctgtggcccaatttgaagccggcgtgaggcccatgaaccaaccacagtttggccccattttgatggttaaaaaaggaataagttcatctaaggtcccttaacttgtcaacgaatccgatttttctctctcaaccgaaaaaccagacacaacgagtccctcaagtatcaaaaccggtgcagatgaggtccctcggcggttttgaggccagttttggatgacgtggtgcctatgtggctaatttgactcggtcttcatctgacgtggcgcttacgtagcaattcgacccgaaaaaataataaaacccgtgggacccacatgtcagtttcacacataaattaataaaaaatggtggggcccatgtgcgccccacatgtcattctcacccctcttcttcttcctcctctccctccatctccctctcttcgtctctctcccctatcctctctccaggtgcgacggagaggcagcggcgcacggcggccggcgggagagaagggagcggcgcggcggtggaggcacggctccggcagctgtgggcggaagaggaaggggcggtgggagttggccctggctgcggcagacggtaggacatgagctgcacaaccgaggccccgccggcgccgactccttattgatgtcaccggcgccgccaaggctgacgaggtggacgcggtggtggtggaggaggaggaggacggcggcgcggcgcggttccatgagcggaggctggtggtggtgtttgtgctgccgtcccagccgatgtgcgccacgtgctggcggtggtggtccgccgcgccgccaccctcgccgccgccgcctagacacgtacacaacatcactaataccaaactcctaaatcaccccgcaaaaaacaatcgacaagatagagcagaagtgaagaataagcatccaagactccaaacaacgaaccttggggcttcttgccgctcttgccgccgccatcgacgacgtccacgctggatccattgcggcaggtggagaaggggatcacgatgaaccggtccatccgccgctgctccttgccactattactcatggctagctagccactgctagctaagctgatactatcttggaatcaaattgcttgccgctttggctgaacctgtactggtacgatcatttttagtaaaagaaagggttaattaagaaatggggttcttgacccttgctaaaaaaaaataatcttggaatcaaatcaatgtctgctcctcgctggcgtgcgctgcgacagcggccagatgctgagcgacgggagcagcacctccgcggccttggcgactggtgccgcgggagcggcgggccgacggcggagcctccctccgcggccgacgcatgctggcttccctcggcggcggcggcggctctgggggcgtcctccgccatggctgcgggtaagtgggagagggagagatctatggcgtggagaggggagagaccgagagggagaaaagaagctccgccgccccttcctcttccgcccacagccgccgggccgtgcctccgctgtcgcgccgctccctcctctcccgccggccgccatgcgccactgcctctccgttgcgcctggagagaggatcccaatccgagagagagattaaggcaccgttcgttccagggtgtttggggagattgagtctcgttttccgcgcgcacgcttttcaaactactaaacggtgcgttttttgcaaaaaatttctataggaaagttgctttaaaaaaccatattaatccatttttgaaatttaaaatagttaatacttaattaatcatgagctaatggctcacctcgttttgcgtatcttctcaatctcctcaatccccttcccctcaaacacaccctaagggagatggggagagagaggaggaagaagagggatgagaatgacaggtgggcccacttttttattattttgtgtgtggaactgacacgtgggtctcatgggttttattattttttctggattaaattgccacgtaagcgccacatcagtgcctatatcagataaagaccgagtcaaattagccacgtaggcgccacgtccgccaaaaccaccctcaataccgccaagggaccttatctgtacctgttttgatagttgagggacccgttatgtctggtttttcggttgagggacgaaaatcagattcgttgacaagttaaggaacctcagatgaacttattccgttaaaaaatcacgcatgttttaagaggggaaaagtacaccgaaggtccctcaacttgtcatcgagttacaaaatcatcctccaaccgcaaaaccagatttcggtcgtcccttaattaatcaaaaccggtcacaatagatccttcggtggttttaaccctggttttgtcttacgtggcggctgagtcagtgtggaccgacgtggcacccacgagtcaggatgccacatcatctatctcattcctcctctctctctctctctctcactctcctcttctctgggcaagccggccggcggctggaaaggaggtcaccgggtgaggcgggagaggaggagagcggcgccgcgacggcggctggctgcggctgttccatggaggccacatctcgcgtcagcaacaccaacaaccacccggcggcgacggcgaaccttctcgttggcggcgacgacgcgcccgtccacggggagacagccattgctcgcccctgctgccgccagcttctcctccgcctcccgcgcccggaacggcgacagccgcagcgcacgcatcaggcggtcgcagcgtttccatctcactgtttcagttccagacaaacgttgcaatggcgagcacaacggcagcaacaacaagtgagcagttcccaccggcggccatggggcccgtcaccgctgcgccgttgctggaagaaccgtcgtactaggcagtgacaacctcgaatcagctgacgatgcatacgacgagcagcacgagcgcaatgaccggcttggaagaagagcgctccatcttgttctgctttcgattgcatgttcaaagttcagaactcagagcagagacgatacacttgagcattttgctcaaaatggcaggatttatatagaattgcttcatggaattatctgtgaatgttgacatggtaaacatagtacatatgcacacaagtttgtccttttctctcgatcgtgttctgctcgccaggttgagttggggttgatctggacggctggtttgttgctgcatactcgtctgaaaagttcaacaagaagatgaggtgctggctttgattttattgctggtgttccttcctttctgcctgtaccccaaccaccccgctctcctcgaggcgcagcagccattcgcctaaaaggaaaccagtactaacctcgggatggtgatggccgcgaccgcctgatgcgtgcgctgcggctgtcgccgtctcggcgcgggaggcggaggagaagctggcggcggccgggggcgagcaacggctgtctccccgtggacagccgcgtcgtcgacgccgatgaggaggagagcatcccctcattcgccgtcgctgccgggtggttgttggtgttgctggcgcgggatgtggcctccatggaacggccgcctccccactgcggccgccgccggcagccgtcgcagcgccgctctcctcctttgccgcgtcgccccggcggcctcctccccagccgccgaacagtttgcccagagaagaggagaaagaagaagagaagagagagagtatgaggaggaagggaaagagatggcgtggcatcctgacatgtggggtccacatgggtcctacgttgactcagccgctacgtaggataaaaccggggtcaacactatcgaaggagctattatgaccagttttgattagttaagggacggtcgatatctgattttgcggttgatggatgattttgtaacttgacgacaagtttagggaccttcgctgtactttttccttttaagagatgtttctttttcgaagcattagcgggcacaaggacctgtgcagtcgtgctgaccttgggtgaagcatttgacagaagaattgggaattgatcctatcatcaacgttttcagaggaaacgagtagccgagtactccctccatctcatagtaggtgacgttttcgattttttatttataacgtttgacaattcgttttatttaaaaaattagtgcaaatataaaaaaagataagtcatatgtaaagtacttttgataataaagcaaatgataaacaaaataaataataattccaaaattttttgaataagacgaatgatcaaacattgacaaacaaaaacttaaaaagacaagtaatatggaacggaggcagta

SEQ ID NO: 30328 - DNA, 3481 bp, Oryza sativa
  unsure (1)..(3481): unsure at all n locations
nnnnnnnnnnnnnnnnnnnnnnnnnnnnnnnnnnnnnnnnnnnnnnnnnnnnnnnnnnnnnntttccaaaaaaaaaaaaaatcatgacaacgttgcaaacgccatgagaaaagagaacatactaatagcatcaggcatcaattaaatataatcttataatcatacgaccatttcggggctaattaaccacaacataattaagtagatatcgaaatgcatgtataagttaaagtaaagcttctcttggcaaaccagaaacccaccagctgctaggatggaggtgacggcactctggatccaatccatacggacaaacggcatcaaaccatgggtatgctgcctagtgcctacgtactactgaggatctttgagcaccgtgatgacgcacctcattcagaatcacaagctaaaatagccgggctcctctccagatcgtcctgtttaatgagcttaacccagtcagagctctccctggcgaggtgaaatttgcgtgacacagtttcagccctgcagtcgtgctggttcccgcttgcatcacgccaacgtgcctccgtccaagtggagcggtgatccatcaggcggcagctgaacgacgcattcacgcctctcgcccctgcaggtccaaggaagacgagcctgaacgcaatacggtaatcgccatgtgtgatgaacacctttgggtagtagcggatctcccactcgtaaccacccacggtgagtcgcctggacgggaagtcgttttcaccgccggacttggtggcagagtagccgttcaccgtgatgtcgtgaatagccgatgtggcctcggtgaggttccacgatgaaaatgacattgctgccgatcgattgccttgtttgtggtgggttcgcactacggctactgcgagcgtgagatggcaaggctcaagcaactccttctacgagtaccctatatgtagatttgtagaggcaagtggagactggattaatatcggaacgagaggagcgcatgcgacgcccgggttgaatgtagaacgcgaatcgtttggtcactctcgagctaggcgtttcgttattctcaccgacgggttctttccaagggattaacacacgcctaagagcaggtacaatagcagactattagccagctataaacatattttaatgagataaaagatgagagagaagagcagtgggctacagatctgtagccagctgcaacacgaactccaagacgcagtgtgtgtatgacagtgagaccatatactaatagtataataaacaactattgtataaattagctattaaattggctatagataaattagagccagtagttggctataccattaaccttgctctaagagcacccgcaatagtaaagtaaggtgctatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatagagagcctatagataaccattgtgggtgccctaatactacatgcataatactacatgcagtcatgatgacctgtgaggctgtgactgttgggaggagaatgaaaattgatgtcaccggcaatccggcagtcctgcagacgggcagaaaaaatgtgtctgcaatgtgcagactctacttggtgcatactgtatgcagtacgtaaatttcatccaaatgccaaatctgccaccaaacgccttggcctcatatgccattcaacatttcatccagatgtactatacactacggtgccgttcttacaagtttgtataacttgaattccatagttcagactgcaacaatccgaaatccatgaaaagtataataacttaagggtgaattaacttaaattctaaattagtactacagttcatggaacagatacttcctataacttgggaagttctctgccgaaaatcagttgttctgctcagggtacccttttgactgctccagggaatcagttgtgttccatgtctcttagttgacgtaattttgtacaattgcttccgcacaccagtcgtgcactcgtgcttccaatgttatgcctggcgacaaactgccagtgacacttccacagttcaactgatgctacacgttggagcagatttcttcgtaggtattacctccttcctgaaaatataagggatttttgcattgccgaaatcccttatattttgagatgaaggtagtaacatgcttttcgtcttccacgagtttatatagcctaactgccagagtgtctcacgatataaacgtccttccatttgttgttattggtatttcatgacggtcatcgtccaaccacttcaacctgttgctgcggttgagcagcctatcccaccatgctgctcaggatttgtagcttcgaacagatatactgatctctgctctttccataaccttacaggtgaacagcaggaatgagttcatttctgcatccggaagttggaaactgtaatgttgggggaaaggttaaggatccgttaatcatgatatcaatatggatttgatagtttaatatacgtaccacgtggtgaaacccactgtcacatggggagcaggaacaactatccctgaatatatgtgcattctgcgtgcagcaccttcttgttcctgaattagccatttcaaggctcccccagctgccaagttagagcaggatagaagttacaatactttggaacacaacttcaccaaataacgcacttgaatatgggcagtttgcaactttgtatatctatcttacattacttatgttgcaactcataggactaatattagggtgtaacctagcaaatgtagagtgaaacccagattgacatgtggtgttaatagttaccttttttaataattgacataaccattctgagtgtccaggacgcagtacaggacattccagcccaacatcgcttgtactgtgtggaatccctaggctcttctcatctctatagctcatcgaaatcaatacttggcattattttcttcagtaggttgaatgatgacacaggtgtgtaacattctgcactgaactgcagcagctcattttctagaacagtaaaagcatcagcaaaagcctgccatacaaatgatcaaacagtagagttagtaaatatgcgcaatttgttaccaacaattgatgcttgaaggccaaacaaagttagtcctaatacagtatgaagactaaaatattgctttagaaattctgaagtttaccatacacagtatgataacccagaaaatagtaagaacaaaattccagaaggtgagaaaataaagatacaaacaattaaaaaacannnnnnnnnnnnnnnnnnnnnnnnnnnnnnnnnnnnnnnnnnnnnnnnnnnnnnnnnnnnnnnnnnn

SEQ ID NO: 30329 - DNA, 5691 bp, Oryza sativa
  unsure (1)..(5691): unsure at all n locations
nnnnnnnnnnnnnnnnnnnnnnnnnnnnnnnnnnnnnnnnnnnnnnnnnnnnntgcaactcataggactaatattattttgtaacctagcaaatgtagagtgaaacccagattgacatgtggtgttaatagttaccttttttaataattgacataaccattctgagtgtccaggacgcagtacaggacattccagcccaacatcgcttgtactgtgtggaatccctaggctcttctcatctctatagctcatcgaaatcaatacttggcattattttcttcagtaggttgaatgatgacacaggtgtgtaacattctgcactgaactgcagcagctcattttctagaacagtaaaagcatcagcaaaagcctgccatacaaatgatcaaacagtagagttagtaaatatgcgcaatttgttaccaacaattgatgcttgaaggccaaacaaagttagtcctaatacagtatgaagactaaaatattgctttagaaattctgaagtttaccatacacagtatgataacccagaaaatagtaagaacaaaattccagaaggtgagaaaataaagatacaaacaacttaaaaaacacatactgcagaagaaaggtccaatcaaccagcaaagggagaattataagtaaccttgatacattggtgaatgcggaaacagttcctgcccacattattggcagggcaaagaggatcatcaatgtgtattggatcaatgctgcaaatcaagcatatggaaaaattacagaaggcaatagttgacagaaacagataaactgatacattgatatttaattttatcacctgtgacctctttctcggttcaaataaatgccacttccttggatagagatacgcatatggcgcggatcaaatacattcctgatatccagattactcactaattaaattccatcttagatgataattatattactactccaaaacgattgcaatttgcacaggataaatcgcatatgagccctatagtctttgaagtttgtgtcctcccttatgtattaaaggataaagtgtccagatgtatttttcttacccaaaaaagtataggaaatccatcaaaaggctgcccagattctgtcaaacatgaaggaacagatatgaaattaacttagaaggaaataagaaaactgaatttaactaagagagattgaaaaaatgactttgcctgttgttacaagttacatgaaggctgattaccaaaataacaaccggatgatacagaagcaaacgtctaataggaaaaagatacaagaactagtaatgaaatagagcatataaaaaacccttcttctctattcatgatttgcaacttacttggttaatgggccgaccaagatgatgctcatgctgaagaaaacgaacgattaacagtacctgcaaaggaagttataaactggaggattatttttcagtgggctctcaagataccaatattgatgcaaataatctggatttgcccttaattgaaagagagaaaaaagaaatggaagaaaggaagatcagcaagtatgaactactgtacaaaagtggcaaggtacaagcacaaattagttagctgaggaccgtactttactgggtctgttctttaaggctaagtcatacagtgctagataatactatggatagaaatgcatctgattaagagggttaatccagaaaaaaaaaacctaaatcaccaaatagtaaatatctgggactaatctactaaagttaaggagaaaaaaaatagctattcactcataatgtttttttattattatagcaacaatttgaacggtaaggtgtcagtttaagttcatgacatcattcacacctaagaaagttatccagagagtaatagatagccacgacaggaacagcaggtgttatgaaaagttacataccaaacaatatgaacttagaccaccagaatatgggtgatccaaactccggtcagccaaaaacttcttcagtattaaggcaagaggcacagcagcaggaaattgctgagttaattcacagacctgtaagtgaaaaaagaaggtgaataaatagacaggggggccttaggtctcatgaaacattgtttgatagatgtaagcttgtgatctgcaaactttcttactcatgtccttatgcacaatatctagcgagcaatgtgtgcaatatgtgcatatctcaaacctaataaacagctggctggttgctcattcatgtatatataagacttaatgtctaacaaaaccatgtcattgtggcatcaaatcctacacactatgaaaaaatcaaaatgttgtaacccattggttcttcaaacatattctttttctacaagatctcagtaaagcaaatacttatggcagattgtaaagaattattcactccgagagtaacataattatttcatccatatgatccgctaaggtgacagtatatagaacatttagcattcatttgagatgacatgtgacagttgacaagaaaacaagagcatgctgataattataactgtatgtatggtccgcatgtgacattttatgtactgcaataatttatatatgaatagtaaatacactttgaattgacatcatgcattcagcataatttattgcaatactaaaatggcaacatcgcacaggagccatggcaaagaataaataattagaaccacatacgaaaggtaatattctatgaatacaacagacagtatgacatataattgtacttaattatatacatatccaagaacctgtattgcaagcgcatttatgctataaattccttaatgcttatgattcattgttcaaagtctttgcatgaaggttgattctaaaactaacaaatagaaataaaacttattttcttcaaaatataagggtagatagtaatcttttttaacttaccaactcagttgtctggagtcctgtgtgggatggtgatttgaaacttatatcaagacgaattgactgcacaacattgccatcatccttgtttattcttgaacacattggcatgctgctaccttctgaactagagttgtcagaacgagaagggctcccttgatctccaagcacattgatggataattgttcgtgtgagctatccagaacagaagaatattcactggacaaatttgtgtcacagggcacttgagctacaagcatgatcacaggtatctgcaaatttaatgacatacgtatgaggaaaataaaaaatagctggtgagctagcaaatgaaggaacttaccgccgtgttttcaactgttttgagggaatcagtcctaacccagtcctggtttgcaagacaccgtgctgcatgctgaaacaaacaaaaagaagaagaagaaaagactcaatgtaaaatattttcttgaccgtggtctaaatattactgtagtaacgcgcatagtgttcagtaattagctaaaagccactaattcactgcgccacgaagatgcgcaggcaagaggaaaaaaaacatgtgcatcgcaagccatgtaacatgaaaacttatttaatatctagaacaattatgacgaattcactcttctaatagtagcatgttgacccccacacatgcattcttctaaagaatgtaaactaagacagataactccgatataattcatgcatttcctcctaatatccagtttcattgcattaataacttggcatccagaccttaagaggataataaagcgccattgtgcacaatacaatcaatcattaacaacccaaattcatcacaacaaagtaatttgctaaaattcgataatatgccatcgaccagtttagaatgcagagtaaacagcatactgatactagagaatgcgtcagtctgttagtcaaggcatcttacctggagacacgtttccttgatgccattcctgccttccaaaatcccagcttcttttataggttcctggaagcagccacaacttagaattgcacactatggcatgtaggcaggtacatttgaactaccagttacatgcataccgatagtaatgcaactcaccaaattacgaactggtggaagagaaattacaagatctacatcgcttgttggaagagccaaaccagtggcatttgagccaaatagatttgtacgggaacgaggccagagaacttgcaaacaccgtgtgacccttttgacagcccaattaatatagggcttcctcaccagattctcggcagaaacctaagtatcacatttggaatcagcaaataagaattgagatctttttaccatactataatggagattttcaaggactcaaaaacaagccatggcatgggattacttggcatcagagtaagtctttgattgtttgatctacggctaataagccgtggaaaaaatgaactaagaaccaaaagaaaaaattataggcagaactttttatatatgtgtgcttaacagtttaaaagccaatgctggaaaataaaactacgatgaaaaaacctcaaaagcaactctaaaattaacttttaatatacaaattttggttgtggctgataagacaacaagcagaaaatgggaggctaaaagaaaaagatcacatagcgtacatacatgaaacttgtggcacaaaaaggacatacctgcttacagaattgatctatctcttcgtgtagtgcattgtgcatcaaagagagggatgccttgctagaagaacagtttaacatatctggtggttgcagaggcaacgcaacatctggctgcaaaaggcataagttagaaatgcacaaagttgcataaataatattttctttggatcacgggcgtccttacatgttgatcacgagaaagctgtgaaatcttaacaaggtgatcctgcaagacagtatcctcaattgattgccccagagtaccagcaggacttcctttatttccccatgaaggccatacgacttcaggaccatccaagcaaaactgagccctgttcaaaattttgtcctcagtaaacaaacttctcatcccccaatgtcttgggcttgagctgccagatctaacaatagggaatcctcgttttcgtgactctcccacaggagaaggaggcggcggcctagggactcgaggaacactaagtactactggcgatggaggtcttcgtacaagaggaatatccctcctgtttgaaggcacacatgggctcctgtgatcatgaccccccttaaattcagatcttgatggtcttcgtgatattggaacaactattggccgcagcattgcatatggcaatgtatctccctttatcacttcgctgccacaagatacactctttgaaactggaaatagttttagagtcagaccgtcaggcatgcaagatggagactgcaacgactcactgttcatgccatttgctgtcattgaatgaccaacagactgagggagaggatctggagattcattttgggaacatactgaagtggaaggtggtgaagacacactatttgcattatatgtacaaggaatcccaacaggtatgtcatcaagaacttgactaacatctgcctcatgccaagcccatgcactgtcatctgagctaagagatggtggcctagaaaaaccagttccggcatgctctgcaggactccaatacataactcctcctccaaannnnnnnnnnnnnnnnnnnnnnnnnnnnnnnnnnnnnnnnnnnnnnnnnnnnnnn

SEQ ID NO: 30330 - DNA, 1091 bp, Oryza sativa
ctagaaaaaccagttccggcatgctctgcaggactccaatacatcactcctcctccaaaatattgattaatatctcttccggaaagtccgcggccatcagattcttcttcagaaaaccagtagctttcagtatcatccccaacatctgatttgtttcttggatcactgtcaccaaaatatttcctatctttctcattgcaaatactacctctttgaattagtggagcatgaaaccctgaccaagcggaagattgcatctgcggagtatataatggatcatatcctaaagcattgttttgattcaatttaccataacctctgataacaggaggccaatcaaaacttaagggcactgaaagagaggatagcacttgattgcatccagcttcaactggcggatttctcatctgatggttgggtggaaggaaaggctgttcaaattgagctggccatctgtaaccaacatcaagatgcaacctatctgttgtagcagggcgctgttgcatttccggtgaaacaaaatgatgtggtgctacactaggccactcatatgatgttccacccagtgtgtttctgttgtacacataatattcacctccagttttcattaccccgccattgtcgcttatagcactgtgaaacatattagtaggaataacaggtggcaatattttttcagttgccactacagagttacgatcaacagtatcacttctggaaggcaaacaagaagatggttggagtgtagattcattctggccattctgcgatatgacctgctcattcatactaaagccatcagatgttttcacactctgagaacattctgtagtcaacaacgagctgactctgggagaatgcaaggtatcttccagttttgtgtttccaatgccttttacatctgttccattaagtgcaatggaagagtcacagcaattcactgctttgggaatgcaactcttggactgatggacatatgatgggagatgaggtgagacatgtgttgcttcaacaggtttatttggagcttctgtagcaatatgaggagcatctgtcttcaatgtgccagatccagggttctcagttttcat

SEQ ID NO: 30331 - DNA, 2240 bp, Oryza sativa
gtctatatcaattgaagagcaagcaaagcatcaataccttcatttgcttagaagatgttattagctttttcaagctactggacttcttctttccttttcgagaaccaccgctgatcttttcaacatctttctttttggcagcctttggtgcttcatccccaatgagttcaagatttatactttccgttgacaccaccatgagaattcctcgtaatttcatgagtatatggtcagcaacagtaccagctgacattaatttagtgaaaaagattgcatcaccactacggttagaaatattgctcttcaagtacactatctcctgaaccagcatcagcctttgcaattctttcacgaaaatgggattcttcttacaagacagtgtgcttggaacatcaagacaacaaggtcgattccttctgaaaaaagactgccgtgtgctttcataataagtctctgcaacaaatgactctggttcacctaagcagaaactgaatttctcgctagaagcaatatatgttccttcaatgatctcattagcctgcaaacttaagctattagcatattaggtgtgcctaagccatagcaacttaaccaacttaactactaccaacttatgtgattttcttgccaaattataatcagtatgtaaaacaagcctgaacaccaatacaccacatcaaatggctaggtcagcaacaaagttcatatagtaacaataacaattgtttgattcattagttataacaagtctagtaagggcacatttgttgcaaaaaggaagattaattatcaatccacgtgtataatggaacagaataagtccaaaaggtttcaacttgttatgctatatctaggtgagaattgtgggtacatcaagtcatacaggccaaaagtaacctacttgtgttagcttggtagtaactataacataaaagcaatcctataaagacaaacaaaatatctgactcaacaaaacttcaaaatcatctttatcagaaacaaacaccaataagacgtcattatttgatatgatttttagagaccaacctttttggggaaaaaatgatagagttgagcaaaagagttattcttttcttctatgtacgtacagtacataacaacaagaattccgtatatcatttccaacgccagtaaagcataactaatgcttagtttgatcacccattctttagatgatagcaaaaccttgaaatctttccatggaaagattcacagattttcccttctattcaatagcccattaaatcttcttactgacttaaaatcaaacctacattgtaaaagttagcattaacagtttaacacaaaccaaatcatcacttctttctttcccatgattccatgaaaactagggagcacacgtttctacagagttgtggagcgcatattcagcttgttttccaacaactgattttagaatagcataactatgcatcagtatctttgcaaatgttactttgatcacatatttgctttatttccgcaccacctttctcacaatcgttccttttacacacaaaaaatggcaaagctaactacccaaaatacaagcatcgatgctttcgacttccatagaagatacaactgagaaatggaagcactgcagtatcctaaatccatgaatgcaaattatttcaaaatgcagtacaagtaagcatattaccagtgctgtagtgcccttcccaaagaatgctcccatgatccttgctctcaccctcggctccagcctcatccaccaatccacataccctttctccctccagaacgcatttgctgccaatccagctttctccttgacacccttcccaaccctcaccgtcttcctccccccacctccaccttcaccacctccccccgccgccgcccacgacatccgcagcgcgatctccacccaatttgccacgaactcctcgatcacgtagtaccccttggccttcagccagggcagctcggggaactcctcccccaccattgccaccaggtccacctccccgtcaccgcataggaacctcccacccgagatctcgtccatggccgcgacgaaaccgtcgaggtcgccgaggagttcctccgcgaccgtgatcgcgtcgaggcgcgacgacgacgtgggggaggaagggaagaggaggaggtggtcgaagacgagcccctgcccgcgggatgcctccgcggcgcgggcgaggaggccgcgggagagccgtgagaggacggtgggcgcc

SEQ ID NO: 30332 - DNA, 10247 bp, Oryza sativa
  unsure (1)..(10247): unsure at all n locations
ggtggtcgcgtggtcgcaagtgggtaggtgtgcggcttcgcatccggtggggttggtcgggacctggatattggggaaggaggtaggagtatggccagtgtgggctgggcctgcgttagaggtggccaaatgggccgggccaaacgggccgcgcgcggcacggccggacctgtagcaggcacggcccggcacggcctgctacagtaacgggccgtgccggcacggcccgtttagccgtcccgtgcttgggccgctggccgagcacgcgggccggcacggcacggcccggctactgtagcgggccggcacggcacggcccggggcacggcccggcacggcacggcggcggcccgtcaggcgcggcaggcggacggcggtccaatgggacggcgacacgtggcactaacggctatttgaccgttgaaatttgaaaataaccgttgggaggctaaaaaattcataaaaatttcaaaaaatctcaaatttcgccctataaatagggcatgaaccccagccatttctcctcatcccacactcctcatcttgtgctctcaagtgttttaagtgctctctttgttctcaagtgtgcatttttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggaggcgacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatgctaaacccagacggtacggtacgcagttgggagtacgatcccatggttgctcgggaatctcttgtccggttaatcgccaggcaagatttacccgtgaactttggggagtcccctgcttttgacattacattcagcaatctcataaccctagttttaaagctgtgagtaggcaaacatcaactagagatttacagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcattgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattctactctaacattgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacgagtggaaacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaatttttttttccttatacatttcctttcctttttttaaaaaaaaaaacactgtgcatgcactgtgggctggcggcctgccttcacgggccgccgtgccccgaacggcccgtgggccgcgggcgtgccgtgccggcacgggcacggcccggccatccacgggccgtgcttgggccggcggctcggcacgtgggccgacacggcacggcccgtttcatcagccgtgcctaacgggccgtgccgaaacgggccgtgccggacccgtgcccgtgccgtgccgggccgggccgcccgtttggccacctctagcctgcgtccgtagacgggggagagacatgtgaagctgtgtagctggcaggtggggccagtggggacgtgaggcaaaattcttttgcatttttcacctgttgttcgttattcctttttctagacttggattgatggttccaaatattttgcacttattttgtttttttactaggtgaaaccccgcgcattgctgcgggaatttcgtatgataacaaaaaaaaataacgtgtaagatagctagataatatcagattaagtaaattaatgtgatttatgataatttaaattcaaatagtatgtggaatggtgattcaaacgtaaaaggtaaggtggtatgattttatggaagaaaaaaaataggaagatagtttggaccgtagattaatcatctaaaggctacaaacaattgatgtgatatggcttaattagaggaaaaaaaggagaaagataatttggaccgtagattaatcatttaagcactaactaaataaggataaactatataagtatataggatatcataaaacataataaatatatacattgaaacattatgttaattatgttggacgataatttaacatgtttgtatttgaaaagctcttaaattataaaaactataaaaatatagcatgtttgcatgatgtttaaatgtgatgattgttagtggatgatgatgtggcattttgttaattagtggatgatgatgcggcatcttgttagtgaaagatgatgtgtcatctttacatgttaagcttaaggaattagtgggagataactttatagtaagataggattagaaacacggtacaaacatagacgcttattatagcgcacacacacttaccttacccttatgagcacctccggaagactggagcgatatatcttgagattgacgaagtcaccacgcgtaagtgcgagcatccatatcaaatctagaatttgaatccaagtggcctgggttcgtcaaaagaaacctaactagttgagttacgctcacttcgcttttgctttttgtttttttgttccttttctagaagattggtggttccaaattccaaatctagaattggcaccgtgaccgtccactaatctggtaacctagtccttgtgaacttctctcttatattaagatgggtgatcaactaattattagatgccagacttgagtaatttgtggctcaggccacgattttcattgtttgtggttcaggcttgaagagcgatcaaaaccaacgaagttgcaggtttgatagtgttgacaggttttggtacatttttggtagcacgaatgcacgatcaactaaccaatataaatttaacgccaacattaatcacatcaaaactgtgatcacagctcagatatgatccgttggacaaaatttgtcgttgcatgcaaaatatatcaggcaaaatttgtcgttgcatgcaaaatatatcagggacacaagcacaggaaaccaaacatgacagcgctatcattttgtccctgcatagttgatatattaaatgaagttgcattgacaataattgctgatgatgtaggagtactataaatgtgataaattgtcgaatttactaaggtcagattggaacatcaaaaaagtagtaattccatccaagccattaaaaagcacgcacaggattgcctgtgaaaggcacaccctttgtattctaccattgtacgagtccatcaccatgaattttcccggttaagaagtgattgcaagaaacctttttcagctaattacattttataattaaccaagagtaagttacatgtagtatgccaaaaaatccggccggcaaagtaaagttagtgtacaccaagaatcgaaaatatgaacatcttacagcatgttccattcctacaaaactagtgggatttaggcagggagagctgccggcgtggctgggggaacccggttctcgacagggatctccgtgaactcggagagaatcgccctgaactcgtcaccactcaatgtctccttctcaaggagcacctccacgatcttgtccatggcctcccggttgctcctgatctggctcaaagcgatctcgtaggcctcatcggacaaccgcttcacagcggtatcgatgtcctccgcgagcttctccgacatggagttccttgccatcatcctcatgatgacatcgccgctctgagctcctgagtccattagcgaccacggaccaatgtccgacataccgaatgtaaccaccatctgcagaagcattgtgaccccaggtgtaattagcaaaagaaagaaaggggaaggactaagaacagatgtttaatatatatgtaaatgctgtcagtttttctagcatgttattttgcagcaaatttatcctccagactggtttgtaagtcataaaaggtgcagaagcagaacagattacatagtctactgcttcaaagtttctgtagatcaattagcaaagttctagaatagaaatatagcgtacctgcttggctaggccagtaatttgctgcaagtcaccagcagctcctgtggtcacctcaggctccccaaaaatgatctcctcagcagcacgaccgccaaggccaccaacaattctggcgaacagttgttgcctggagatgagcgttgggtcgtccattggaatgaaccatgtgagaccacgagcttgacccctcgggatcaaagtaaccttttggacagggtcgtggccaggcgtcaaagttctacaaagaatacatttccagatatgaatagttgcacggaattttgatatgcaagtaataaacaaaagcacagttagcaaatatgcagattatctcttacccacaaattgcatgcccaacttcatggtaagcaacaagacttttgctcttcccatctgtcatcacagttccttccataccagccactattctgtcaattgaatcatcaatctcctttgaggaaattgctgtccgaccacgtcggcccgctaatatggctgcttcatttagaagatttgccaagtctgctccactaaagccaggtgttctcattgctatgacttcaagagagacatcagtatcgaacttcttgttgctaccgtgcaccttaagaatctctgtccttccgcgtacatcaggaacatcaacacttacctgtgcaacaagttaaaaggtatatccataatgttagcaaggttttggacatatgaggataacaaaattctaactttgagaacactcaaagataactcaagctcgaaaccaaaagcatccaaactgattgcgtgagtaagctacaaccaagaacgagtatttattggacttctagcctaaaaccacgtgagaacttcaataatacagaacaaaggtaaacgctatagctgaaacatttttacttaattgtgtcacaattgaatgagttaaaaactagaatacaacagatgttcacatccaaaagaatgttcagtggataaaaactaacctgtctgtcaaaacgtccaggtctgagtaaagcagaatccaggatatcagccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttccaccaccaatacctgtccctctttgcctcccaacagcatcaatttcatcaacaaatactatngcaagggagcnnnattcctttccccttttttttgggcccaccccttttcttgaagagatcacgaacccgggaggcaccaactccgacaaacatctccacaaactcagatcctgatatcgagaaaaacggcacaccagcttcccctgcaatagccttggcaagcaaagtcttaccagttccaggaggaccaacaagcagaacacccttagggatgcgagcaccaacagcggtgaacctttctggtttcttcaagaactcaaccacttccatgaagtcttgctttgcttcatcgacaccagcaacatcatcaaatgtaacaccagtgttgggttccatctgaaacttggccctagattgaccaaaaccaaggggaaagccaggaccgttaggtccaccaaggccaccttgtgctcttcttgacagcaaaaatagaccaccaataaggataagtgggaaagccaagtttccgatcaggttgaacagaagagaaccagagtcctcctggttgctgtgtgcagcaaaatcgatattcttttccctcaacttctggagaagctcctggcttagaccaggaagctgcacacgaactctctgcacacggttgccgagctcaggagaaatagcctctacaatggcaatcgtgccattctcaaacaaatcaaccttcttcactctgtccttgtctagatactcaaggaacctcgagtaagacattctcgacgacgagacaccttgctcttcagcaagagctctcttagcacccaacaaggtgggaagcccgaccccgaggttcccaagcgcgagctttaggaacttccttctggcatcattagtcttgtgctcgagggaggcagtcacagaaactggcctctgtgcaacgccactcgaaggaagtgtcgagaagggaagcggcgtctttgcagcaaggctcatggatgttggagccatcttcgctcactgttaaaagtaatgaaagggagatcttgtcaatcatacaagtgttgtatggcagaaattgcttcatccgatacttcaactaagctaatcacttcatatcaatccaacttagctgtaactaacaagctgtcctaccgtaagtattcaagaacaaaggtaaagcatctcttcacaatcacccctacaagtagaagctattgtaatcccttctcgaactacaaacagctacaaccatcatccccaaaccagtatgaaatccgaattcagtagctcaccgtagcttctacttgctgattaacctatcgattggaacgaacacgctaacgatctcagtcccaccatctttaccagtaaaaagctagaccagtactccaaattccgaaaagcatactggctaacaaacagaacatccgcatcgcatcagagaccaaacgccacacacttacacactggattcaagctagaaacagaaccagacgcacgcacccacgcacgcaagcgaaatcgtaaagggaagcactgaatccaaagcaaacgagcacgcacctgagtggatcggagcggggcgtggaggggagagggggggggggtgggccgaactaggaaggggagggaggagggagtggagtgtataaatagcccgacaccgacgaggagggatgcggcagattgatttttcctcctccgctcgcttggcctctctctctctctctccggtgcgcagttgcgtggggatttggggaggaagaggaggagagggggatgggggcgacgtggccgcctccgtgcccacagcgtcgataaggaagagatgagcccacttagacggaagccaaagcccatggagacgaagtgaaatatctctccgtcctggtgaaattggcaaatggctcgtattttttgcgtgccattttcgtagccagtggggttttcctccgatggcttgtagtgtcgtggctgctggactcacggctcacgcaagattggactgcttggaatcctggagatgtgaaggcgacacactggtcagagcatggcaatatgacatactaagttgctgccaacattagttattgggtaaacaaagccagagccgtccatttcccttgcacgacctgccgactgaatttttttcctcgtcgaatttacacatagtgtagaattttcttctatgatgatatactaatgattattctctatctgtaaggaatacgattacacaggcaaaactctgtagccaagatgcagaatggtaaagaattggggagagttacaagcacatgtcaaactgtcaaccactcgtcggcaggatcagtttgctcaggatgtgggaaaacggtggagggatggatgcacacgatgttacagggcgtgaacaaaccaaggcaacctttgtgtttcactaatctgatgacgagatgcgccggatcttgcagaccagatgggcggtggggaggtcgagctggctgccgccgtcagacttgatgaggtcgcggacctggtctctcggggtggagatgcaggtgtggaaggtggcgaggaagggtgggatcggcatggacagcgccgagaggacgttgctcaggtactctatgtccgccgccagctgctgcgcgcctcggtcggtgatgtaatggatccctcgcagctgctccatgaacagcgcggtggcgccttccgcgacctggttcatcatggaaacagagatcagagacagttctagattaattcatcaaaagatttgggttcggtgtttatgttgtggtcagattattggggttttatgtaatgttgtattcagttgcaatgcatgtagttctaaatggtcaactcttctgtacggaatttgcgaaagtcgcagtgtgaannnnnnnnnnnnnnnnnnnnnnnnnnnnnnnnnnnnnnnnnnnnnnnnnnnnnnnnnnnnnnnn

SEQ ID NO: 30333 - DNA, 1764 bp, Oryza sativa
aaagatttgggttcggtgtttatgttgtggtcagattattggggttttatgtaatgttgtattcagttgcaatgcatgtagttctaaatggtcaactcttctgtacggaatttgcgaaagtcgcagtgtgaagtatgaatggttttgtcgatggtatgttgcgaatgtacacagcatgatgaaaaaaaatgctttgaatatattaccttaaatatccattcagtagcaaagaactgagcctcctcgttgccagcctcaccgcctgagataccttctgcaagtggctccaactgctggggtaaagttaggagatactccccaacactggtcacatatgcctgcgggtaggcactgaagcttggaaggggaaggccacctggttcctccaccgatgaccaaattgggaggcgagcaacctcattgagacgctgtcggactttagatatgagcacgtcatagacgagttcatttactgtgtctgagaaggccgcaactctttgtgatgtcagaggtagagcatggaaccttggatcttttgactgtataacagaaatgttatctttaaattagccatgaagacaaacaaagagttacttgtgatacttgggaaattataggtcaaaaaataggttctatgccacatatgagtagcttaaaaaaatgcataatagaaaaggaaagctaaaaaagatctccgaatttcctataaaaccagataatctagcttaatactaccacctaagtttgcaatcaggctgttcaaacaaatcagagaaacatgtgataactctagtgttgtgacactagcaagataatttaaaaatatataacttgcctgttctagtacagtgaagagcttcttagacttgtctggtagatcggtgaggcgaatagctgcaatatcaagtgctgccctccctgtgataggcacttctgcattctcatcaccatttgctgcagttgatttatctaggctagaaccaaaaccagaaatagaaaagttggttccaatcctggcaagagtagcccttaaagaagcttcaaaaactgaggttctgctagttaggcaatcagcaactgtaagaatctgcaaagcaccctggacaatagaccattcttcctcttcagagacatcgaccaatcgttgtgcttcttttttctctagtcctgcttcctttttagaggaatcactatgtgcagtattatccaccccacatacaatcctaagggattttaaagtttcttgtaggtttgatatgtactgcagcataatgtcatctagagccaataccagttcatctgcctctgaaccaccagtaagactaatgcatctctcgacagctgcttcaagaagcactataatttgtgggatggattcctccattctacgaacagtttcactcagctctataccctgtgcacccacaccacgagcaatggccccacggatatctataccagccatctcagcagaaagtaaagcacgctccatttgcccatacctacatagcatgaaacaccactggctgagtactacagcaatagcaacaaaaaaaatctcaccaatgcagttaactgcatgcaacagaatttttcacaagttttttttttaccttgctttaaaagtctcatatggggaataaatagctttcaatgtattcagcagaactaaaagatctgactctgaaaataaatgttggatgttccgagcaaaagtgcccgtcatgttgtgcaggtcgatcagtgctccaagatgctaattct

SEQ ID NO: 30334 - DNA, 2286 bp, Oryza sativa
  unsure (1)..(2286): unsure at all n locations
nnnnnnnnnnnnnnnnnnnnnnnnnnnnnnnnnnnnnnnnnnnnnnnnnnagtttatgcattaccttttgcaacagatctagtttcaggaacagcatctccagttgctaggttgacacgagagacaaaacttgaattcaactcactcatggtttcaacaagtacttttgggactagtgatttgtattcttcagggaaagcagtcaggcaccttcagcattagcattgtagaacatccattaatttttggtggagcaaaaatattgtccgaatgcagctaaaagatgctgccaaaaactggcttctgtttacaagggcaaacattgctgattcagaacaaaagacaacagggtacaatgaacataccacttccattcttgttcaaggtaaagtagtgtctcatcatagaaatttggaagccagctagcaaatgagagactgtttatgctttctccaccatacttctccatctctacccgcttagctctctgttttagatcaaaatcttcccaaagtttctttagaggcttgacatggatcttagtatattgcacctccagtgacttgaatctgccaatacgtatcagtattccacgaagatcttgcacagcatcgaccttccaaccaaaatttgtaggctttagatgaaatagagatgcctgtactactgtttaacaaatataaatgagattagtaagaaaaaccttgcggttagaaagtgcatccaccaaacgaggttgaaccatgtcatctagccgttcttccaatacttcaagctgctttctcacattagcgaactccgcaacctgaaagcaacttttatataagcaaaacaaatagcttctgcatataaactcagtgtactgtgcatgtttgtgtgagagagtacaatacctcaccaactgccgacaagcaatgtctcatggttgccagggtttctgcagcttttggaagatcaccactagaaaatacatcctcaacactttggctcaactgagctagtccagccgcatcctggcattccgaccaacaagctgttaaatctattaaaagataacctaccactgtgagtgaagcatttacttcagtaacatgcaccatagtccacatacaacttacctgtaatgttgcatacgccgcttccattcgttgtttcacagtatcaattcgtgctagtgcagttattgactctgcagatgaaccctcagcctgattgaagaaatcatcatcatcagtaatacagaatttatgaaatgtagatgggactgaatacctagttagttgatcatacatgcatatgtatgtcatatttcattcattaacacccagtattcagcattggccgttacaaagaaggaatcactcagtacccaaaaaaaaaagttctagtgctagcaaattcattccagtgtattctacaaaatgtcaagctaaatgttatgagaagataacgctacacgtaacaagaagtacatgctacaggagaaaatgttttgcttgtgatttgatgtagcatcctgacctatcacctatatgaactaaatgatataagtgacggtatcccattataatagactataggcatagttttatgggcatcactgaactgctggatttgaatgtcctctacagcatactcaaagtttacatgcacataactgcattgcataagtacacagcattataacatcccgacacatgcaaggattttgccaacagagctccagcttggttttgccaagcccacgcaaattctgacttcagtttcagttaacagagatgatcaaattaacatatcatttgataaaagcgtacagcgataaaattgacatgactaaatacagttctagttgtacgcactgttcaatgcaaagcgtacaaggataaaattgacatgaccaaatacagtacgtgagatccagatccaagtgaaaaaacggggggtactaaaagcggccagaggctgaatcatacgcataaatgaatcaaactaaaacctattgtgccaaattggttcaacatttgctcattcgcaccaactattatcgcaagttcgtaatcctccaaaatgatctgggtttcgcgtgatacacgtacaattgtgcacgagtgaactgtgagatccagatccaactagcaggcgagcgggggcgcacctgggagagcgactggaggacggaggcgagatgggaccggagcgagacggcgtcgtcgcggaggcggagcgcgtcgcggcaggcgagcgggacgcggcggagcgcgtcggcgctgtcccgctcgagcgcgg

SEQ ID NO: 30335 - DNA, 14785 bp, Oryza sativa
  unsure (1)..(14785): unsure at all n locations
nnnnnnnnnnnnnnnnnnnnnnnnnnnnnnnnnnnnnnnnnnnnnnnnnnnnnnnnncaaaatttatgtcttgttgtttccagccatcatgtttttattagtatcaaccaaaatataatttatatgtaaaacttttagatcagttctaattaacttaaaaataagcggctctatttaatgagcattttcggctgttgcttttgtgactgcaccatgatcgacacgaatagtgccgcactcactgtgcgtagctacaactgcaaccattgtagccggccagaagaacgctccctatagccttagttatggctgcaagcagcggcattacacccttaacaacaaaaaaatataagttaatacaaccatagccattagcagtgaacccgctaagaaaattaccgatggtccttatgctcatctaacttatgaagcaaccttctcatgtgttcgatttaacttagtaagggtgtcccacatggtataaatacataacttataactgtaaaaaaaaaatcaccagtattcaatgacctctgttgacccttactaggtactccctccattccatgaaaaaacgaatctagaataggatatgatattttatgtccaaattcatagtcttaagatgtgtcgcatccggtactaggttgttttttatgggatggaggggtacgccgctaacagccatgaattccgaataggaacatgctgaattcgggaaaaaaaaaaacaatcttggaagtggttaatattccgtagaaaataaatgtgatggaatatgattttagggtagagttttacatttctacttttatcagcttaaagaaaatgatgaaaatgacacctagaataatttaaaatgaagtttaaaaatttcaatttttaactgcaacctgtaaaccaaagagcaaatgatgagggtagaaatgaagatgcacttcagtttcagataaaatgaaaatgcatatcaattcagtattcggatacaaacaggtgccaagaaggtcgaaaatgtacattggggatgggttgtacaacagcagctatagaaccatagcgcaatcaataccagctgcaaactcaaacgaacttagatgaacacatatctcgactaggtcatagctttgaagatagtccacaacttcagagctcacatttcacaacagtggggcgccctagagactacacccgagtgccccactggtttattgtattattacctcaaatcagtcaacagtatctttaagcattacatgatcacacatatttacatacatgtatacaaagatgtacacatacaaaaacatttcgagccatgccccaccccgagggaaaaagaattgctgagcacacaaaactggctatctacatgaacatgattgatgagcaaaactagcctagggttagagcattattggaagctatacagatgccacggccacaacacgtgctagcgttggtaaactgccggatcagccgtccacaactccagtacaaagagaacacaagaacgtcttgtggaaacaactgaagcttcgtccgcatacaagcagttctccctcactcacttgttaccctggagtacgaaaagttgcttcagcaagatgggataaaatcagattacaagcacctagaaaacgagagtaactgaagtattacatgaacgggagatggcaactctgtggagatccaagattttccatgccttcagacttaattgggtccccaccagaattacatgatgacagcaagctcagctgcaatcaggtagagtcaaaatgtcaggacattgcactataacaaatcgaagtcaaatgcaagtgttgtgtagaacataaaatatgcccttattgacatagctaatgcatttcatatctgtagaaactatataccacgaaaccatgataataatatcctatttagttattcaggaaaaagaaaagttccgtataaagtttctatggctgttgtagccagcccaatcaggatcaaatcctgcaaagtaagtttgagaggacatggatgcggtcaacttgacactagatatccagaagaacacaggtggatgagagtaagcatgtggtaggcaactaatgcaatctgatcacagtaatcatgaaagtagccagtcaattgtttgttatttaaaacattattagctaccccaaacttcgaacacaaattcagctaacaagaaccctaaccacaataactagccaaaatggcaaaccttaacgctagtacagttcaaactctaaattactcataacatgtttagatagctacaagatgcataatatcagtggagaacaaatacaaaaacagaacaacttacatgtgccgcaaagttggggctagttaagttcatggacagatttctcatcagcagtagtacctgtcaatttgtcagatcaaccagtgttcattgcaagtgaaataaaatagttatgtgaagaaaaactagaagtaacaatggtacggttgtccataaaatagaagaacatgaattgatcgaaaccaatgcagtagaatggtgagacaacctatatatatattgatacaatgaattcctactgtgtttagcataaaatatacgaataacttctttcaaatgtggaaagttgcagcagatgattttttagttaagggtaagagctatgaatggaagagaatgcaaagtcttattttggccttactgaacaaagaaaggcttctaagaacaacaatagtgaagtgaaatgttagtatcactgaaacttttacagctgttctacaactggggccccataaatgcacatctgtctaacatttccgctacttcaaaattaagaatatctgtgttgggaaaaggatacgatataatcatagaacattcagaaactatatctcaaatctcaagaaacataccgtttcaacatcaattggatccatcgcctttaaagtctgcaaatgcccactagtatctggatcaaatatgcttcccagaaagctgtatacttgtgcaaaatctggcatagctgcatgtgtaaccagagaggaacaaaattataagaatatagtggaataaagcactgaagcctacctcaaggaatatttaacaatttaaatatgatataatatttcacaataagtaagtcaaggacttgttgcatgacaaaataacattttcaaatttcaatacacgtgaaactatacgtatgtgaatagtcaggcctcaaaggtagatgattacttgcaaccatgcaaacaacatgagaaacttagtttccattgactatagaagactagtctaaacccccccatcagggatcatcaattatgaaatgtgatgcctttgtggaaccaaatcattaactaagttccaacaccgttggtccaacatacaaactaagctgttgatcaacatgcatttgccaagataggtctgcaaaccgtatactaaataaaggaaactcaccacgtagtggtcgaagcatattttcttgttcaactgcttcagaagttggccaagtagtagaaggactctctatgctactagagcagttatttgtagcaacagcacctgtacctgccaaatttagttcgtcaatggcatttgttggatttttctcattaattttggacagaggtttatgagcatagtaggtaaacataccttgcgtgcgacttgcacttaaaggttgagcaatagaattgtcccaggagggtactacagcactggcatttgtatttctgatgacaggagatgtatccatggacataacacaaccttgctcccccagaggagggggttgtgatatagcagctggcgaaactgcacaagctaaataattccgattactacttcccaactagaaatagttgatggcaaaaaatattacaagactgaggctgctgagcagtacaaaccatttttagaggccttctgtggatatggatgagctgccttccgctttggcctgggtggaggcagatgttcacctgtaccatttttctgaaccttcaaaaagtatttttgtgcatggctccttatctgtcaaaagaacagctttttagattttgcagagagaaaccaaaatggtgtaggagcatttcattttaattggcacaaaaaaaacatcttttaaacttgtaggatactaatatgcattttgaacttccagaatatggtcatactcccaaccgttcagcatagggtagttgtgcctgctaatgagcacttactatatttcaagtttgcaaatgtaatttaacttcgcgctcgagaagtgtaatccaagttgatttgacttgaaactatatttgaactaggtgcatagattacagttgcacagaaatgcctgtttctttttaaaaaaagaaggaaagtgaaattccaaggcttcaagcatagcgcttcaattttcatatcaggcataagattctataagtcaataaaatgacaacaattaacagacagaatacaatggtgtgtttcaaataatatgtggcgtgcataaatttcaaatgatgtgtgacactgccaaccagatacatatagaacgcctcaaatcaaacatcaacacgccactccaaaggctagcagagaagaatgaaaacgttaacttgaaaggtagctatgaaccatacctgtatcacagtttttgagccaacgtatgcttcaatctttttccaatcacgatcgaacctaaatcaaacaaaagaaaaggaagcacatttaagaggtgtgtacacaacattgaccaccctaattacaattaatcaacaagaaaattttagcgatcaaataaattatacagaaaagtcaccctaacagccatgtgtatgatatgtagctagttaagttcgaaaagtttagcagtaaccagcaacattaagagatataagtcttataaaataaacaggcccacgttaattcaaattacaagttcaataagattaccactactgttgtatgttcccacactgtcaatatctgtcaatcctctaataataatgttagatctcaaaggttaatagtgataacaaaccagcacatccacattttagaactattttttctctgaattattccaagatgcaccctttaccgtgtccaatcctaccatgcagaaacaaccaacaagagacattaacagaaacctttctactgaaaacatctcgatccaacctatccccactactgtcatgttttcctttggttagcctatagagatcagcctagtgcaaaggaaaactggtctgaatgaatacccacactgtccagcgtttcaaataactggttacataatagtaatactaagatgcaagactgctggaagcctatggcacaaacttggtatgctcgagaaagctaacagttcaggtaacctattagaattcctgacaagtatgatattggaagttcaaagcttgcaacaactctggccaatctgcttcacataaaggactgtttcaggatgaaaactgttatctgtcgcctgctaacaaaaatcatcaagtgatcccttgcatttggatctatcgagcaaaacaaccacactatatgcttattaacaggtgggtattctaacatttgatatcattgcatattgctctttcccttatttataaccttttcaatttctgtacaggttgtaccacctatatccctttatttcttttttggtttagccctacatggcattttgtagcacattttaacttccattaatacaatgtttatcaggtagagcgacctctatcatcccacataaaaaaggaagcaatgaaatgcttgttttaaactaccatcagatgctaattgagttcaggaaaaataaatattgtaaccctaacatgcaggaaattctataaccactggtacatttagataataccaacagcactcttcccaacattaaacccagcaacttggttcacaaatccaaggatcagaatatcataaacctccctactcctacagctacaacgagattgtacttcctccgtccaaaaataaaccaacttttgtaaatgaatatagacatagcctatgtccatattcacatacaaaagttggttcattttcggacggagggagtagacatgaaagaagcacgcctgtcaagctactggcccctactgaacgcatggattctagcaccgtaattcagttaaaagatcaatcgaaaatcaaaacatcatagtctacccaaaatgtgagacctagaaggtagtgcctcccaaccacgactgctcagctcaacagattcgaccacccaattcgacccagcaggctaaacctatcctcaattgaatacctcctccaaaaaaagccgtctttcaaactacccagggttagcattcgcaggaggagcagatgcacaatcgcatccaaactccacaacgacacagacgccaccatacaagattaaaaaaaaaaagcagcacgaaagccgccaaactatccccaaccacggggggcgcgccgcgcgcgcgcagagataagagggagagcgagagacgggggcagaattgggggcactcacagctgcagcgcctcgaggaacttgtcgtgctcgggctccgtccagctctccctcgacttggtgatggtgtacggcttcctcaccttcctcgcctcctcccccaccgccgccgccggtgcaggcacggccatcggcggctgcagcggcgcagccaccacctgcttctccttctccttccctcctcctccccctcccccatccccacctcccccgccgcccgcgacggcggcggcggcggagacgacggaggcatcgatcggattgggcgtcgcgctcatcgaaaccatcagccggggtctctctcgcgcgcgcaggattcgccgcggccgcgagctagggtttgggtgcttgtgctgctggtgtgcgtgcgtgtcgatgcgggggacgaagcgaagagaaaataagaatgcgaaacgcgacgctgtgctgtgcgcgatgtggatgtttctttatacttcggggcgcttcgttgctggccacaagaggggggtgaggctgacgtggagggcccacgtgtcagtagagagaggggtggagttggttgggtttgggttgggttttgtgcaggtctggcacgtcccacgtagtgtcacacggaatgatttgtttgtgctgctgcggtggaacgtgtcctgtgtggtacagtgcaggttggttgactactctgtgtagcgttttttctcttccctcggaggcaggcctgggttgttcatgggccggccaaaacaaggccataattgggcctaaattttgggcccaaaactaaacaacatgcaagattggttgaagtctgagaagtttgtgagaaatgcggcgccatcgtttttgcttatcatgggaataagccaaatggcatatttgtaaacggaaaataatttgtgaatatttttttatatgtgtattcttagtgatctaaaagcaaaggctggaaaataaacttcgacaaaacaactccaaatttaagttgaaaattttatttttggctaataagtataagcataagcgaaaagataatgccgatgatttttctacgtgaccctcttttgtattgcttcaagtttgtgagattcttactatgaatgaatttatatatgaaataaaagttatttttatctatgatataaacaaaatgtctcgtctctaacaaaacaaatgtctcaattactttgatctaccatcggctcaacttttaaggatttctagcgttaacgttctctttgtttaaacttataatccaaagcaaaaaaataggtttttcgtttggcttttcaaagttataacttataagtcactcttacactattaagccacaaactaaattggagaagttttttttaatgtaaagtagatgtataacttcacccttaaacttaaaactttatccaccgacttatagatcattgaaaaaaagacttaaaagcctaaaaaaaaggccataagaaaatccaactaaaaataagcgagttaaagttatgtcaaacaaaacacgctatctctgtgtggagtagcactagtacagatagcttacaagttagtaatctgtaattcaccattattttctcttcaaactgtcaacaaaacacgcagcctctgttcaattcagaactactccgtataagctggtacaaaactgggtctcgattgcctgcgagtagtaactttttcctatttccagaagtttggcatatagtagaaagttgctgtcggtcacccgcaccgtcctctactcctctcaacgtcagatactaagattaggccccgtttacttcgcgaaatgaaaatttttgggtgtcacatcggatgtttgaccggatatcgaaagggattttcggacatgaataaaaaaactaatttcataactcacatggaaaccgtgagaagaatcttttgagcctaattaatccgtcattagcacatgtgggttactatagcacttatggctaatcatggaataattaggctcaaaagattcgtctcgcaatttttcccctaactgtgcaattagtttttgtttttatctatatatataatgcttcatgcatttgtttaaagattcaatgtgatttttttgggaaaaactttctagaaactacacagggcctcaggcatgtgcaccatcagaaacttttcttggttgttgcatgaacagtactactttgaacacagcggaatggcagaaagtttcagtggcactcctgttgttgctagacagtgccagaaagtttcaggcaaaattaagcctgaagcttcttctccccacacaaaatcaatgcggttgatagcacagctcgatcggtctgaaagcgttcatgtccactgatgactcagcgatttctgaatcacctgaaatcctgaatataccttatggtcagactgcacgtagcaacattttgctgtgagctcactgctgaaattgctgatgtaccgagtacgacagtagtagaagggaaggggcatggagacagaccggtagatgcaagtgggtgatgagcattgaagatcttcagaacagtgaaaggacaaaatacaccaaaatcgccgcccaaactcaaattatcttatttctgaattttttaaccgcaaaaaaaaaagaatctaattagtacagtactaagcagattttttttaaaaaaaagagagaaaaaggtgatggtgcttgtgcggtgagtgagataagcactgggaagaaaaatactgtgcctgcctgacgataactcaactccaaggaggcagtgatatttttggattttttaaatatattcatcagtttggtggtcgacccacggaaataggtcatagaaaaacagcaaaaaggcatctttttgaggggtttggttacaatttcttctcccaatttaaaaaccaaaagaaaagggaagaggaaagggaatgaaagatggcctttctctctccttcgctctcatcagctcgagccccgacagcaagtgtgagctactgaactcgagaccctcctgtcgcgcggcgcggcgcggcgagagtggccttttgatccgacgaagctagtaagttccctcgctcatccgatcatctcgtccgatctgtgagctgggttgctgattgatcgtagttgggctccatgagcatcagggtttggccgacctgagtgatgaggctttgcttgttttcctgggtcttgggtggcttcttgcttttgattgttttgattggattgattttttctttctagattgatatctcaatctgatagatatctcttgggttcaattttcactgatgagtaaagatccccaggtggtcgtgttctgagttaggactgggtaggaaaaaaaaagcccctttagatggattcatccaagatccgattagttgattggctaaatctgtttttggaatcagttggttacccaggtgaggttattggcaaaaaaaaagacggttactttggtccccaaatggtagggcatgtaaaagtttagcttatctgcgactaatctgctatgtggtgtgttcctttgtttctttattgtctggtcgatcagttcgattccttggaaagcactcattctgagtaccgttctaccaagtaccaacggatcacctcgattcgattaaaagcagtttatatttttcggattctaatatggagtaaaagaggttataggagttggaactttttagaggcagatcaattacactgaaagatacacactgatgattgtgttggagggaccctcctttggtttgcagttgtgaaaacacactgctgcttgcttcttatccagtccattatcggtagtcactttcataagccatttgctgattggaattggaatccgtgtccagaagatcctagtttttaggcattaattgtgatgagatgtaaggaattcaaacgtgatcgaaatatatccttacaggggttgttaagatctgtatacatttgctgtccaaaaattttaaaacataacggcatgtttccatcttagaacatgtgttgcagctcttaatatcaatcaggcaagaagtgcaatgtttttatcatcttgttggttgctacaagttgttttgaattttttcttatcatgcgaatgcatgttgctggactcctacaataattttctgctacttgttttctttgaagccttttatcagtctaagaccctgccaatgtccatttggagataggatgtcggaacagcaggatagtactagtaaaagctctagctcaagcatcagcagcagtacacaggagagcgaggaggaggtatctataacaataggtagcctcctcgcccaagcaaagaacaacagtgggcatagtcttggaaggcgcctctctcaattgggttcaatcccggtaatatacagtcatccatatttttctttgttccccccttggcatttgttcccttgaactcatcttgagctgtaccatgattaaatataggaattctctctcaattgtacataaatattccaatacagtactcaatataataactaatacgataattattacagtttttaactgcagattgttaaataaaaaaataaagttcttaatttacaatagtgtgccttcggctatgttttatgacaagttactaatgccctcatgtatggcagcacactcctcgagttaatggaaaaatccctaatcttgataatgcaactttggatcatgaaagattgtcggaaaggtaaaaaaaaaacagacctctctctctctctctagaacagtatggccattgcgctttcttatatttctcatttgtcctgatccttcttgacaggttgggaaattatggtttggccgagtttcaaatagagggtgatggaaattgtcaggtttgttttaccattgaacctaaatcatcatttcatttatagatacggtgccgcatcatctacactatttcagagtaacattttgaagcagctgttttttttttgtatttactgttttaaggctgctgccattatcttatactgaatagtgaataatagattggcctacattcttttgaagattaagtggcctgtgttgtttgatctttatagctgatactatgaggtgtttagtagaactacaccttcaccagtctgtacttaaacctgttcccttttcacttgatgccatattgttacagttccgagctttggcagaccagatatttcgcaaccccgattatcacaaacatgtgagaaagttagtcatgaaacaggtggatttcttgcctcaatcatgcactgtcatgaatatgcaactgtgctgaaacactatccctgtttttcagctaaaggaattcagaaaacagtatgaaagctatgtacctatggaatataaagtctacttgaagaaaatgaaaaggttataatccaccatccagagagtttttccattacttttggcctacttactcatacttcataaccatcaccttgcagatctggggaatggggggatcatctgactttacaagcagctgcagacagggtaatgttagctgttgtggtgttatgatggttgaatagtttgtgggaatacatctttttttaactgcaggtccccctttagacttttttttatgcagatatttctgattgtttttgaacgactgatctttctgattgttgaacttgttcatcgtttataccttaaatcctacttcaggacatcaaatgaaactgataaatgcatatatttatgattggcttattgctggctaacatccattataatgtccttaggaagacacctgcagtttacctgtttgataacatgtcattgtttcatactgtttggttgaaccatataaagaagaagtgaccagtcaggttttaatttgtattgatattcatatacccccatctgaactgtcattcaagatgaacgcatagtctgtcaccttggacatcctaccattatatatcatgtttctagatcatctaacacccttttatatctccaattgtacacagtttggtgccaaaatttgtttgctgacgtcattcagagacacctgcctaattgagatagtccccagggatgtgactcccacaaggggtgagaactgggatgctgtgttgctccgatcatcacatacttagttccatgcgacgctttttatctcaccgatggtatctgattctttcatgacccgcattttgtagagttgtggctaagcttctggtgtgaagtgcactacaattccttgtacgcaactgacggtgagtgtctttcttagactatatgaacatcgaattttcgcttatgattcttacatcattaaattctaacattccctaccatgatattttgcattgttagttctgaatgtgctcctgttatgtacaatgcagatctcctaacccgcaaaaccaagaagaagcattggttgttctagggcgtctcacctcgagcttccttgagcttctgctgctgcagttcttttcccttcaagttagcagcatctgtggtgcttactagttttactaccatggcaacccagccggcactgcaattccctaacctgaaagaagagcttatgtacagtttaactttcagtagtatgtttcgcaaggtacaaacctagaactgtgcaactttcagatccatgagtcccatgttctacccggcgagatgtagttttggttttgcatagtatattgagatctatccaggtgcttgctttgtaaaatcatcatgtgagctggctagattttttaccatatataagcttcagttgaattctcgaattccaaagatcgttttgctaaactgaagtctgaatttctcagtggtaaaaacaagcacagattcaacaccattggcaagcgttttgtgggatctctaaggtagtgtttggttggtgggatgggatgggatgggatgggacaaacccacttttagaggtgtttggttgaggggcgagtgggatgggttggtccctagagaggaatattcctcccagatccgggacaaatccatccggcaaaatcggccggacgagctcgtcccacttggatggagcacacggcgtctcctcggtgaccgccggcgctcgtccgcgcccgtgcccgccgcctcctccgtgaccgccggcgctccgccacgactgcctgccaccacctttgcgaccgccggcgctcctccacgaccccctgccttaacaccggtcgccgccgcgagcgagatgctcggcgccatcccgccgctcatcgtgatgctcgacgagagcggttgcggcagctgcggtgatgtctacgcggcgggctcgagtggcggcgaagcttggaggtagggagggcggcggcggcggatccagagaagggggactcggcggcggcgaaacttggaggtagggagagcggcggcggcggatccggcgcaggggatctcccgatccagccgcggcgacgacggtgggccagcgggttgggtgctccggcggtggtggccgtcctgctgctgccgctgtgcttgatccggttgttccacgcgtggatgcaggtggcgcaggcgacggtcgttgacggtgatggcaaacggcgtccatcccatctcttcctcatcctttcaaccaaacaaaaaattggaattatcccatcctacaaaccaaacatgtgagtggaatcatcccaactccaaaatcagggatggtttcatcccatcccacttagtcccgaaaccaaacatatgctaagaaaatttttatcataagacacattttttttcgttgacattaatcagatcaaaattaaattactagttttctggcatttacgatagaacgctgcgaaatcacgtcactgccaacgggacaaatggggcgtgcgtgtccttgaatgttgcaatttgcaaatcaattttgacgcacttgataagcatatgtgtgagacgtgcacgcagcacgccgtaggtggcgcatgtggcatacgtgtttgcatgtccttttacatgtttaagaaacagtttcaacgtcattaatctacggaagcgtcctgtaggtggtcagaaataaaccgaaaaactataaggaataataattgaacattttttttcgtttatttagttttctttcttaagtgctcccttcgtttataattaatactataaaacacttaactttttttaacgaataagatgttaaatatttttaacgtagtttctttttaagtattgacttttaataatttttaataaattatttttattnnnnnnnnnnnnnnnnnnnnnnnnnnnnnnnnnnnnnnnnnnnnnnnnnnnnnnn

SEQ ID NO: 30336 - DNA, 11066 bp, Oryza sativa
aactataaggaataataattgaacattttttttcgtttatttagttttctttcttaagtgctcccttcgtttataattaatactataaaacacttaactttttttaacgaataagatgttaaatatttttaacgtagtttctttttaagtattgacttttaataatttttaataaattatttttattttctagtaaaccgttttgatttattacagaatatgagcaatcgatgatgatgacctaaattttagtcaagcctaaaatttaattaaagaaaaaaaattaaagtgtatagtactccacgctgtgttcggagtctagtgatgggagcgcgtgattaattaagtattagctatttttttaagcaaatttgattttttaagcaaatttgattagctattttaaaaaaatagattaatttgattttttaagcaactttcgtatagaaactttttgcaaaaaacgtatcgtttagtagtttgaaaagcgtgcgtgtggaaaacgagggagatgggctgggaacatagggatgcaaacacagcctatgaaatggaggagagagtactcaagggaaaaaaaaactagataaactcaggttgtagacttgtcgtacttcaccttggccgttcccaacttccatcttttacttccatccccttccctctgcactgcagcaacgcctgcgtggtttttctttgttttttccaacagaaattaatccggcttatatttttctcctgtgaataaaaaaaaaaccagaatctcgaagaaccgaagaaaaccaaaccgaaccgaagagtgcgtgagccattacgtcgtctacctcgcgccgctcacctctcgccgtcgtcgaagccacacgcgcgccacaatttcttttaatcctcggtgagacgagagcacgagacccatccccatcgatcccacatccacggcgctgacttctccagctccactccacgtctcccagcacgaggggaggagaagaatcaaatcaaatcaatcagtcgcaatcgaggggaatcccacaattctggacaatccgagaccctcccgctccgctggattccccgcctccccttcttggattgggctcagctgggatgattggattgccggtcgcggtttgagctgaggagattcttgcagtcgagggggggagggatggaggtgagcaaggaggagttcttgaggcagttcggtggcgactatggctacccgggcgcgcccaagggcgtcgacgagatgcgcgccgccgagttcaagcggcttgaaggtgcgcctaatctcgaccttgtcgattccctttttgccaaattctgggaggaaaaatggaattctattagtgttttgtgagaacaaaaggatggataggaacttgtggcgttcggtcagatgaccgcgtttcttgctgtaactcactgttgtatcgataaatctattaggtttgttgttgcggagagtgaagaatctagcatcctaccgaattttgctacataagcttcaacaattgtgcttgttttgatgtttggaactgcagtagtgtgagctgcaaactatgtaataagaattggctatagcttctatgaagcaaatccgggttgatttccattatatataaaaaaacaaatgtgcttgtatttgtagcaggtttctagatttttaattttctttctttcttgatcttgaggagcagggatggcttacctggaccatgccggtgcgacgctgtattcagaggcgcagatggcggatgtcttgaaagaccttgcatccaatgtatatgggaacccacgtatccttagactttgagacagtgttctggacacttcattgttgttaccttggtagaacattgcactgcagattcttggggatgtgttctttgacatgcttattagatagtcagagtgattcaagcatggctgcgagtgacctcgttactgctgcacgccatcaggtattgtgtgctagttttccagaacagttacttcgggagaatagtgaatttaggctgcctcatggcaatagtatttaagctctatcagtctatgccaatgctcagcattggcacattgcatgatgagtcatcctgcatccattttttttccattttacgccctagttattgctactttcttatctactactacgtacaatgatttgtgccccaggaagttgcatgaattgttttgattccaaggtactacaacagggtgcctgcacagctacatctttactatatccagttatgcgcatggtacaagttttgccatctgctaatttctttgtagtgatgttgacctgtttttcacaggttttaaaatacttcaatgcatctcccagagaatacaagtgcatatttacctctggggcaacagcagctctgaaacttgttggtgaatgttttccatggagtagagaaagctgttacatgtacacgatggagaatcacaatagtgtgcttgggataagagagtatcctaccacaaaacgtttctcagatcattataactctattatctgactagtcaaagcatacagaactatgcacatacatgcaaaactagtgggatatacagctggtttatgtacatagcttgatatcttgataccttcatcagtatgctcggtaatgtgttctgcattcaaacatgaggcaatgaatttctcctgggcagtttctcaaaattccatttattcctgtcagtctatgtgtaggatcatgaaattcacattggcacatagtatcttgtaaattttgtcttcccttagcaaatttctagatatgctctgagtaaaggagctactgtgttggccgttgatgttgaggagggtgctgatctggcaaaagacaatggaagttatagtttgtataagatttcaagacgcacaaaccaaagaagaagcaaagatgtgctttcacacaattgtcagaacggaagtctttcagatatttcaggtcagtcccttatgatttttatttttgtcctttacaattgctgaataacatattcttgatcaggttcaattattgatcaatattgtagaatttacacagagaatttgattgtcttatttccaatctgttaatgatgttttcagttttctctagctttcttttattctttatgagggagttaactgggaacacatttatcattcctggatttttccttaagaagtttgtttatttggtttattggtttgacatggtcatattgtatgaccatgcaatgtggaatgaacatggataactagaaatattgatagcaaaacttttggtttgctctcatttggaagattaattccagtgcgatgcttaatatttatgctcactccccattcatttcttctgtagggaacaattggaatatatttgcattcccgtcagaatgcaatttttcaggacaaaagttcagtctgagcttggttaagctcatcaaggaaggaaaaatcccattgcagcagcagtaagatgcattgaatttgtcttgcaggatcattgccttgttttccttggactctagtgtctttagcatgcttattaaatgcattaatataggggtaaatggatggttctgatagatgctgcaaaaggatgtgccactgaaccaccgaatttaactgtgtatcctgctgattttgttgtatgttccttctacaaggtaatccacatgcacctgttgtgttttgaaatgcttggtcctacagaagtcaccaattgatatcgatatctttggcaaacctgcagatatttggctatccaactggccttggtgctctaattgtaaaaaatggtatgcaactagcaattatcacttaacttagcatgatagttttttttttctttttacacatattataatctaagctacattggataggataagataaattaactaacaacagcaatctgtaaatcgttgccatcattattctttgcaagggaatgataacctttctaatgaccttttctatattttccattttatggcagaggctgctaatctgttgaacaagacatattttagtggaggtttgtggtcacagctcgttatacttggttttgagtaatctattttctatatcctggtttttaacttacctccggaattgttattaaattccaggaaccgtagctgcttcaattgctgacatcgactttgttcaaaaaagaaaaaatattcaacaagttctagaggatggaacaatctcgttcttgaacataacttctcttcgacatgggtttaagatcattgaaatgctcactacctctgcaattgaacggtacgtaagacagtttgggtcctagcaccctatccatgatgtatagtttacaccctgatgttcttttgtaggcatactacatcccttgctacttatgtgagaaacaaaatgctggacctgaagcacagtaatgagataaatgtttgcacaatatatggacaacagtattccaaggttccataactaagttatatctcattatatttctatcttcttattaagaattactgctgctttatttacttttcttccattggtttggattatttgtcatccatataagaacaagccattatgaataagatattctgaagtgcccacttgaattctgctagctctctgcacttatctattcttttctatgtattatgttttaggtggaaggtctgaaaatgggccctacaatcacattcaatttgaaaagagaagatggctcttggtttggataccgtgaggtggagaagcttgcttccttgtttggaatacatttgcgtgtaagagcacaaaaaatcatccttcccctttcctaagtctctgttttaacatctctattggggcatcttcatgtggtgaaattttacccacgcattacatgataaattagagctatgaaaatcaaggttctaaaatatgagaatccaattacgtttttatgaatgacaatatttctttatgagttccatccatagttaatgcaacagcagcacttgtagatttatgaacaagcagctacatgtgctgtgcaagtcctgtgacaggtgatggattatgcattgtggcgattagcttgtacagatcaatgtatatcttatctcaatcatatatctttccacacaagaaaactgatcataacttctgcccaatcaactccagagtattcaattgctcagtctaatttttttgcctctattgttttccagactggctgcttctgtaaccctggcgcttgtgctaagtatcttggactgtcccattcagatttagtttctaattttgaggtactacacaacacaacaataagcataccattataccttcagatgtttcacgtcttaataaagcgaatgcactgtatacatatcaggctgggcatgtttgctgggatgataatgacataataaatggaaagccaactggtgctgtcaggatatcatttgggtacatgtccacatttgaagatgcagaggtgcgaaattagtccattttatttgttaagggcatatataaatttccatgcaaacttaactttaagtagctatcagctatcgctaatctcacctttccccccgtagaaattcctgaagttcctgcagtcctcttttgtatccctaccagtacaattcaacaacgggtacatgttgaatctgaacagtcttaacttaataggtaattgccttataatatgaagccagtgatgtatttctttttttatgcatgtaccagtaacattaatatatttttgtaagttgcagataattcgagtcaaaaggctgtttcagatattcacttaaaatccataattatttatcctgtgaaatcatgccaaggatttagtgtaaagagttggccactaaccactggtggtatgcctaaattctgcacctttgacttgttctttcatttgtaacttattttggttaccttatatgcatagttcataagttattatgtgttttgttttaggcctaatgtatgatagagaatggcttctccaagggtcaggaggtgaaattttgacacagaaaaaggtaaattagcgattcctattttgtgtatctgttaagccttatgagttatgagggcgcgacatgtatgcatttatatggtgtttttatactgacactgcaaatctgcaacctttcttttatttattagatgtcttattcccttagtaaaacatttaatatatggtgaaggataatctgtttaaaattgtggagccaatgtgtcctcaggttttccctttaatgaattgactatattctacaggtgccagagttgggctcaatccgcacattgatagacctggaacttgggaaactcttcatagagtctcccacacgcagggataaattgcaactctctcttcttgagagtttggctgatctaagtgaagaagtagatgtatttggtcagaggtatgattggataattggatgcatgttgagcaaccttacgaatcacccatttgagtatttgattgatccaccatcttttgttcttcgcaaacttcctttggcactcattgtactttgatcacaaaaatgtaaaccatataaaagtggtgggtggattcctacaacattgggcattatatttggtttgcattttatttggtagtattactctagaatggtcattaatgatcgcttcctgcaaaatgctttaggtatgaggtgcaaagttacgatgatagggtaaacacatggttcagtgaagctattggacgtccttgtaccttggtgagatgctcaagctccaagtaccgttcctgcacatatactggcttgagagatcgtccatgtagagatactcaaagcaaacttaattttgttaatgaaggacaactactactaatatcagaagaaagcatctctgacctcaatagtcggctaaattcaggtatccaacctccttcattttccgctcttttcatttttaccgcaaaaggtcctctactcaatcatagaactaattgaactttatcattccttgttggctatgatccaacatagtcagtatgcaatgtatagctgcacattcttttcttgggataaccttgttatgggaacttattctgtagttacatattttgcaggcaaaggggactgtaagcaaaagttgcctgttgatgcaatgagattccgtcccaaccttgttatctctgggtcgagtccatacagtgaggataactggaaaaaacttcgtatcggagaggcctgttttacggtatacattttataacccttaagatcccattgctacaagaccataatttggcttttttgcaattgctgagttactcatttcattcattctggatggcttatgtgcagtccatgggaggatgcaatcgctgtcagatgatcaatctacaccaggactccgggcaggtgctcaaatcaaaggaaccattggccactttagcgtcatacagacgaaaaaaggtaagttggcatgcaaaattttcatcagtggccaacctgcagttgttcttcagtcatgtgatccacattttatacgtgaccagggcaagattttgttcggcatcctattaaactatgaagacattatggaaggggaaaatgagaccattgcagggagatggctccaagtggggcaacaagtgtacccttccacagaatgacttgatgatgaagtagctgtggacatatcacttgagtacatatatggaattgcaagttgcatcagcagcgaccttggtgatgatgaagtgatgattgttacgtatacaaaacacgtcggcatacaaagcattttcgtaattttccaatacgcataagatgaaacaagtttagttaggtgaaaacagaatataccttcacatgtatcacatatatactatagttctcaaaatgcttttatataacacacaaggggctctaagcctaagccctagctcaaacaaaacgaaatgattgtgaagaaaaatgtacagacggaaatggttcatatttcagagttctcatgattacggtttctgtgcacaggttatcagtcatattagcaatcttggtacactattgaatactatttgaaaaccaggtgtggtatcaggacttaagaattacgcaaatgattacatattaagtggatatgacagtatctattaacaaggagaggtgagggcatgttgcatacacgatgaaatgccttaactagaaggtcagattgctctatgctatacgacgccatttgaatttgatcccttgtacctgaaggggaaatggctctagaaactagaggacagctaagtaaaaacacttacattgtcaacctaaaggtctagaagtagaagcagttaagaaatcatagcaggtatagcccataccatatgtacagagcatcacgtctcgtaacaacagggagcaagcaaaagcacagtggcaggtatatgatgatgatgcaagagaaaacgcagtactgtaagttgtgtttcagtccactttgtgcaatgacatgctggtccacatttgagagtgcacaacttcagagttcgatgatacgatttcatccacgtttgaactcaaatatcgccacaacactctttcttcaggctcaaactctttcctcaagatagagaagccttccagggacaagtttcctgtgttgaaacatatgatttcacaattagtaccatgtatgacaggttctgtaaaagatgggtagacaaatttcctactccatccgtttcacaatgtaagactttctaacattgcccacatacatatagatgttaatgaatctaaacacatacatatgtctagattcattaacatctaaatgaatatggacaatgctagaaagtcttatattgtaaaacggaggaagtataagttaccttgtagggggcacctcctcgtcagacaaaacctttatcaacctttcctcaaagggtgtggaatgccagctgacatgttgatcctaacaacagtaaaccatcagaagttcagaacaagtggtgaatttacatataagcccagcttaagaaaatcactagatgagtcagtgataatacctctccatattttctacttgtgtttggaatacagtggcaatcccgagccttggacaacctcggagtatgattgtccacatccacattatcctcagaagtcataaaggcatgtccctcttcgataagattgttctcatcgtacatttggttcgtgtttcctgcgggtgaagatttaagccagcgtgatagactgcacacctcaatattttcatctgaattggactttgatctctctccagcatccaatagcctttggcggtcgagctgatacttagacacctcaagagggaaatgtgaagaattgagtgattctcctttaaccactgaatctgaagagatctgctgtgtcatcttggcagaatctgaaagttgcatcttctgaagcttgttctctgttggtctaaagatgggatatgcgaattgtttgcgggtccgcacacgctttccagacgatcctttatgtgaagtataaacagttctgggggtctgcatatcatctctcaatactagaggagtatgaaagggtgaatcactggaaccatcgttgatgcttttgatgttctggaagggggagttgcctcggatagctgattgataaactgatttaactagtggaagatgttcagtatcttcagtgttaagttgaggcgtcaagatatgatcctccccatattcaaagctgcatagtatgaaaatgaagcatcaattaaatatctcaccatgataatatattaaaaaacttcagacactaatggaaattagggcagttcttaccctccagatgatttagattcaaatgctggagttgcttccactgccagtacatttgtgggaattttatcatgctacatatcagaagtgaaggtatcagagaatgaatattgataaacaaaatattcagaaatgctcttctcacctcaatgtaactttccatattgatttgataggatatgttatggagttcagctggtgtttcaaatagtgtgccacataacttgaggaaatttgcctgtgtagagttaaaaagtgcaatgaaaaattcaacttcacagtaaagtactagtagactatatgtataaagagtatatctcaacagctcagtactcaacaatttaccatcttaaacaaggtctaaacaaaaagggtactggataagagcgtgacttcgagagcaaaaggaaaaactgcagaagataaaaaaatatgtagataacacatgtacaccaatataatcaaaacaggagtagcatcactgagctttccaatcctatatatgatggaaattctggacaaaatcttatgcccaaagcatataacataaacatattatctgcaaatgcaatgctcataagcccataaaaacatttactgaactacagtacaaaaaataaaactcttttttacaggacagatcttactacagttcatttaaaaactgattcaaccatacaccgtaactccaagaaattccacaaccatccgattattgttataacataattgtgaggtgatgtggcctagttatagaacataaggtggtggctgtcaagaccatgaatccaaatctccattctccttccaaaaacagtagtccttgtgatttctctctattttctcaccaatataaaagatatatccagccagcaatactgagtgtttaagaacatgtctactaggacatatacaaggaacgggttcccaggtcatataattgccggttaggacatatatagctcctaattcactgatcactactaggtgcacgaccaaacaaatatggataaacgttctgcagaatcttgcaacaaactctctaggtgctcactctagtactttacaatagaaattagcttagcacttttcatggaacttatgcaatagttgttactgccagtaaatcgagtgaaggcacggtataaagctaattctatcagccaaacagtagaaaaacacaacaagggatcaaaaacacttgagatctagtttctggtaagctgaaggttgcacatacacaat

SEQ ID NO: 30337 - DNA, 16281 bp, Oryza sativa
  unsure (1)..(16281): unsure at all n locations
nnnnnnnnnnnnnnnnnnnnnnnnnnnnnnnnnnnnataaaagatatatccagccagcaatactgagtgtttaagaacatgtctactaggacatatacaaggaacgggttcccaggtcatataattgccggttaggacatatatagctcctaattcactgatcactactaggtgcacgaccaaacaaatatggataaacgttctgcagaatcttgcaacaaactctctaggtgctcactctagtactttacaatagaaattagcttagcacttttcatggaacttatgcaatagttgttactgccagtaaatcgagtgaaggcacggtataaagctaattctatcagccaaacagtagaaaaacacaacaagggatcaaaaacacttgagatctagtttctggtaagctgaaggttgcacatacacaatcagactgtcaacctcaaactagaacgcgacactgacaatagccatccgaagaagtacataatcagacaatagattacatcgcacttgattacggggaaaagaaaaatcattcgagcatacctcggatcgaagctcctcatcgctgccacaatcatcagccaaatcctcatgagatcctcccctccctcccaatcctaaacaatgccacaaacacacagatggggacaacgtacgcgcttacccccacacgaaaccacacaacgaaatcgatcgaatcagacctagctcatcgtcgtccgagagcagctccccgagccgatccttgtgcgcgagcgaatcctgcatcggaaacgccagagaacaatcaccacctcaatccaaatcccctcccaaaaccaaacgatccaacacgaggtcccgcaacgaagcgggagggatatgtgtacgggaggctagggtttaggggggttcccttacgcggcggccggagccggggctgtcgtcgcggtcgcggtcgcgggggtgggggccgaagaaggagaggaagaagccgacgaggacggcgtcgaggaactccaccaccgccctcgcgatcgccgccgcgcaccggcacatcgtcgtcgcgtcgcggcccttcccgccgacgaggagagaggcggaggggaggaggcgaggagaggggatatggtttgaaatgggaagcgaagctgcgaagaggagggaagcattattattattattttattatttttttattattttggggaagcgagaaggatagttgatgggccaggccttcgcgacttcagcccaactattaatagtttgggcctcttctgttttagtcagatttgtcaacgcaccgggccgtagaaaaaaatatgtttgggcttcagccttgctgctctctctgcttctttctcttttttttttctgggaacatatatgctgtttggactttccagcagattgtaaaaaacaaaaaaaaaaagatttctgggttccttttctgtaaatagaagatcaatatctaaggaaactatttaaaaaatattttctcgatttatgtctctgtacacgtacttacctcctgaatattcctactaaaacatacctcataccacatatatatattgacgaacccaaaacataaattaccgaggatcctatatatactaattattcaattatcgactgatattactaattaatatggtataatttagttagaactgaacaatctactcgtgaattcgtgatcctatgacctcgcggaaagttgcatgtcactatatatgtacccatgtgtatataataattgtagacaaagggattcgaccattaagctcgctccatcggcgcagttagtgtcgggccctccacagagtcgcgatctccaacagtagcagcttggattattggagatcgatcgatcgatcagatcaccgcgtctatggacacaacacctgcatccatctctccgcggtcgagaaagtttccaagaaatgacttttcgcctcaatgattcccaacaaaatcgtctcgatcgtctccgcgacaaaagcatggccgccggcgactaaacgcgaggctctatgcacagtgcacacacatgctttgttgttggcaccgccacattgacatttgtggcgatcgatttgatgctgattcctcccttccgctgcatttacatgtgtagcacgcggttttcacccatggataatatcgacacgctatgacgtttgtacgtacgctaactgcctgcactgtttgatttccaaagtgattttgccgctgtgtggtaattaattcgtgtacggctttgcgctgattcattgaatctctcacacactgatcaatcactcaaggtctctacaactcaaccaaaattaacccgtgtcaaaatcatcgagctgtactagagaaaaaaatatatatatttcacattcctagcgcgttgcaaataatatgaaattttcatcgatatattttgtgctattattaattaggagggacacatgatagagttcaccaaccgacggaaacggcatgtttttcatgaaatatcaggttttgagttggctcaggctgataattccgctcggtaatttttttaaaaaaaatcatagtaaatcttttctaaatttcacaaattgttttcaacctttttcatgaaaatcgagaatctactaataaggtgtgattctcgatctagtaacgactctctacacaaccctacaaaggaaatatatttagggttagacgtgcatttaggtacaccatacatatagagagtcgttttagcttactttttaattgaattgaaaattataccatatggtcagatctagtgaggccaagagaatgaagatcagttccaatcgctatcacaaattaaaggtagaaaagaattggagcttggatgaattctacgcagctaattaagcagctagagcgccatgaatgcgcacacagttgacggagcttgcagagaactttccaaaccggagaaagaatttttccaacttcgaaaaggtacatgcaaattagacaaccaacaaagcatgcaatagtagccgcgatccctttcacatgccatggaactgatgaaaattggaggaagaattcgacagcaaagttaattagcttcggctgtacgtctggttgacttgctcatagcttgtccactcaatcaaatgttcaaattgggtttgacatttctgtacttgattgatcagtcgttttgaccaaggaatagcaaatggtgtagctgtaggtttgaagaaataactggcccagaggtgaatagtctctgaaaggattaattggactgttgctgttgttcagggaaactgtcttaacaggccgttgaaaatgtagcaagctgcttagctgcaggtaattaatttgccgtacgccctggttagcactgtgtacacacatttcacacatggttaattagcaaataagtttacataatgatattaggagataaacccagaaaatgaatggtactaattaatttgaatgccaactttaatttctggaaaaacatttaaaaaaaaggcatctatcgagtcacttaaacacttctggtcattctctatagcaaaacgtactaaaaatatctctgaattccagacaaaaaaattacatctagatctatcagggttcacataaattgatctatatctatcaacacgtaatcctctatactacatgggaaatgaagcttgttgttgttgctgttgctactaccactataggatctaataggtaatcctgggaccaccaaaaaaaaatcctatcccaatgtatatttacatatgtgaaatatatttttgcaaaaagaaaaaaacactgtcttattaatatattatgatgcaatcaatttatatttctaaccttattatatttagggtattttaaaaaatatataagttggatcacccatataaaaattctagatacgccaactactattatgggagtgaacattatttgtttgctcacctaaaatagttgatttctctccatgtctagaataaatataagtcaaagttgaaaagttacattttggtttagaattggaaaaatcttacagatatgaaagaatatcgaaattgaatatatactagaaaaaaaactccaaagaaaattaatccaatcgatataccaataattaatttaatattacttctagtcaatgtagtgtgcatttctaaaataaaaaatagccgcgcctagtttttgtaacaaaccaagtaccaaaatattacacgagtgcaaaagcaccttattcacacgtacggcatatgtacacgtgtatcacacgatcgattgaaaaccgaatgtgattaatcaagcatcattttaagtttttaacgcatgcacgcacacggaaaatatgcacactgcatgcgtaatacggcgccgaataagcttaaacttaattggagtttagctaagcttaattggagtagtcatcgttcgtgcaagatgccggtacggcactacgacctttttggcttagctatagactatagtctctaggtagctagctgccacttttgccttttagaccctgcaattgcacgcttgcactattccctatagtttatccgtactcgtaaaataagtcgtttaaaataatatttaagttaaatcttaaaaatataaattataaataattctcaagttgttaagtttgaaaatgtaaaaattatatgaatagatttgtcttgaaaactattttttaaaagtatacatatatcactttttaataaatatttttataaaaataagaagttaaagttatgttttggagaccgtatcgctgtccaaaacgattttatttacgtgtacagagggaatacatttttcctttcgatttggcagctaggataaaagtcacacgggttggtgagatcaatttgacaaatatactgcaaatatattgccacacgtgcacgtgcaaatcgaaaagtttgtgagcaaaatataattaacccgatcaaatgcaagttacgtgtttgcacgagcaactagttaacttgatgattagatttagaatctagattagtctaatgagttcagtgcaagtgtgttactggtttctgttagtagattaatttaattagatggactagtaagggcattcacaatgtagatgaaaactagtctatagaaaataaaaaattccattcagctatcttaacacattgtgcaactagtctgtagcaaagaaataacaagcttcagctccggctgattttttttcctttagtgggacccaccttaattacacacattgtggtggtttctaaaactatggactcccatgtgtgggtaccacatctatggactagtttgccaaatacattggtgttgccctaattgaaagaggaaaaaggtagtacaagggcatatataaatatatgatgtctaatcatcggtggatcgatcgatcgcccgtcgaattgatcatgcagctcgagagaattgcggtacacgtttagactttggggacttgtagaaattaaagcgcatgacagccgaaaagctagcaaacagctagcggccattgtcacactaaaaccatgtgaggttaattaatttattagttatatgcactcctcgcatctcatcttataagtcgtttgatttttctattagtaaaattattttaaattcgatcaaaattttatagaaaatatagtattattttaaaaaacatattattaaaatataataatattagatttaataaaactaattaaatattttaggtgattctaaatttttctataaatttagataaacttaataaagttaacgaagggagtatagtacaagcatgacaagctaactagctagttagggcacgtatagtctacagactgccctgatactggttaagttatctgattaacatatttatataacattctacctactttctttgtcttaattggatagattaacttatctagtactattgttagtccattcacttacgtcttttgggcattgggtttatgatgtagctatatggattaattaatattagatctcttctgaaaggaattaatattaattctcatgtgaccatatggtcctgtttgaaaatatgacataatatatacatatatatagagatatatagagcagtggcggagctaggaaattttttaagcccgggcaaactcaaatatatctagtatttgttacaatatttttaactttaataatttcaaaataataaaaattcaatggtgtatttgccggcgagcccgggcggctgcccgtgtgcaacccgggcggtggctccgcccctgagagagagagagagatcaagagagcatttgctgagtattatctgtcacctattaattacccctggaagcacgctttagaatgtaatgctgaacttaatttataggatttttgtaataattagtattcagttcaattcccatatacccccccccaaaaaaaaatccactagacacgcacacgtttaaaaggggtgcacttagtaagtacttcatatggatatgggtaatgctagaaagccttaaaaaataaaacgggggagtatctttaatatgtggtgtgcatatatgtacgtggtttttaaaaaatgaaaataattaattacgatcaataattcttaaattaatggaccaacactcaagtggtacatattgaattgggagtgcaggtctttgaagcgattgtatatatcattttgatataataatcgtgtgaaatgtaaagctttcctttattaaaaaaaagggtacatatccgagtttagcctttttcagctcatgcatatatgcaactttgaaggggtatacgtcatacactacttatttggagaaactttaattttgcgacgtgtgatgagcgtgctaatttaagtttgcgtgcatttaggctcaggaaaggtggaacgttggaattgaagtctctccttttaattagctaggctaggggtgtgtatctatcaatcagaaaaatagatttgggtgaagtaaacgtaactcaactagttaggtttcttgtgacgtaaccaatccacttggatgctcgtatttacggctaactatttttttcagtggtaggcgatgtatcactcgataacgagacgtttgtagtgacttcgtcaatctctagatatgctgacccattattctttcagtactagacgacatacatgtcaacagcgagaccgagacgtccgtggtgacttcgttaatctcaagatatatcagcccagtctttcggaggtgctcataggggtagggtgcgagtgtatgtatttataggggtgagtgtgcgcgtgttatgggtgcctgcatttgtattgtgtttctaaataaaagaaatgaattaattaggatgcatgcattgtttttactctccgtcaactgcatgtaaataactcaaagaaaatattattttagagtggtctcaattagtagtaatctactatcagtataaacaattactcagtttttgatagttaaaaaattaagatacttagttctactactactactactatttgaggtacaaatattaatacatatgtactcctgttaatagagaccatatatactactactactatttgaggtacaaatattaatacatatatactcctgttaatagacaccatagtaaaatagctatgaaagagaatatggtacatatactggcagtgtcatgtcatatcatcactggcccgggcacacagtgatttaattgttttatttcagataatgaatgggacaaactattttctaattataatgtatatatgccatatctttttcgtggagggggatttaccacgtctcgagatatatgctttcatgtgtgtgactatgttcgtgtgtgtgtgtatatagaatgaagaatttgtcttagtgtagagaacacggcaggcatgcagtagcatatatagatgagccctaagtccatacgattttaagaggtcggcaccgtcttaaattagcatgagggcgacttaatagtataggcatctactagcttcaattcatctataaccaacctaatagctcattcatacaatagttacatactacactattaatatctggtccacttatcatacacatcgtgtgtcttgaaatccgtactacagctggctacaaatctgtagctcgctgctcttctctttccttatttatcttcttaaaatatatttgcagctagcttatagcctgctactgtacctgttctaatggagatatcaattaaaacatctagcttataattaagccttgacttacgattccctagctccttcatcctggctccctggaatatatattctcatggcattatttccgttgttccatatgcatgggctgccaagcctttgaatttttagtatagcaagatagctataacttaacctagctagcttaattttgattagctatagctaatctctatagggaaagaagaaaaacaaaaaggaggagaagaagagtactacacgtgcatatgtgtttctgcgtttttgccaaatgtacattttggtttagtcgcgcacgaatgcttttataagtaacgtaattactccctccatttcacaatgtaggtcattctatcatttctcacattcgtattgatatcaatgaatctagatatatatatatatctagattcattaacatcaatatgaatgtggaaaatgctagaatgatttacattgtgaaacggaggaagtactttttcaatagaaatgtattcaatagaaatgcatctgtcttctaacaaccaacgtctcggtcttgcttgcttttgagagtggtcctgctagctgatcatatagttttcttggaacagtttatagatttaaaagctgaataatctgatcttgcgtacgaatgctactacgtacatgcatgtgcatggaaattcaaactgtcattgctaacgcgacaagtgtacatgcaatatagtactacatgtcgaccatttcggcaacaaattcagtggcgaagcttctcacggcatgcgtggtttaatatattgtccatcgatcaacgtcgaatgtaaagggccaacaccaaacacgcatgatggctagcttccttttcgatcttttcctgattgttgtggggatagatgaattcttatataaattctctccgtctcaaaatataataagggattttggttgaatatgacacatctaggatcatgaatctattcacccaaaattttttatattttaggacgaagggagtatatgtgtatctaagtatgttatcatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgattttgaacttgtttttgttagattttgattctaggtatatagcatccatacatataattagttaggtatgtaatcatggattgtgaaataaagttaaatttgagttgtttggttgataggtataggtatgaatcgaattcttataactaggtatatactcacaatttgaaaattttgaaaaatttaagtgattttgtgcatttgaaaccatagtgcccgggcaccatggtgccccatatgagtaaataaaataaaataaaatatactcattttcctttgcagttttagtgcaattctctggaaagccacataacatgaagagtttatagtcaaatcagtgtgctaatatttctttttttatcgtaacggaaatattgtgttttgcaatgcttcaagtcaaacttagaatgatctttaaacgtaaacatgttttaattatttatatttttaaggcatgaaaataacctttgggccccttataatgggaaaatttaagtatttaacgttgcagttatttgtgtatgaaagtttattagaaaataaattaatccgctggtgaaagtatttttcttaaaaaaaattatatacatactccctctgttccatattattagtcattttgattatttaataaatttatttaggttgatcaagtttatagaaaatattggtattttcaacgcaaaacacaaatatattatcaaatacatatatattcaatctaaatttaacgagattaaattaacagtgttgttatttttttataaacttagttaaacctataaaagtcgaaaaaagaatcaaaataacttataatataatatgtaacgtagggagtagtttacaaatcaagtactcctgcaaattcaaacatcaaagctggatttgtcgcctttcgtctgcatgcttggaccatctgatttaatcggtgagtgctttgctatgcctgttcttttttttatcattccttgaacaccaaaggggccacatttattaattagctaatttgcttcctgataagtttaattactttgtacgtacttaattatgaaccatgttttggggaatatatatcaaaaaaatggaaggaattaatagtataaggtctcattcttttctccaacaagagttggatgaatattaagattttcatggcatgcttttcaaactgctaaattgtgcatttcgtacgaaaactttctatatgaaagttgctctaaaatattatattaatctatttttcaagtttgtaataattaaaactcaatcaatcatacgttaataccacctcgttttgcgtaaaaagcttaatcttcatcttcaggagaaaagaacaccacctaaataaataattgatctgtagttaaatatatacctcctcttcttcatgtgtatctttggttttatgaaacctctgatatagttctgaaatattttccttgagatggtaaagtatggaaattatattaatgttaatacttccatatacacaaacttcaccccttttcaaccttgctggcattcatgtatgatgcacgtacgagtgggtttgatcttgaaaattttctgaatagatattttttactgtcgtctctatatatgcctatatctattgttcttctggctcatttctttggtaagtttctacgcaatttccagcacacaggtaattaaagagatggagttagatgtatagtacgtattagatattccacattcaaaaaaaaatgttgaaaagacaatttcaagattttgatgtgtagagaacttccattaatattttttcttatgcatatgatatgtacaacgaaaatttctagatgaaaaactttaatttctggaggaaactttcttgcaacttaactatatatacaatttgatacatgtctttcatctggattaaaaatgtccaagcttctagctagctgaaattaatggtacacgggagagaatttcaaaagaccgtgtctacgtccctatccatgaccaagttaaagtgaactactgaggatgcatccatgaaattggattggttgggataggatcgatatgttgatagagagatgcatctttttgtcacctttttttatatttttccctttaatttgcacatccgatccctggacacaagaatgtgatccaaaagtccacaattcatttcccatacgtaccgaatgcttggcttttgctcgtcctttcattttccccgtgatgtcactgttgtaatcttgataggtaattgcaaactactaccttgacttagaaagcattttatcacgcaaggtacctatgccagtgtcagagcgcaccaagcatctcatcatcaagctgttgaggaggaggaggacccagaagatgatcaaggaggcgacaaggcgaaggacgaagtacaggaggaaggtgggaagcaagaaggcgttgtcaagagaggcaggcgtatccggatggagaatagaaaatacaaaggggccgaatgggccgtgtaacaatcgttgtaaggcccaactgaggctggtggcaaaggagaggttggagaggaagaaacgcaactatataccagctggcacaagcttgtaagaactcgatgaggaactcggcaaggtggcgatggcggcggcggctccgctcggttgagcgtgagaagtaatctacctatctagttcgagttccacatttctcgtgttcttcctggagtgccaagtcgctagggttcctaacaaaatttggtatcagagctcaagcgatcctaacctcttggttcgaccgtagaattaccgatcaaggattgagactggttcttcggagctacgtctcgcgaaaaggcaactcgccttgccttgattgggttggttgaattcggagcgattgcgagttctgagccggattcatggcgcccgatgagaagttggacctactgttgaggaaaatggaagagaatgaaaagaagagagtagcagcagaggagagatcacgagcggatctggcacaattgaagtcggcgatggaggcaaggttacctcaagtggagaagagggtggatgacatagcttcggtggtgagtacattgagccaaaaggtcgaacagcttgagggcgcgctgcagaaatttggggatgatgaccagaagccggaggaggtgaaggaagagcatctagcaactcctaaagggaaatcatcgtttcagattcaaggtatgagagatccagcccttaactctgcaactactttccaatttgattctgttcaagccactgctgctggtagtttgggaagcagtttacccccaatgacatgtcctcagtttagtggagacaacccgcagatgtggagagcaaattgtgaggtttattttgatgtatatggggtcctgccgagcaattgggtgaaggtggcaactctgaattttgttggcaacgcagcattttggttgcaatctgtgaggaatcagctcattgggataacttggcatgacttgtgtgaaagagtttgtgctaggtttactagagatcggcaacagtccttaattagacagtggtttcatgtgaagcagttgaccacagttgcagattatgtggagaggtttgatagtataatgcatcagctcaatgcttatgaaagtgctgccccaccagattatttcgtcactaagttcatagatggattgaaagatgaagtgcgaacagttgtattagtacaacggcctcaagacctggatactgcttgttctgttgctctgttgcaggaagaagctatggaaggtcagaaatctggatcatatcgaaaaagtgagcatgtcagtaactacatcaaaccatcttacagaaatcaaactcaaattggggtgacaactcctattctacaaaaggtgaccagcaacagtgggggagatgatagaagaacagcagagttggctagatcccgagatgataagttggcagccctcaaagcttatagaaagtccaagggactctgttttatatgtggagaaaggtggggtagagaccataaatgcgccaatgctgttcagttacatgtggtacaggaactgatggaggctatgaattcagaaggtggagaagaacttgaagaagagcctcctgaagaagttgaggaagtacaattgctagccatttctaaacaggctatttcaggcacagaatctagcaagtctatcagactcaggggttggatacagggaacagaggtactcatgttgatagattcagggagcactcattccttcattgaagagcaagtgggaaatagactgtctggggtggagttacttaaacaaccacttaaggtgcagatagcagatggtggtcaacttacttgtaccaggttcatacctgactgtacttggtggatgcagggacacagcttcaagagtaattttacactaattcctttgggaagttatgatattattttgggaatggattggttggtacagcatagtccaatgcacattaattggtgccaaaagtggatagaatttcagtataacaacagtctggtcagattgctaggactttcttccaaaccaactcagttcatggaaatatctggggaacaattgttgggaatggctaagaatggtgctattatgtacatggttcagttgacaagagtaccaccagagcagcaacaagacattcctggatctgtacaatccttgctccaggaacatcaggatgtatttgctgaaccaaaagggctacctcctagaagaacttgtgatcacaagatacccctgattgaaggtgctcagccagttaacttgagaccatacagatacaaccctgagcttaaaaatgaaatagagaaacaagttgctgaaatgctacagtcaggagtgatccagcatagccaaagtgcttggtcatcaccagcactgcttgtgagaaagaaggatggcacttggaggatgtgtgtcgactataggcatctaaacaatctgaccatcaaaagtaaataccctgtaccaatcatagaggaattacttgatgaattgtctggctccaagtggtttactaagttggatttgagggctgggtatcatcagattagaatggtacctggagaagaacacaaaacagcttttcaaacacattctggtcactttgagtacaaggtgatgtcctttggattaacgggagctccagccacatttcaaggagctatgaatcagactctatcttctgttcttagaaaatgtgctttggtcttctttgatgacatattagtctatagcccagacctgccatctcatttatctcatcttaaacaagtgttgcaattattgaggcaagatcattggcaagttaaattcagtaaatgctcatttgcacagcagcaggtgtcctatttaggacatgtcattggagttaatggggttgctactgaaccaaagaaaatacaggatgtgttgaattgggctactcctgtttctgttaaaaagctcagagggttcttgggactggcagggtattatcgaaagtttgtcaaaaattttggaattatcagtaaacccttaactcagctgttaaggaagggagtaccttttaaatggagtgcagaggcaaaagatgcattccaacgtcttaaacatgccttgacatcggcaccagtgcttgggttacctgatttttccaagattttttatgtggagactgatgctagtgaagcaggcataggagcagtgttgtcacaagaaggccaccctattgcgtatctaagcaaggctttggggccaagatctcggggtctgtcaacatatgagaaagaatgcatggctatactgttggcagtggaccactggagggcatatttgcagcatcaagagtttgtcatcatcaccgatcaccacagtctggttcacctagctgatcagcgtcttcacactctttggcaacagagggcttttaccaagctattggggctgcaatataagattatttatagaaagggaagcagtaatgctgtggcagatgccttatccaggaaggattgccctaatgacgctcaagtgttagctatctctgtgtgtacaccaaagtggatgcaggaaataaccaagggatatgagctggatccccattcgtctcagctactcattgaattgttagtggactctgctgccagggaacatttcacattgcaaagtggtctcattcgttataaggggcgcatctgggtgggtaataatgaggatttgcaagcaaaactgatttcagaattacataacaaccctatagggggtcattcagggtttcctgttacatataggaggattaaaaggttatttgcatggatgggtatgaaaaaacaagttaagaaacagctgcagcaatgtcaggtgtgtatacaggctaagccagaaagggttaaataccctggtttactccaacccctaccagtgcctgcaggtgcctggcagacaatttctatggactttattgaaggtcttccaaaatctgaaaggtacaattgtatttttgtggtagtggacaagttttccaaatatgctcactttgttcctttgacacatcccttcactgctgaatcagttgctaccgctttcatgaaaaacatttacaaattacatggtatgccaaaagtgattgtttcagatagagataaaatttttacaagtcaattttgggagtacttattcactaaatctggtactgaattacatatgagttcttcttatcatccccaaactgatgggcaaacagagagagtcaatcagtgcctagaattgtttctgagatgttttgttcattccacaccacataagtgnnnnnnnnnnnnnnnnnnnnnnnnnnnnnnnnnnnnnnnnnnnnnnnnnnnnnn

SEQ ID NO: 30338 - DNA, 2849 bp, Oryza sativa
ttctatggaggattgtgctgttccagatctgcaggagtggctcagggatcgaaaatttatgcaccaattgattcaacagcatttgcacagagcccagcaacaaatgaagttttatgcagacaaaaacagaactttcagggagtttcagcctggtgattgggtgtacttgaaacttcaaccttatgttcagacttcggtggcccgtagagctaatcacaagctatcgtttaagtactatggtccatttgaagtgcttcacaaagttggccaagttgcttataagttgttgctgcccagtgattgttatatccatcctgttgtccatgtttcccaactgcgagctgccactgggttcaagcctccagtacaacacagtttaccatccagtgctggagctatgcaatttccacttcaaatcttggatcacagaattgccaagaaaggtaatacaattgtaactcaaatattaacacattggtcaggttcttcggtggaggatgcaacctgggaggacaaggaggagctgaggagccgcttcccacacgcaccggcttgggggcaagccggttcccaaggaagggaggatgtcagagcgcaccaagcatctcatcatcaagctgttgaggaggaggaggacccagaagatgatcaaggaggcgacaaggcgaaggacgaagtacaggaggaaggtgggaagcaagaaggcgttgtcaagagaggcaggcgtatccggatggagaatagaaaatacaaaggggccgaatgggccgtgtaacaatcgttgtaaggcccaactgaggctggtggcgaaggagaggttggagaggaagaaacgcaactatataccagctggcacaagcttgtaagaactcgatgaggaactcggcaaggtggcgatggcggcggcggctccgctcggttgagcgtgagaagtaatctacctatctagttcgagttccacatttctcgtgttcttcctggagtgccaagtcgctagggttcctaacagccagccacagaattcttcttctgtaccctgaccaaacacgcatttatcaatttatcaccagcgacatgtgcatatccaagaggagaaattttgagcatctctttgaagatttcaaataaataattcacgcaatgtgatttaatctgttgccaaagtcgtcatatatatcaagctaagaaggaacttaaattctctggctatattaataaacggtcgagaaaattctttacctagcttgctatatagatacttccctagccatatctctcttcctaatttctaatgcaaggtacatataatatatgaagctatcaatttgaactcaatcactagctaacaagtgactagctaggaatggaatttttaaggaatatatataaatatgctcaagccgatctttaagttcatgctttcacatatgcttttgatcacatgctgccggtgctagctagttatatatactgtcgtcagacataagtcatgatattgagatatatattcatatatatgcagctaattaataagtcgatcgctgcatatccctttcccattttattggggaaaatccagagaagagagagttgaattgacctcaaatatataatttacttttgcatgaagtctacctttgtgaattcaaaccaatatatatacaattaacccgtacatatcaagttgaaaacgtacgtagacacactagtacattagtactagtatagtatatcttgaataattttgtcaaacacatactagccagacaaataagatggctaattaatgttcccgttgaacaatgtaataattcaaagaaatatcaatatctcattttcagtttgtcaaagagagaactattcacactagcaatagtcattgtatgcagacccagacaaacctatcaatgaacagtacatgtcgatcccaatgggaaatgcatgagctacttgaactcatacttcgctgtctcgtgaacagggacagcccccaaactcttcacaaaactggggttcctatacttattttaaaactttttttttcttatctgtgttcagtaaagtagcaagtgagcatgaatgtttgaccggacttggtcagaaaattcagccttctctctcgatctctctcctctccacacattcgatttggtacgtttctgcacggtaggcaacaaacaagtacttgaatatatatatacttcttgggggtgttctccttcttcttcttcatatatcatcatcaccatctttatctccctctctctctctccctctctgcatatatatagctacttcgatctctttgtagcaaccatcagttagctagctagcttgaggtagctagcgcttgtatttatcagaagcttagagataattttcagaagcttagagagctatcttagctacaaggaattaccggccaatcgacggcgagatcgatcgattgatcatgggagggtttgagaggagaggagttcggcagtacaaccggtccgaggtgccacggatgcggtggacggaggagatgcaccggcagttcgtcgaggccgtcgagtgcctcggcggccaggacggtgagtttgaaacaccaaccatggatatgcatgtttggtattgatcaattcaagctatatgagcagattgatcatgcaattgcttaattattgcatggacatggagttcgctttgatgatcaaattaattgggattttaatttgctaggtatagatcgagctatcatgtttttcaagggaactgattaaacgaagtgctttcttgttctttttgttttttggtttagaaagtttggtctccttaattattagttggtgtcggttaggcaggag

SEQ ID NO: 30339 - DNA, 1802 bp, Oryza sativa
tttgatgatcaaattaattgggattttaatttgctaggtatagatcgagctatcatgtttttcaagggaactgattaaacgaagtgctttcttgttctttttgttttttggtttagaaagtttggtctccttaattattagttggtgtcggttaggcaggagtttgaaaacgaacacagcgtagcaggagtatagttaaagaaaaataaagacacgtgatattatatgtgcatatgcacgatgaacacccacggcccgttctcttttggattttctacggataattaagactgaattaagcatacaatttaataagagttaattagttagatggaatatcattagcacaataatttatcaattggagccactttcatcctcgactagctagatatatatctttttccaaaattaaattaatatatgttcttcttgacgattttttatttttagttttcatctgaaagtaatttagatcaagtactttagatatttttacactctttttctacctttaatcgtgcatatatttgtaccttgagtactaacagccattttcgtatgtactcagcctgaagtactgatcagttattatcatttgcaaactaaaatatttcaaaagtttcaagtactatctcatttgaacattaccgtaattaattattgtgtgctttatccagcacggtccggccatacgaagctgaacgtactatcgattttctctatccttgagggagacataatataatttttggtctcatgatacatgcatggaccatggaataacagtactgcatcatgatgatatttgtttgtagatcattcttcagaagtgctgataatttatctcctctcgcttttgtctgacagaagcaacaccgaagcgaattcttcagttgatgggcgtgaagggagttagcatctctcatatcaagagccatcttcaggtaattttgtagacccaggacttaccttttcagatttgtatgctaataatatacatgcatatgtatatatgcagcatatgctctttagatttgtatgctaatattagctagagatttgatccgtggctcaacctcttttttctctctcttaaataatggtcagatgtacagatcaggctctagcaacagcaatcatcctgtcagcctccagaagttgacatcagctactgttaacaacattagcaaacgtgagtttgtgaatagtgaagatcgctgcatttacgcgtcaggggatagaaacactgcatcttcagacaagaatacttacaccatactccgctgcggccgctcatcaatgtgagtgtgagagagagttaattagtcatttttcaattaatgttaattccaagtacatatgtgtgttatgaatttttcattttattcaatatattgatttttatacccacttgcaggccatcaatagaagaaatattcagaaactgggaacaaaccagagggcgtcttcttccatggaactccaacgtgattacaacagaacaggtgcctttcccctcactggaagctacgcctcaaataatatcacttaattgcatatatataatttgcattttcgttggacatctgtctgaatttttagcatgtatacatcttggtgtatatcctgtattccattcatgtagagagataggaaaaagctatggacaaatgcagacgtattttacttaaagaatccatcttccatatatgtagtattccctagaagtttttgttttggaaacatgcattaggtggcaggctgccaaactagcaaaccatactgccgtgtattgactg

SEQ ID NO: 30340 - DNA, 4866 bp, Oryza sativa
  unsure (1)..(4866): unsure at all n locations
ttaattgcatatatataatttgcattttcgttggacatctgtctgaatttttagcatgtatacatcttggtgtatatcctgtattccattcatgtagagagataggaaaaagctatggacaaatgcagacgtattttacttaaagaatccatcttccatatatgtagtattccctagaagtttttgttttggaaacatgcattaggtggcaggctgccaaactagcaaaccatactgccgtgtattgactgttcattcctgcttctgcatgcatggtcgaaaccatgaactatctagactatctctgaaacacttaattacaaatttaaaatccatatatacatttttcagcaagcttattaacactgaaacgtagattaattaacatatgtatatatctttgcaggcaacgactagagcaagtcgtcagactactaactacagtaagcctctgaagcagctgacagactgcgacctgacgctgtcgatcgggcagctgtgggacgacgccgccggcagcgacgccgacggctccagcacgatcagcgaggaggtcgccgcgccgtcgagggacgaagcgttcgtctcttcggccgatgaccacttcgccgccgccgccgcgaagaaggagagcaatatgctgaccactgatctgaacctggacctgaccatttcatcttcttggctgtcctgatcatatgatcattcagttgatgggcctgtgtatagctgcattatatttgtgcatatatgtagtagtatgtgtacaaaaataacgcggagagagagagcgtcaggctagtagtatttgcaggttacctgatgagatgatcttagagagtgtagtaatattctggagatttctttaggattattttcttatggtcagacacagcattttattaggtttttcagtagcgcatgcacgcgtttatctgtatagttttctttctattattaattgttcgttcgattagagaccggggacttcagacgaagacgggtgagaaattttgacagtttttgcttctcttgggtagacttctctgttgaatttctcacctttcatcatctgggcagttcccctatttctgatcgaattgtttgcgcaccactatctatactgattgagaactactccctcaattccaaaatataagggattttgatcggatatgacacatccgattcgtagtactaggatattttacatccagcaaaagtctcttatatttgggaacggagggagtaatggcgttacttgctagccattttacccttggctttcatagtgtcaatctggatttgtagctagctgctcttcgtcccaaaataaatcaacctcgtacggaatgtgacacatcctagtacgatgaatctggacatgtctcgtacgaagttggtttattttggtagagatagctatgtatcttggtattcgcaattttttttcctatagaacatgtcatcagttctcttctccagagtacttcctccgtttcacaatgtaagtcattctagcattttccacatttatattgatgttaataaatctaaacagatagatacatatgtctagattcattaacatcaatatgtatctatctgtctagattcattaacatcaatatgaatgtgggaaatgctagaatgacttatattgtgaaacgaagggagtactatatattgttctgcatgcagtatacttcaaacttcaccatatatctcaacgggacatttagtgcaaattatggatacagcaatcatcagttcagatccaaattttgaattcaaaagccggtcattatcgatgtttagggcaaaatggtcggaaacgatatcatttctctattaattttagattatggaatagtctcgatcgatacggtaatttttttccgtatttataaatttaactatttagtgatgacgacttcaatatgatgctgataaaaatataaaaaagaaaattttatatatagttagaaatgaaagtgatcggaaacaatattatttttaccgttcgatcgggaatttctataccattttcagcccaaactcccactgcgtacatcatatcatagtactactatgtttgtcatgggacatatagaactaaacactttgtctcttaattatatatatcatattacttcctctatttttttaatatatgacgctgttaatatttttatatatgtttgattattcgtattatttgaaaattttatgtaaatttaaaaacatgttagtcttttttaacatgttgaatgataaaacaatgcataaaaaaactaaaaacaaatgataattacatacttttgtaattaaataacagaaagttgaataaatggttttaaacagtttataggaaatgtttatgaaggacatttttttaaaataaatatagtatttggatgcttgggaagtgtactcgtgataatgggtcatctattagctaaaaaatatgtccttaaaaaaaatcttcgaggtggcttataataataataaaggccttttctactacggaatttgagaatttgccactcctaatttcaatcttgattttgcccttttcgatcagttgggagatttgaggatttaccacttctattgcaatctagagttttctatctatatgtgtctatgttatatagcatcaggaccatgcttaaggtgataagttgtgaagcgagtgtagctcttaacgcaagtacaaatctcaaattaacttcgtacgggtgctcatatttataacttttttttcaataataaataataaatccatcaacaacgagatgtatatgatggcttcatcaatctgaagatgtactgacccgatacggaagatgattatatagtactatgatatagtacgtgtatatgttgatagaaatgagtatgcacctaacatgcggatctgatcaacgcttgtgtctaaagtgtgtttggaaaaaaaaagaaagtattaaattttccattttttctgttgtgtcgacaaaatgcttatgcctccctattcgctggcaccatccatatgcttgacaattgacgcacgtcagcatacatcaatgggcagatgaaacggactgtaccagggtcagcccagaaaggccccccaaagcactatcaaacgggcctgatcgacactactgggctggcccgctacacggcccatttagccacctccagattccagttcgttcccgatccgtccacgcaacgcaaattcccacaaaagaaagcccagaagcagaaacaaatcgaacgctcatcttttttcgaagaaaaaagagaaaaaaaggaaaaaaaacctcgtcggcgatccgccgtgcgcctgccgccggcgggaggggaactccgccggagatgtcggttctcatagtgaccagcgtgggggacatcgaggtggacctccacaccgacatgtgccccctcaccaccaagaacttcctcaagctctgcaagtaagcttttagtttacccgcacctagggcttgttctatgtgtgaattttcgcgggatcatctggctactagaggtaacgagggtctcgtggcgggtgggttagccttcaggaagcagttgagcgggcaattttggcgttgtagagcgggtgctactgggtctggattcgatgtgaagggtgcgtgtagtgtagtgtgttggattgattgattacagttgaagctgctgccataccagtgtgtcgtgaatcattgtgaatgctcttgttcccatgttacttcgagtttcgattgcgtttaacttgttagtgtagtgctgttaagttgatagcatcttacaagtgctgttggtagcacttgtctgtggcgctcctcatatgacaatctgtattaaccatctctgtacatgtctcttggatattttcaacgttattcacccagtgtttgcatgatttttctttttgttgcaacatggcgacatgcttcatcagattttgctgtaggactttttttttcttgcaacggttttgatgcttctgcctgtcatgtatttgttgcggccgtagcccatagtaggaaattgtggcatttgtagtggaaaattgtttcagcggagtggacaaataaactggagcagacaattgtttcagctagaacatgccattgttgcgattgtagcgagaaatcgtttcagctgcaacaaggaaattgcttcaattcttcttttggaattgttgctacgtgagtagaatatcattgctagctaagccaccaatatttatatctaatcgttgatttgatttgtgagggatgttgatattgtggtagacattttattttctttatgattagtgataaatgaaagcagctgtggtacaatttagaagagccagaagttgacttccgaagcaaaagattacggcctccgtggagtccatgaattggttgatttaatggttgcttatatagtagcgaggatcacttatttcagaaacgtctgacaatagctctcggattgaacatccgagcactagttgttatcattagtatttggttctagggatgaggtgggatgaaacaggatggttctacatttttgggatgaggtggaatagaattgtttcgtttagttgtttggttgagaatgggatgattcaatattttgtttggtttaagcgagatgggatggaatggtccaatccagagtttggtttggagaatagaattagattttctttttagaaaatgggataaacccggcctctacatccaactggatttacgcagccaagaataagataggattgactcaggtaacctgcaccttagactggggagaataaacctttttttttaaatttnnnnnnnnnnnnnnnnnnnnnnnnnnnnnnnnnnnnnn

SEQ ID NO: 30341 - DNA, 6315 bp, Oryza sativa
  unsure (1)..(6315): unsure at all n locations
ctgacaatagctctcggattgaacatccgagcactagttgttatcattagtatttggttctagggatgaggtgggatgaaacaggatggttctacatttttgggatgaggtggaatagaattgtttcgtttagttgtttggttgagaatgggatgattcaatattttgtttggtttaagcgagatgggatggaatggtccaatccagagtttggtttggagaatagaattagattttctttttagaaaatgggataaacccggcctctacatccaactggatttacgcagccaagaataagataggattgactcaggtaacctgcaccttagactggtgagaataaacctttttttttaaatttcccttatttccttttccccttcttaatttttctctctcccttatcatctgtaggaatgagctttcctggctacagcttcttccttgtcttcctctctcttcattattttgttcacatccaaaactatttgttctccagattcctgagtggtgctatggctagtgagtggaggaagcggagtggatgacgccactttgctgcacaagccggcgactctcatgagcgcgtcaaggcagtgatccactagcggcatcaatggtcgagtgcaagaaaccttttaacctcatggaggtggtagcccactgcttctcagcttgaggagagtggtggctgctcgcagtctcgcagatgggcggtgaacaaatccagcgagaagctctcccccgcactgctgaacattcttgcatgagttcatctgggcaaaagagtggtatcatctcatcctgaatcttgttggaatattcgtcaaaatgaaactacctcgtcctgaaatgtttcgtcccatcccaagaacagaacacatgggctcatcccaggaccataaccattcgttctatcccacttgatctcaggaaccaaacacatagaggattgttctttgattcttagtgtcgttgtctgaactaaaattatgtaaatatgtttgtctacttatcttgcaaaagttaaatactgcaaaatagcaggctatgaaatatgactgagttgactacttatggcaattggagtaatcattctctcgctgttcctatgattttacttaccaggatgaagtattataacgggtgcctgttccacaagatagagaaggatttcttggcacaaactggggactcaactggaacaggagctggaggcgactctgtatacaagtaatcaattaatatagcgcaataggagcctctccttctgtttcctgtaaaaaaataatcaattgctcagatgtctcactgccaccgattgtcaaatacatgcctgaaaacggattcattttttttcctgtagattcctttatggtgaccaagcacgattttttgatgatgagatccatccggagcttaggcattctaaaatgggaactattgctatggcaagtgctggtgaaaattgcaacgcctcgcaggtgtgatacttagtccctaaacttcctaccgaacccaaatgttttgattaccagtaattagtccattttgatgtcctcactgctgtttttagcctttcgtttatgtttgtgtgacttattagttctacatcaccttgcgggatggcgtggactacctcgatgataaacacactgtgagtagcaccttactattattacattgacttagagattttttttcttgaaaaaccctactttatctgcagtgactcacaagtatatcttcatcaattgtaggtgtttggcatggttgctgaaggctttgacacgattacaaagattaatgaaacatatgttgatgataaagggagaccatttaaggatatcaggtaaaatacctttgaaaagtactaaactgcatagttagaacatgcttgccaatatttacttactttctggtctttctgttgtttctgctttatttccattgctgaccttctgcaaaatacttaatgaacaggattagacatacatatgtcttggatgacccttttgatgatcctcctcagctcagtaaacttattcctgagaattctcctgtagggaaaccacaggatgaggtaatatgagttctgctattgtgctcatgttggaaagacaataatcaaaattgactaatcagaatcacaggctgtcttacatttgtttaattcgttttaccttccacattgttgaaaactttataacaatttatttgggcacatacctgtttaagagtatgtatggattttagttgaggcagccactgggtgtacatgtaatttattttccctgttctgtctgtaccaaattatgctaaaagttcctatgcaatgtcctgctaatgtactatgttatatattttcttttcaccgtcaatgtacagattgcagaagagcgcttagaggataactgggtccctccagatgaaacagtggctcctgaagaactcgaggatactatccgctccaaagaagcacatacaaatgctgttattcttcagagcgtaagtcctggtgccaaattaaaatccaaaactacgcttattaattattaatcatgttataacttgtgactcataaaacttgtcttattcagttaggagatattccagacgctgagatcaaaccacaagacaatgttttatttgttcgtgaactcaacaaagtaacacaagttagtatcggctcttaattgattaactctgttcgccagttccactaatttttttgcttatccatcctgctttggtagtagcactacgtacagattcttatgtatagacatttcattcatttaatgctcctgtgattatatcacagattattttggacatcataaatatcggattgatatcccatagcttatgaaatattttttggtaagagaagctaaagggctaatattcattgttttgtaggatgaagatttatatacaattttttctcattttggctctgtgacgtcgtaagtgccttttcctaagctcaaataatttgcttatcttcctgttgcttctcttgttaatttttttaattgttccttgcagagctgaaataattcgtgactataagactggtgatagcttatgctttgcttttattggtaagtttcattcctcaaaagctggggtgcattgacatacttcgatcaagcattggatttagacagagtcctgctatttttctggagtaccctgagcccagtttgttcatcgaatacttgcctgagctatatcactagatttcgtaggcattcatcatccagttattcagttgtgttgtacatcagcctcttagagctgttatcctaacagggctccaactgaattacctatgcaataactgttggtgtttattgaaaggcatatactttagttgcagcatgtaaacacaccttttattttgttactatatacccgtgcattgcaaatggtcccatactactgaaaatgggctaggggctaatatatggatctaacataaagtgagaatatatttttatccaacaactattccctttttttcccgtctttcttagcgatttctttttgtgtgtaacaatttttctctagtgattttttttatggttccaaaaaaagaaggtttctgctactgttgctagattttctaaaatagtttttttttgtgcggaacctttttctccagcaattttttttccatgagcgagggggagggggtgggaaggaggacaactgtgcttttatagtagtagagatagctagtaatatacccatgcattggaacgggtccgtactactgaaaatgggctagggactattaatatggatttaacataaagtgagaattttttttatctaacaacttttcctttattttttctttatttcttagcgatttattttctttttgtgcagaacaattttgctctagcgattttttttctggttcaaaaaattaaacgatttctactactgttgctagatttcctaattttttttgtgtggaacctttttttctagcgatttttttccatgagcaagggggagggggtgggaaggaggatgagtgtgcttttatagtagtagagataaactcgcaaatggataaaatacatgaattgtcaaagaagattaatggtgttttctcctaaaaaacaaacctaatgatttaagaaaacaaactgagtgactccattgtacacttctgaggtattaaaccatagaagttaactgatagctcaactgttctcagggttacaatgtcagtgcaacatatttggtgcagactcaagtagccagtagatggcctaagaaagaatctctcttgttccacctggattaattggcaagatcagaatgttgttacaaaatactaaaaattatcttggtcttttgtagaatttgagaaaaaggaggcatgtgagcgcgcattcttcatggttagttgcctaaattcctgtttccagtggcagataaaatttcttctcttatataattatactctataattccttctgccacctactccctccgttttatattataagactttctagcattacccacattcatatatagattcattaacatctatatgaatatgggtaatgctagaaagtcttataatatgaaacggaggaagtagcattctagcatattttttatatatttatttatgcttgactagtgaatgttacctagtttctgcattgacaattcagcagtctatgtttttgtaactatattagagtgttttcatgggagcatttgcttactcaatgatatgcttatagatggacaattgtttgattgatgatcgaagaatacgtgttgacttcagccaaagtgtttcaaaacagtggcgtcagttcagacaaagcaaaagtaatgcaaataaaggtaagataagtcatgtattcttatttccatggcttatcgttgcaattccagcttcttttttatttaagctaactgcaaaatcagtaggggaggtgctctactgttggttttttcctttaaggaaaagaactaaacaaatctattcctcatcaatattcttttcatctagacttactttggtggcactcaaatatgcatattctcatttcaaaccatagttgtagcattctgtgttcattagaaattcttgaatcctataaggaattttaccattttgtaccatggtgaagatgtcgagtcagtagctagtacctttaaatattttcaagtgaaaagatggcaacaatgttcccaataagttgggggcaaagaagaaagaacacgtcgatctgagtaagacttcaacatgtattttgtccttagcatttcttacttaaatctcttgcttgaacatgcatttgttctttggagttcatctgtaaataggagaagtgtgatatgaatacctcgtcttagtatatcagtgagtgtgaagatccccaaacagaatctaattgttacatgagtctttattttttcagtttttggcaaaactctgaagcacttgctgcatacagttcgtattttcatcatttgctaggcattctgatactcggattgttggtttctttgtatatgtaatatatgcgatccatgtagatagccctgcactgaacttaaccataaattcttccagaatcaacgggaccgtgttttgttctttacaacacgagctgggcaacggacttgaatgataattagatgctttaagaacattcctctactagagtaacttgtataactggtgactggtgagagttctcgtaacatctctgccagacaatattaagccatgaaatttctatttctctgtagaaaaagttgttttcaggaatacgcgagacgcacatttttatattaagaaggaataaatgaaattacaggggggccaaacaatttaaaaaagaaggggacagggtacaggtgtgggggggaaacagaaatcctaatctcctaaggagtttggcgacccgtgaacaaatgaaggaactaccatggccggtatggctgccctagccatccgccaaactgtagaaaaagttgtgatttatgaaatgatttttgacaagcaacatctcagtctaggttaaccacatcgaacccattgatctctaggtactaggaattacctcagtatgttcattgccgagtttaacattctcaactaggaccctgaattctggtattaagtcgagttagttgtgagaccttatgcttattttatcatgtgggagtttttaattcctgcatagttgattgcttctaatgtatttttnnnnnnnnnnnnnnnnnnnnnnnnnnnnnnnnnnnnnnnnnnnnnnnnnnnnn

SEQ ID NO: 30342 - DNA, 439 bp, Oryza sativa
caaaatgtacagattgcagaagagcgcttagaggataactgggtccctccagatgaaacagtggctcctgaagaactcgaggatactatccgctccaaagaagcacatacaaatgctgttattcttcagagcgtaagtcctggtgccaaattaaaatccaaaactacgcttattaattattaatcatgttataacttgtgactcataaaacttgtcttattcagttaggagatattccagacgctgagatcaaaccacaagacaatgttttatttgttcgtgaactcaacaaagtaacacaagttagtatcggctcttaattgattaactctgttcgccagttccactaatttttttgcttatccatcctgctttggtagtagcactacgtacagattcttatgtatagacatttcattcatttaatgctcctgtgatt

SEQ ID NO: 30343 - DNA, 581 bp, Oryza sativa
ataaaaacccgcgtttacgacagactcatgtcacatgacaaaaaatgggttgaaaaactccaatcagtactattggcggtacgcaccacaccgacaacatccagcaaggaaaacaccctttttcctcgtgtacgggtctaaaaccatgctctctggcgagttacgacatcaaagtacacgagtacagaagcattccgacgaggaacagcgagacattgatgtaaaccttctcgaggagcatcgtgagcgagttgctgttcgagcagctagctatcaacaagccctccgctgttatcacgagaagcgtatccgagcacgcatactttcgatcggcgactatgtcctctgacgagttcaaacccaagcagggcaaaacaaactctcaccaaaatgggaaggaccctacacgatcacacaagtcttgcggccaggcgcattcaaaatcgcagacggcgacggtcgcgaattagcaaattcgtggaacattgaccaactacgtaaattctatgtatgagtcaataacaccgtacctgtaagcacccttacagtatcaataaagcctatttctaggtttcatacca

SEQ ID NO: 30344 - DNA, 730 bp, Oryza sativa
ccgatcatcacatacttagttccatgcgacgctttttatctcaccgatggtatctgattctttcatgacccgcattttgtagagttgtggctaagcttctggtgtgaagtgcactacaattccttgtacgcaactgacggtgagtgtctttcttagactatatgaacatcgaattttcgcttatgattcttacatcattaaattctaacattccctaccatgatattttgcattgttagttctgaatgtgctcctgttatgtacaatgcagatctcctaacccgcaaaaccaagaagaagcattggttgttctagggcgtctcacctcgagcttccttgagcttctgctgctgcagttcttttcccttcaagttagcagcatctgtggtgcttactagttttactaccatggcaacccagccggcactgcaattccctaacctgaaagaagagcttatgtacagtttaactttcagtagtatgtttcgcaaggtacaaacctagaactgtgcaactttcagatccatgagtcccatgttctacccggcgagatgtagttttgtttttgcatagtatattgtgatctatccaggtgcttgctttgtaaaatcatcatgtgagctggctagattttttaccatatataagcttcagttgaattctcgaattccaaagatcgttttgataaactgaagtctgaatttctcagtggtaaaaacaagcacagatt

SEQ ID NO: 30345 - DNA, 1385 bp, Oryza sativa
  unsure (1)..(1385): unsure at all n locations
nnnnnnnnnnnnnnnnnnnnnnnnnnnnnnnnnnnnnnnnnnnnnnnnnnnnnnnatcaacagatcaagagggaaatgggcaagcattttaagtataccacaaaagagtagagtagtactatatataaatttagtcaagaataccttgcgtttgccttcaaaattacataaaagcttggcctagttgaaaccaactactgtatgtatgtactgtcgcttgcatttccctttcaggaccaccattgtcaactgaagtaagttcaccatacaaaacaatataggaaaatgcacaaaatttcagtactccaccatcaaccacaagtacaggatcatatgatcatatcaagatcttaaagatttttttttctgtgacaaaagctagcaaatatccgagctgtactgctggaaatgaaaatcaaactgatccagaagagcaaggaaatgtccatttcattcacctcagaccaaggagcagcatgtctcaatccaaagatctctttttctcttcttgatatatattagctagctctaggtacagccttatggccaactgctgagagtgacaggtaaaatggccatatctgaacttctgaaggcatgaaggtgaagtggggaaaggtgtggacgatgatcttgtcaagctttgatgatggcttaaatcggttggagcaacggctaatgtagtaccactgtaccaactaagccttcaatgctgaacagttgcagacaagagcaaaagatgaggacaagcattgcaagtatgtgtatatgttcagcatcaatgtacattttttagggggccaagaagaatgacatgtaaccatgaattccaggctttgaaatggacattccaatgccttgagcttctgatgaaagttcaggtccctattgaatatatatagcaagtggattaaaggggtactgatgttgaaaaaggcgcaagcacagtgcccatcagataatcagatggcattgttcacttgaagtacaaaacaagttttatttatttttaccctgaaggttagaaatcatgatcaaatgatgtggggaaagagatagcgcaaaaatattaaaaaaaaaactttattgacaacataaaccttccccttttttttgcgagaaggtgccgatagtaggatggtataagtcctccagttgtgagatttttatgggttcagagatggtctgtgacagtggagttttcgtacgggtaagagctatcttttggagcattttgtcgaccttaaatgtaatcatttcgggatgtctctcccctgtatttgtcaagttcttctttaagtcaatgtttcgacatttcttccacaccactgataagcttctccagctgcagaacacggccatgaaatcaatgtgcaaccaactcc

SEQ ID NO: 30346 - DNA, 9412 bp, Oryza sativa
  unsure (1)..(9412): unsure at all n locations
atgcatatatcgtgacctgaaactaactgacgagatgggccaacatgactggcgaaagttggcgccttctgagagctttacactttctttcatccgtgtgcgtgcatacctgaacatgtatgcacatgtcatgcatcatcaaccatgcatgtggactgataagtcctgataagttcagagctcatgtggctccctgaggaattaatcaacaagatgatgctgattactctaaatcattagccataagtagaagaacagcatgcatacctgaacatatcatgcatcatcaaccatgcatgtgaactgataagttcagtgctcatgtggcaccctgatccttggttcaaatatcaggaatcaattaacaagatgatgctgattactctaaatcatagcagaagggaagaacagcatggagtttaagccagagaatatgcatgggtgcaatttgcaggagtgaccactttcagatttgttcagaatttatagttctctagtcgacaagtgaccaagcacaatgatgagatattcgtagagttgtcctgaaggaagaactgcacgtttaatcctgaactgttattgtaccaacttatgtgatggccccggcactgtttacacaactaactggagacattttacgcagtattatgggacagtattagttgcaatgtgaagaaacattgatcagcactgaccagaaatccgagggtacactggtacaccaaacaaacgaaataaatgacgatcaagtacaattatgtgctacttgcaaaatgaagaagttagctcttaacactgcaaatgacagtgctaaagatggcacatgtgatccattgattgagaggatagtagaaaatattgagaaataaaaagagggactgctagaagattttttttttaaaaaaagaaagaaaccttcaagtgcagtcagataatgagatctgacaaatatagatgtatcagaaattcagagataaaaccaagaagtgaagagcactccatcagctaaaaattccacagaagatttattaacaataaatggtagatggaaatgaaaggtgaaaaaacgtagacctgaactttgccatcacaattttctangtactgaattcattcaatntaggtcatggtgatgaaacgatgagataatctgtgatagctatcttgctcatttgaagagccgttacgtgaccgaaggtgtatagtgattaccagtactgtgacttatatatattgccgtataatagtctcctcattacctgtcaactcatcagtgattgccaaaatgagttatactcttatattgaggaaatcttctcctttttttttgacttgaaaggaaagcttctcttttgtcagtttatatagaacatgtgcgattcggtggagataaacacacgagtatttacgttggaaaaaatgtctgttttctaacaataaaattttatgaaaaatatataaaaaatcaaccataaactcaaagccagaagctaatcaatcatgcatggacaattgaacttgcctcagtttaattataccaaaatttatgtatgtcccaaacactctacagtacactcgataatttcttatagactatattaactttttacgtgaacgcgtaaaaaaattacacattaatttgcagactatattaacatatggttccaaccttgctcggtaacaccaagtcagtgacatatcaccaattcaccaaaagctcactctagacgttgaaaaatcaagttttgattattcgtgatcgaatagcttctgatttcgatgttcaggactataaattctgcctcctttataatattgaataaaatcttctagatagaagtaggtacaaataggtatgctgatgcaagtaaagtcgtatcgatttgaaatacgatggttcatgagagatatgataagttttttgcacttatatacgaattttaaatatgcattattacatttttgaatataatatatacacacgtctctatatatcatctgtacacgcgagcaattgtgacgtattaattgttgtattttccatacgagaagatgcatatgcttacagatgaaggaagaaatcaacaccttcttgtaagtttctttagaaataccttttttttgtaagtgtatgaacggattgaagatgcattgtgtgatcaacaaaattcgaactcccgtcatgctttcaaagtgtccacaatacacgtaatacatacaccatgagaaaatttacccccaaacaattaaatatgatcatgcatcgcatatagatacctcaatatctcataccatcaatatcggtttggaagcgaactgagttcagttgtagtttgactctccgactcatcatgggcgctagcatttacaaataattattctctccatctatttttgatagtcatatttcatcttagcacacatactaaggataagtaattttacttatcatctatttaaacatgctactagttattcctcgtaaacaagcgattcattaatatttatatttctcaatgtccatttagccaatcttgtgtggaagaatagagagtcacgcattaaatccgagaaagtcattaagatgataggttgttggattgaaatgtgcctatcaaaaataagttttttcagatttggaaatataactatcaaaagtagatggagggagtaatatttatcaacaatgaagactcataggtgcttatgggggtaggataagggtaagatgcacgtgcttatacatgagtgtgtatttgtattgtttgtgtttcttaaaaatatatatacacttttttttcgaaatacgatacactatattatacatattggtttgggaaaaaaaatgcagatcacgagaagatatcaacctgtcgtgcattgatgatggccacacttgtacctggttttcgatcttgatcattaatcttgccaccttctcattcacacagaagaacatctgtttcagaagaaaagtagttcagggcaaacaccacattcagagaaacataaggtgtgtttaattatttttattgacgtacaaagcttgctggacttcatgtgaagtcgacggggcctttccatatgagatccatataagcatgtgattattataccacacatcgttccatctcaatcttccaaaaatcaaacggtgaaaggataccctaagtcgttccctactttagtaggtactagatagctagcaatcttactttattagcttcattacccccttaatcatgccatctgcaaagttggagtgccagttaatcaaaacaataccatttttttttgccagaaacacaatactatttattatgatggttgaaaatttttgctccgcttgaaaaaatagaaacacctagtctacgaaaattcctagtagtgtattcaacttgatgaagcttcaaccatctacgcgttaatggattcacctaattaaatcaggctaaaggactcctttaggatgcggaaattttcacattacaagcattgtacaatttttacaagagtcaactcgattccgtggagaccagaaaaaaaatcccgtgttctagaggagtatgcgtgtgttcttttatgttgcatagctgaatgatttatgataagtgttcaagggtacaaatgaatgaattaactattataatattagaaaattatttaaaatagtattttaagaaatccatatatataaagcttatgtaaaaattgtaccatttagaaactcgaaagcgtgcaatatttatctatgcatatttatgacaatttatatatatgagtgcatgtgtatcttttgtgctgaatgattatttatcataattaagtgtagaaataaacaaaataactattcacatatagatttttttttagaaaattgcaccatttagtaacttagaaaacacgcatatttatccattcatgcaaatcattcattggaactcaggaagtgaatttcggctatctattaagtgactgattattttcttatctatcaatcactttttaaacactaatcaatatcaacaattggtcttatgtttttctttcttgtgtgaagcatgttctaacctaaaagttaaaacttaaaaggatatactacctccattttaaaatgtataacattgttgacttttcgtataacgtttgaccattcgttttatttagaaatttggtgtaaatatgcaaagttataagttaagactataatttatttaatgataaaacaagtcacaacaaaataaattatgtttatttaatttttattaagacggatgatcaaacgttatgcaaaaagtcagcagcgtcatacattttaaaatggaggaattatatgttttgatgtaacttcttgcccatatgtaactagaaattgctatttatataagtaaataatacatccagattaatccaaaaaaaataaaaacaaaccaaactaaaagttccgctttctttttactgaagttacaatttgcaagtttagttgactaaaaaaatcgaccctgataaatagagctgaatttctttttcttcagcaaaattcctaaaagaaaattcagcaaaatcaagagcagccttggtcggttggccacacaaaccgctttctttcttctgttttttttttcttctccgaggtggactctgcagcgcacgtaggtacacagacacaaggctgccgcatgtatgcgtcatgtggcagccagagggagaggaacaaggcaccaaaccaaccatggaatggaagcaaaacactcctaacaatttggcgccctctctgtctctctctctctctctccccccttctttttgtgagaagcctcctcccacgttttcccgtctccttaactgcttctctccttcctctcctacacaactgtggtggttgcagcaagaaagagagagagggtctgaaggcagcaagaattcagtagcattccagctgccgtgggagagagggcaagagagcaggagaaagaattccagcggcggcggcggcggcggcggtcgtcggagaggtggagagatggatgtggagggtggtggtggtggtggtaaccgcccaccgcccagggggaggaattcttgggtaatcaattaagctttggttcttggtttggttctttggtctttcagttttgtgtttgatttggttggtttggtgcattttgtttgcaagtaattttgcagtgttactgcggattctgggatgagttactttgggtgcgggcgctatctcaagttcctcagggttaaattttgtagattttctgcattttgttctgaaaaaaactgaactttttcgaagtctatggcgctacaatttcgcttgaatctacttctgtctgactaggtgtttctgtgtatgcatgagacagagaatgctctgaagctaaggttgtagcggcgcacttcttttcagttctgaatttaggtggtaaagttggttgttttcagttaattaattttgcatcagtccagctcattagttgcagtcttgcagagtgatatgttatgctttctgaatctgataaggggaatccatgagttcaggaatcaatagattccatagacgagatggtatcacgaaatctttgtaatgcactgtaattttcctctttggtaaacgggtccattttcttacatatacacgatttttaaacgtagccatcaggtcacttttgatggtcagattggacatttcctttcaacttagtactagttactactacttcagagtttgagattttttctgtttactttgaatactatcttgttgcctatttcaagttactctttctagatcatcaattttggccagcagtaaaattcaaagtagtcaagtcgatactactgattagtaattacgtcatcaaatggtcacggacacgaaagcatgacacggtctgtgtttgctagggatggcagaaaggaacacttctactggcatatcagagcttcggagttgtgtatggcgatctctgcatctcacccgtgtacgtgtacaagaacaccttctccggaaaattgcgtcttcatgaggaggatgaagagatccttggggtattatctctggtcttctggagccttactcttatacctctcctcaagtacatcatccttgttctaggagcagatgacaatggagaaggtgatttcaaaaatccgcgtgtttttcgccgtattaataatttcaatgtgcatttagttaaatatatgccatttttgtcttgcaaatgtgccatgtatgtttgcaggtggcacatttgctctgtactcattgctgtgcaggaattccaagatgggacttctgaacaacatgcgtgcaaaccatggttctctgtcggcatacaacaaggaggaaccttgtaaggagtcgaggaacagcatgctcatcaaggccttcttcgagaagcattactcgcttcgtgttgtgctgctgctgttcgttctgatgggtactagcatggtaattggggatggtgtcttgaccccaacaatgtcaggtactgaactctgaaagactgaaactgaagatttgtggaagttgtatgctcaaggcacaaattttgctgcttgatcatttttttagaaattttagataatggaagtgttttataaaccaaaaatatatatgagcatattttgtatacaattgacaaacgtatatgatagagtaaggaactttgttttttaatttcttttttttaaaaaaaaaacagagagtaaggaattcttggggaacatttaaattgctttaacatcatcatgttttgtttgtgactgaagagggtggcatgttcttttctgcagtgttggcggcagtttctgggctcagaattaagtttccagaactacatgaaagtaagcagctgatatattggcttgtctcataaaggtttactggtcactcctcttagcagcacacatttaaattactcttattctcaattctttttcttcttaatgtctacttgcaccagaaaatacagctgatctgctcctgttacacttctctgcagattacactgtgctccttgcttgtgtcattttaattgggctttttgcattgcaacactatggaacacgccgtgtcggattcctattcgcaccaatcttgatttcctggctcacttgcattggtgggattggcatatataacatcataaagtggaaccctagtgtcatccgtgctctgtccccgtattacatatacaacttcttcaggaaggctggcaaggatggctggagctcactaggagggattgttctttgccttacaggttcacatatttttatccttttagttttggtttatcacttgttttcgttgtaacatgcttaattatagccgtagattttcaggtgctgaagccatgtttgctgatctggggcatttctcaaagctttcactgagggtaatatgattttcagtggtgaattggtgatagtttcagtcttggtagctgaaagagtacacttttttttttttgctaagaattagggaaagaaatctttacacttatttttttgttttgccatgacagcttggattcacaattgttgtatatccttgcttagttctggcttacatgggtgaggctgcatacctgtccaaacatagggaggatctccaaagtagcttttacaaagctcttccaggtgagatgttaattctcttgccagattgcttcaggttttccgctgctttttttttctcatcatcttttccaacagagagtacattgattcttgtaatattatatttatcaatcccttcagagtttagtatatataatatcagtagaatttgtgcatggcccatgtaaagcttaacacaagatcagggaaaatctggcccggcccagttatgccccaaaggtgttatgggccatgttcgggcagtattaagcacaaattcagccctaaacaaattcttctaatttcacggtacaaattcagtgtgtggtcaggactgaaacagaaggcctgagaaacttgggccaggaattttggcctgattccaatttccgtccatcgtttcgtctgttaatgaagtgcacatcattcttgtataactcactttcccttgtggatctgtggttttctattacttatattaccaaaaagaaatagtgtataaaggaagtagaaggatgtgaatttgtttgtgaaaggttaatgggcctttcaaggtcttagtgtatggaataactcaggaaactacaaatcggatgtccgattctcttaaaaaaaattgggtggttaaatatttcagttgaccaccagtgaaacattaagttatgcgtgatgaaaaaaacagccattgattttttttttgtgtgtgaaacatagtgaaaacacacgtttaaacatgtcgttatcgtgtatgaaacattgagttttaacagttcgaaacatatgttttctttcatcagaatataatctttgtgatatcttactgtgtgatcggatcataagtcagacaagtaatttaggagaaaaaaatatgttgaaaatcacaaaatacatacatgtatggatgaagtgaagagaacaactagtagactccaacattaagaatttattttcttggcaaatttatttaagtttgaaagctaacataaattcaaagagaattggtttaaagctaagcatcatttttgtcgagtataaacatgcaatatttatatcacctttcattaagaaaaatattcaaaaccatgactcgctatgagcagtagattttaatatttagattgaataattagcatgaaaactggtatgtgtgctaaaaggcaacaactttcgtgctagtgcacttaatccgttgcttttcagaagaacccgcaaatgtaactgaaatataagacctaaatactaaaccaactgaaccacaaatatgcactatattggatgatagccctagccgccgactccgacagttgagaagtgacaaacctttcgattgataatcagattatctgatgaaggtgtgagcataacaactcactcatgaagattactacttggagagataggcaagccttcagctaattgaatactcaacagtcaaaatgctattcgagtaaaaggaatttgttgaagacaccctaaggccttaatggtccctcatctgcctcgagcacataaggtagggaccagaaagttatacacgtagtccacaggttatttgtaaacctaatactatttaacgtaggaaaatatctatattaccctcaagtcataggccattgttgaggggatgttgtatgtaatttcttttgtaccctatctagattaattagaaaaccaccttagtgacaatgtaaagggggactatctttagaggaaaaaagttgtaannnnnnnnnnnnnnnnnnnnnnnnnnnnnnnnnnnnnnnnnnnnnnnnnn

SEQ ID NO: 30347 - DNA, 706 bp, Oryza sativa
  unsure (1)..(706): unsure at all n locations
acatgcgtgcaaaccatggttctctgtcggcatacacaaagnaggaaccttgtaaggagtcgaggaacagcatgctcatcaaggccttcttcgagaagcataactcgcttcgtgttgtgctgctgctgttcgttctgatgggtactagcatggtaattggggatggtgtcttgaccccaacaatgtcaggtactgaactctgaaagactgaaactgaagatttgtggaagttgtatgctcaaggcacaaattttgctgcttgatcatttttttagaaattttagataatggaagtgttttataaaccaaaaatatatatgagcatattttgtatacaattgacaaacgtatatgatagagtaaggaactttgttttttaatttcttttttttaaaaaaaaaacagagagtaaggaattcttggggaacatttaaattgctttaacatcatcatgttttgtttgtgactgaagagggtggcatgttcttttctgcagtgttggcggcagtttctgggctcagaattaagtttccagaactacatgaaagtaagcagctgatatattggcttgtctcataaaggtttactggtcactcctcttagcagcacacatttaaattactcttattctcaattcttttnnnnnnnnnnnnnnnnnnnnnnnnnnnnnnnnnnnnnnnnnnnnnnnnnnnnnnnnnnnnnnnnn

SEQ ID NO: 30348 - DNA, 628 bp, Oryza sativa
aacgacgctacagaggagatgatgaccatggaaggagcaaccgccacacgagatgaaagtgataacaggaaaagaagcccagacactggtagtaggcatagaagataagatagggagcaccgtgagtgagacgagcaaacacagggaaagaagtcagagtgatgatagtatattgctaaggtagctcacgtatattttggatagttctttttctgttactttacatacgaggatttcagacgaagacgggtgagagagattttgacagttttttgctctcgtgtgtaaacttctcagctgaatctcacatttcatcatctggagtctgattacacctttcatctctgatcgaattgtctgcgaactaattgcgaatggcgtgcatgcatgcatgagctgtaatttgctagccattttactttggttatcagagagatctgaattacttgctagctacctattatagaacatacttcacatccgttacaacatataagcattcacctagccagaaatgcttatattttgatattttgaaatagatggagtatcagttcctagtactgctgatttgcaaaatgtccaaaattattagttacgtgtacttcatattcatacatgcgagtat

SEQ ID NO: 30349 - DNA, 1181 bp, Oryza sativa
  unsure (1)..(1181): unsure at all n locations
nnnnnnnnnnnnnnnnnnnnnnnnnnnnnnnnnnnnnnnnnnnnnnnnnnnnnnnnnnnnnnnnnnncattctacgaacagtttcactcagctctataccctgtgcacccacaccacgagcaatggccccacggatatctataccagccatctcagcagaaagtaaagcacgctccatttgcccatacctacatagcatgaaacaccactggctgagtactacagcaatagcaacaaaaaaaatctcaccaatgcagttaactgcatgcaacagaatttttcacaagttttttttttaccttgctttaaaagtctcatatggggaataaatagctttcaatgtattcagcagaactaaaagatctgactctgaaaataaatgttggatgttccgagcaaaagtgcccgtcatgttgtgcaggtcgatcagtgctccaagatgcttattctgcaatttggtactttttggcaagtcacctgataaaacatctagtatacctgggtacagaggacataaaatcaatttattgttacgaaagaagtacgcatatgtggcaaacaagtaatatccttttttaattgaacagagaaaaataaaacatgtaattcaatcatgaaattagtatagacatacaaaaatgaaataatacgagaagtttatgcattaccttttgcaacagatctagtttcaggaacagcatctccagttgctaggttgacacgagagacaaaacttgaattcaactcactcatggtttcaacaagtacttttgggactagtgatttgtattcttcagggaaagcagtcaggcaccttcagcattagcattgtagaacatccattaatttttggtggagcaaaaatattgtccgaatgcagctaaaagatgctgccaaaaactggcttctgtttacaagggcaaacattgctgattcagaacaaaagacaacagggtacaatgaacataccacttccattcttgttcaaggtaaagtagtgtctcatcatagaaatttggaagccagctagcaaatgagagactgtttatgctttctccaccatacttctccatctctacccgcttagctctctgttttagatcaaaatcttcccaaagtttctttagaggcttgacatggatcttagtatattgcacctncagtgacttgaatctgccaat

SEQ ID NO: 30350 - DNA, 1139 bp, Oryza sativa
  unsure (1)..(1139): unsure at all n locations
ggcgctcctcggcgtcggcgagaaaccggtcgagcggctccgacgggtggcgcgcgtccagcgccgcgttgatccaccgcttcgggtcgaacccctccgccccgaactcggacgcgtccaccaccaccattttccgcctcccctcccactcgttgcgcctcctcctccgccgccgccgccgccgcggctcgccgtggacttgggcgagggagacgaggaggggtggctttgagttcgctggattgctactagtccttttgctaggtgggagagtcttccgtctccgcggctactcgtagctaacggccgccatgggagggatcacctcggtggagttcggagggggaaacgcctgccaaaatggcgtgttctcttgtgggagacggagtgtattttacagcggtttttcctccaaaatttatgtcttgttgtttccagccatcatgtttttattagtatcaaccaaaatataatttatatgtaaaacttttagatcagttctaattaacttaaaaataagcggctctatttaatgagcattttcggctgttgcttttgtgactgcaccatgatcgacacgaatagtgccgcactcactgtgcgtagctacaactgcaaccattgtagccggccagaagaacgctccctatagccttagttatggctgcaagcagcggcattacacccttaacaacaaaaaaatataagttaatacaaccatagccattagcagtgaacccgctaagaaaattaccgatggtccttatgctcatctaacttatgaagcaaccttctcatgtgttcgatttaacttagtaagggtgtcccacatggtataaatacataacttataactgtaaaaaaaaaatcaccagtattcaatgacctctgttgacccttactaggtactccctccattccatgaaaaaacgaatctagaataggatatgatattttatgtccaaattcatagtcttaagatgtgtcgcatccggtactaggttgttttttatgggatggaggggtacgccgctaacagccatgaattccgaataggaacatgctgaattcgggaaaaaannnnnnnnnnnnnnnnnnnnnnnnnnnnnnnnnnnnnnnnnnnnnnnnnnnnnnnnnnn

SEQ ID NO: 30351 - DNA, 793 bp, Oryza sativa
aacgtttgacaattcgttttatttaaaaaattagtgcaaatataaaaaaagataagtcatatgtaaagtacttttgataataaagcaaatgataaacaaaataaataataattccaaaattttttgaataagacgaatgatcaaacattgacaaacaaaaacttaaaaagacaagtaatatggaacggaggcagtaggtattaggtaaacaccgtttggtggaccgaatatacaggtagcagagccgagggttgaagagagcctaaaaacttgctctgggtgaacaatgggccaaccccttctgcttctttgatccgatgctacattccgacgtttccaaaaaaaaaaaaaatcatgacaacgttgcaaacgccatgagaaaagagaacatactaatagcatcaggcatcaattaaatataatcttataatcatacgaccatttcggggctaattaaccacaacataattaagtagatatcgaaatgcatgtataagttaaagtaaagcttctcttggcaaaccagaaacccaccagctgctatgatggaggtgacggcactctggatccaatccatacggacaaacggcatcaaaccatgggtatgctggctagtgcctacgtactactgaggatctttgagcaccgtgatgacgcacctcattcagaatcacaagctaaaatagccgggctcctcttcagatcgtcctgtttaatgagcttaacccagtcagagctcttcctggcgagggtgaaatttgcgtgacacagtttcaaccctgcagtcgtgctg

SEQ ID NO: 30352 - DNA, 608 bp, Oryza sativa
cttgactagtgaatgttacttgattgtttgtgccttgacaattcagtattgtctatatttgtaattattttaccagtgttttcatgggagcattgcttactcaatgatatgcttgcagatggacaattgtttgattgatgatcgaagaatacatgttgactttagtcaaagtgtttcaaaactgtggggtcagttcagacaaagcaaaagaaatgcaaataaaggtattcttatttccatggccttagaatatgattgcagttttcagtttcttttttatttaagctaactgcatggtagctttcttttttcttaaggaaaagcagtaggggagatcctctactgttaccctttcctacaaggaaaagaactatataaatctatccttcatcaaaattcttttcatctagactttggtggcactcaatttcctttcagaccataattatagcatcctcctgtatcctatagaaatttatttattcctataaggaatttagtgttttgtaccatgcggaagatgtctagagaagtgtactgattattattcagcacagttaaaccgtgtcaagtgtaaagatggcaacaatgttcccaatagccacagg

SEQ ID NO: 30353 - DNA, 490 bp, Oryza sativa
tgggctctgtgcaaatgctgttgaatcaattggtgcataaattttcgatccctgagccactcctgcagatctggaacagcacaatcctccatagaaattccaaaatgagcaggttgataaccataaatgacttcaaaaggagttttctgaacagctgagtgaaaagcattgttgtaccagaattctgctaagtgcaaccaggctgcccacttatgtggtgtggaatgaacaaaacatctcagaaacaattctaggcactgattgactctctctgtttgcccatcagtttggggatgataagaagaactcatatgtaattcagtaccagatttagtgaataagtactcccaaaattgacttgtaaaaattttatctctatctgaaacaatcacttttggcataccatgtaatttgtaaatgtttttcatgaaagcggtagcaactgattcagcagtgaagggatgtgtcaaaggaacaaagtgagcatatt

SEQ ID NO: 30354 - DNA, 9457 bp, Oryza sativa
tattactatttgaacttagagtgtttcctctaagagaaaacaccctccaagaataaatattatcaatatttgaactccaaaaataaatattatcaatatttaaccttaatttgtagaaaacaccctccaaaaataagagtatgcggctatttgtggcgcgcacacggtactctttagtaaaaggcgaaagaatagttcgctttgtgctcaccacgcagctgcttgagttttcgccgagcagctaccgccctttaaatagccgaatggctaactcacctccaccaaaacaagcggtatggtactaaaaatattctgctcccccggcggctctggtgtctcttctctgctttgcaccaatctcctgcatgggcctatagaagcagcactgttgggcctttcctgacgctagccacagcccacaacagaagtcccattccggcccaactataacgggccacacgtcacgacaggcccgttccgtatgggcctcatgtacgttgcggtcccgtacaatttggcccaacgaaaatgggccaaccacatgtgttgcattcttccggaaggaataagttcatctgagatcccttaacttgtcaacgaatccgattttcgtccctcaaccagaaaaccaaatacaacggatccctcaactgtcaaaaccggtacagattaaatccctcgacggttttgagggcggttttggctgacgtgacgcctacgtgactaacttgactcagtattcatctgacgtggcattgacgtggcgcttacgtgacaattcgatctgaaaaaataataaatctagtgggacccacatgtcagcctcacacagaaaataataaaaaatagtgggccttacgtgtcagtccaactcacccctcctcttcttcctcctctctctctctctccccatctcccctttcttcgtttctctcttgcgctggggatgggcaccagatgcggccggcgacgacgatggcggcggaaatagagaagagcggccaccggccatctctctcttgcgggcgcgctcgctggtaggccagggaaaccaccctcaaaaccgccgcgcgacgccgccctttcccgccaccgacccctcgcctctggaggatggaaacctcgccgcgcgacggggacactgccgacgaatgaacgaacgatgcgtccctcctggtgctccgtcgccactccagatgggtctccttgaggttgaggacctcctcttcgccccgcgcgtcgacggcggcggcggcgacgatgagggcatggcggcgcccgactacgccatccctcccctctcccccaccgcctcctccgtcgtccaccgatgcgcccggtatgatctcccttcatcctcaccagtgtccaattgatttgattccccgatcgatcgtggctgcaggatcgccggcgtggaggtggagcagctgctccggcggtttgagccggagaagggggaccagccgctggtgtacgccaggagcgtcgtggagtactgctcctacattgccctgtgcgtcgagaccaagcgccatgactacctcagcgacagcgagttccactcgctcacctacgacatgataatcgcctgggaagcgcccgacgacgagacggacgccacgttgtaggtgacaccccggtttcttttttttttttttcatcaccaattcaacatcaccctcttgttgttacagttattgtcattctctgaaacctgaacaatgagcattactgaatattcaggcactcggttactttcattgcatgattgtcttactatggcacctctggtttctgatgttagggtgctgagatttgcaaaacgtatatcaggtgaccatcaccgatctctccccggcgcccatgcacggaaggcagctgcgcgtcgcctaccagggtgtcccggctcccgggtgcctacagcgaggcggcggcggccaaggcctacccattctgcgacgccatcccctgcgaccagttcgaggtggcctttcaggccgtggagctctggattgccgaccgcgccgtcttccccgtcgagaactcccgcgccgtcgtgcccgtcgagcatccctcggggagctcaccctcaacgccatgggcctcaacgtcgcccgcgaggccttcgacgacaccgcggccgccgccgagcacgtcgtcgccgcggggctccgggacaccgccgccatcgcatcctctcgcgccgccgacctgtacgggctccaggtgctcgccgacggcatccaggacgacgccgggaacgtgacgcggttcgtgatgctggcgcgggagcccatcatcccgcgaacggaccggcccttcaagacgagcatcgtgttcgcgcacgacagggaggggacgtcggtgctgttcggtgctgtcggccttcgcgtttcgggacatcagcctgaccaagatcgagagccggccacaccgctcttctgaactgaagagaggggagatggggagagagaggaggggtgggttggactgacatgtggggcccacgtgggcccaccattttttattattttctgtgtgagactgacatgtgggtcccacgggtattattatttttctggatgaattgccacgtaagcgccacgtcaatgccacgtcagatgaagacgagtcaaattagccacgtaggcgtcacatcatccaaaaccgccctcaaaaccgccgagggacttaatctgcaccggttttgatagttgaagtacctgttgtgtctggttttctggttgagggacgaaaatcgaattcgttgacaagttaagggacctcatatgaacttattcctcttccggaacgtacttggcccatttaagaaaactacaactgcgagagatctaatgccatggatgttgtcccagaaaagattttttttttttacaatgcataatcgaatctaggtggtcatgtcaagcttgaatcatactcgaaattacggtgttgaatgcaactattattacttttattcggcgagatacgatctgtgcgtaaaccagacaaatgccaaagatcttaaatgggctggggtgagagagggtttcattgtgtatcatctttctatgtttatacttagggtgtgtttagataatgtgaaatggggagtgggattgagattgtgaaatgaatgaagggttatgattaaatagaagatagataataaatagttaggatttaaagatgtcttttggtgggtggaaaatcatttcgctatctcattagccaaacattgtcttattgtttatcttagttcgaccagaacaacatgaggctgtccctagaactaagtagctataaagataataaaaatgaagtcttggagagagacaagctgctccatggtctgaggtgaatgaattggggtggacatttcttttgcattgctggatcagttatattttcctctgcagcaatacagcacatatatttgcagtttttttctcagaaaaataatagcggcaatatcttgatatgatcctgtacttgtaacttgtgctcgatagaggattactgaaatcatgtgcatttcctattgttttttatggtgaacttactgcagttgacaatggtttgtcctgaaagggaaatgcaagcgacaatacacaagttagtttcaactaagccaagcttttatgtagtagttttgaaggcaaacgcaacgctttcttgaccatactctgctctactgtggcatactaaaaatactaatgtaactatgtaatttgaaaatgttgttttagttcacactaactacttcctccgtttcacaatgtaaatcattatagcattttccacatttatattgatattaataaatctaaatagatatatatgtctagattcattaatatcaatataaatgtgagaaatgttagaatgacttacattgagtagctcatttttgccatccctaactagcatgattagcaggccaaccacatcatctgtcaaacaaaactagcaaacttaactttgagcttgaattttaaaagatagatcttgaactttgatttgtattcctacgagagaaaacaccctccaaaactgtgcgtacagtagtgtcaaacaaaactaacaaatttagctttggaaattgagtctaatctaaagagataattttttccaagagaaaacaccctccaaaaataaaagtatgctgctatttgtggcgcgtacacggtattctttagtaaaaggtataagaatagttcgcttttgtgctcaccacgcagctgcttgagttttcaactagtagcttcctgactatataagtagcggaacaactagctcatcttgtccaaaacaagcggtatggtactaaacatgtccctgcttcggtttgccagccacctcttgcatatgggccgcagtgtgcaaaacaaagagaaaacagttcgggctgtggagaatcacagcagcagcagcagtaacttgtgcctaactataatgggcctcacatcggcccggcgacaaacacaacaggcctcatatacgcctctggcccaacactaatgggccttacgtcagccattgcccagttcctgatgggtcgcaccttcattgctttcccgtacgttctggcccaactttaacgggccaagcacgtactcgaggctattccttgatccagcgactcaattagcgcagcgaggcatgatggtgaggcggtggagattttgctgtcctatgccaatatacaaggactctgtgtgacagatctatcatgaggacagaggggtcctgtgccccctaagatattgtaactatgggatgagcctccatttaaccatcattaaaatattttgccatacatttatccactagaagagaggttatagctttgtataatttattctgtccttctactagttcatcctggatccatcctgtacatctatcttgctcttctgtcgagtggtcatgtgtttttggtattaggatatgattgattttccgttttaaaaaaagtgaggttcaatacaacagtatatctctccctacaatatacaacatgctgtttatacatagtttcctagttgatccatattacatatatgattcttcgaaagaagaatatttttttcagattctttgtgtgctgaaacttttcatatgttatgtattgccatatcagaggaaagaaggtggaactagaaggtgtgcagcagtggcaggcagaccattgtattttgagcagctggaggtttggtttgctatgttaggacaaatttatttcgagaagctagaaactcaggtgaattttggcaaatgcatgtacgattttgatgtcaagtttgcttagttagctaaggtatcctttctgaaagggcggaggtaggcctagggtagctagggcccttaagccctaggcctaactccaaaaacttatttaaattttgttaattcatcatgtaaattttataggaaatgaatacttcattagtagagtcctatcttagctacagtcttataatttctagctccgcctctgcttctgaaagttcaatctcaatgtcgacgaggaaagctccaaagtttagtgtgtgcaactgtaactcgataaagtattaactagtcttcatactaaagacatcggatgtatttttattagggggtgcacattgtctaaaacaaaaatgatagtaaatacaatataaagtagtagtaaatacttagtgtatatgttctacttaatacaatactagtaatactagtagtacaatatataaagtactcagtacataaaatgataactcacaataaaatatcctaaactcacatacatagtcagtaaaaagataactcgcacgtatatatcccatagagctacagtactagacagcaacgcgacacagagggcaaccgttggttcttttgaagaatcatttggtgacacacctgtggtgaaaccggtgtccgtagagtagactggcaatagtgtcgccgacctcctattcctgtaggcatatcctgcagtcacgattgtcgctggtgcatgctgcatagacggtagagtaggtatccgaccactcctaccgccgctgctaccatgagaaatggcaagataaaagtaatcacattctcagagctattgccgtcataactataatccatctacaaaaaataatgagagaaataattgtatcaagttgcataaacaaaagaaatgcttagagccaatagctagactggatatttcaaatataaaaattgaaatttcataattttgggtttaatttaaatatttttataaaataaaaattaattgttcatgaaaaaacatgcagcatgcataaacgtgccatttctaaactttatctctacaaaacataccttttaacggctaacggtttaaaaaatatgctaacaaaaatcgagaaggtagccaaagaatgcgccctaaatggaaaaatggagtataggttgaaatcatggaattaagcacaattggctgcatgcctgcagtcgatcgagaacttactcgagtgggaagcggaaagaaaataggactaccaaattcgtaaatgatattatacttttttttacaaaattagtcaaatttggagtagtttgactttgactaaggtcaaaacatctgataacctgaaacggagggagtactaaccacaagataaccttggcccacctaagtgtttatgtggtgaccatgtttaaaaaatataggaactgtcgcaagtttttcaaatatagggaataattttcaaatataactgtaatataattccactataactatattgtaatataacttgtatataagtattaaaataatatatgtaacttatatagagaatacaatgtaactatagtgtaattacattgtagttacattagaactatactacaattacatttgaaagtttttttttgcccaaaaaacttgtgacaattttttagcaatttcaaaaagaaaaaaataatgctctcttccactgcatatacagaacatgacctcggtagtgagcagccaaactttttagcaaacgatcgaaaaccaaagccctgggtgatcaccggcgaggatgatgcaacggaagcagctagccctgcttgatcggcggcggccgggatatattgatcgcaacgagatgacagcgagcgagctactcccaggcggccgaggcgagcgagatcgacgattccgatgttggaacggaaagtcacgatatcagaaccgtactgcctcgctttctgattggcgaagcgagtaggaactgcctacgtcacgtacgtaagtgcgcggcttgaagaatgaatttagttttccatttttttttctttaaaacacgattaaaacgcagacatgctcataatgcatgcgcttcacttttactaaatatacacgcgcatatagcatatcctgtccctatgagtacatcctaaagattatgctagcatgacaaagttatcataggcgtctctgctttctttgcaaagggagaaaaacaaaattttctgtgagtatttgtaaaagaaataacaagacatgcgttgtatttttttttaaagaaaggaagtctagagcagggccagggacagatccaggaaaaaaaaatgggagggggctcaattatgcagtttctttaacggacctttagttttttattcatggtgaaaaaatcaaaagggtgctcatggggtatccatgggtcttgtgggtgcagggggacttaagccccccgcacccacgttgaatctgcccctgagcgcggccatgctttttatataaattaagcaataatgtggtttacatgtgtttttttttctggggttttcgactgaccaagcaaagccctgtaccatcataatcatccagaacctatgcactcccggcaaatagcagcgctgggaaaatatggaaaagcacccaattaatatatatatccaacaagaaagaaaaatggttttaaaacttagtgaattttagggctgttacacccaatattaacatttgttttgatacctctcttcttagatacctgtgctttctttgtaaaaaaaaagccaatctaaaaaggaatatatatgacctctttctagtataatgaatctggattattagagtaatgaactcatgatccttgtttcccaccctaggctgaatctagacatcgttatcctagtttgagacattttgcacaactgcgaagatgcatgtcatgcacgtcaaagtaaatacaaattaaacccccttaaccaggttctaacacgaaagtcaatacaatgcaaacaaccaaattggtggtgttattgccctcataattaaacttcatttgcaaattaataacatgaatgattttgagcagatagaactgttaaaaaaataaactatgggataaggtgaagaacaacgagtgcacctcaagtagtgagtgcatcacaggagcctggaggacatgttgattgtaattggccattgccccctaaattaattatgactgcctttttgtagaaaaaaaggtgtaatgtggacctaatatatggctggctacaggtatatagcaaaagaaagatgacgagatgggaactaatcggccggttgataaacacacacgtcattctaattcagttgctgaaatgttgaaatgttgaaatgttgcttcagatgtgtgtatgagaaggaagcatctcacgtacatggctcttagatagaaaccattatagtttataaattagtatgaatagtttattgaacttggttgcactcataaagcgagcatgaaggagagcgacgaaagaagcccaaggaacagagcggttatcgttcctgactagcaagtgatcttctagtaaaccaatcttttttactgcacatagcttgataatagggcctgtttagatcccacctcaaaattttacaccatgtcacatcgaacatttgaacaccggcatggagtattaaatataggctaaaaaaactaattatacaaattgcgactaatctgcgagacgaatcttttaagcttaattgctccatgatttgataatgtggtgctacagtaaacatttgctaatgacaaattaattagccttaaaattcgtctcatggtttactgacgaattctgtaattagtttttttattagtccccgaacacactatatgacaccctatataatatccaatgtgacacgccaaaactttacacccctggatctaaacaccccatagtcaccatttggcttcctagtgcagcactacaaggcagccagggtgcctattatagcatgaagcagccacaggctgtaggcaggctacggggtggaagaaaccaagcgccaattagcaataaattgtttattcaactgattaagccattaacattttttttaaacctaaggcggaactttgttccacttttatatttagaagaagagaattgacccagtttataaggaaaaccgggcccgaaaaccatacaa

SEQ ID NO: 30355 - DNA, 4931 bp, Oryza sativa
  unsure (1)..(4931): unsure at all n locations
nnnnnnnnnnnnnnnnnnnnnnnnnnnnnnnnnnnnnnacagaagaaagcaagggacctagctacacaactcgcaacgacggcggagcccaaatataggacatcattgccaagctaatacacaaaagcgaccgaaacagctccaacatcacagaagaggtgttatcgttgtcgagctagccgcccaagcaacccagcagcgccgactttacaaccgcatcgacactgaagccgtgaaagtcgctagagcgaaaagcagctccgatatccaacaatggacatcagccaagccaccaaagagccacttccttcacacggccaacaacaactccttggaagagactgcaacttgtcatcgttgccaagcatcgccgcacgtcatcagcgagccgctccgacttcatcagcagaagcaactgaagagcgtgtcacccaccacaagaacgaagcggacctaaggaggcgaaggcctcgccgaacgccaaggtatgaaggctttagaaccgaaaaagaccatccacggtcgtcgatacataggagcttctccgaagcgacacccccaaggaggacacgatgcataacgtcgccgccgctcatccgaaatcggaacaaggttttcacctggagatttgtggggaatatgaaggaacgccatcacgacgcctccaagaaggttaacggcgcccgtgggcatcgtcatcgtcgaaccggccaaaggcacggcaaggctttcgccaacgtcttcacatcacacacacaagcaccccacatcgacgaccactgaatagtccatgacgtctcacaagcagtcatacctcgacgtaaccaaacacgccatcgcatccacatccacacatcgcgagcaggaggctcgccgctagcgagcaaccctgccggagtccgcctcgactccgcgctaccgccgagctcgtcggagccctcccgagccgtgcaacgccgccacacgcagccgccgcccacgctacgcccgctcccggtctcctccttccccgccgcccaactccttcctcgtcttcaaatgttgccgctgacgtcgacgcgccgactaccgcacatgcgccctcgccagccatcgccaccacggccgccgccgtcagccactgtggtccgccgatcgtccccacgccaccgtcgccagccgccgccgccagctgccaccatcaccggttgccgccaccagccgccgcctgtccagattcggccaggatggcgcggatccgggggacggaacgcgccgctcggcgcccggttggagcgagacgaccatgacgatgcggcggaggtcccagccgtggcgtcctggacgcgccgcggtccgccgccgacgtcgccttcagtcgccatggtccgccgccgacgtcgccttcagccgccgtggtccgccgccgtcgtcgccaccatcaccgtcagtccccgccgctggccatcccccctctagatccggctggatacggcgcggatctggccgccaccaccgccgccccgggcagctccccccccgccgccgagcgtagggttggctaggcgagaccccgccgccgccgtccttgcggctgcgcggcattgccggcacccgctctggcggcggcgaggtggaggaggaggcgggggaggaggaaagcggcggcgcgcacatcgcctcccgagccgcctgggggagggcgacgcgagggcctcttccttttgggaaaagagatggccctcgccattaatattttcaagagattctaattttaactagtacaactacctggccccacatagtaaaacatgttatcctcaaaaatgctagcttggtagcatttcgtattgcttgcataaacttcgagaccagcaggccaaacaggaggaggatagggctggccatcggtatcaacatacataacattctgaaaggatgctgacatttttcctggaaattgcccattgcccattgggggactggagctccctttgtaggattgagcatagccagcccaccttatacgagtagcatgatctaccatacgattaaaaatattctttggccaaaatccaactcgattgagattgttgatgtcatatccaaagtaaagccaccaatctccatcatttttgtcctgtgtacatatatggaaaaatatcatcgcgcaagaatattcggaagagttactattcgagaaagtaaaggctgtacacttagatattttcctactataaatacaaggtacattttctttaagataacagggaaattttcagccttcagctcaagagatcccatctacaagctacatacccgggcatatgaaagtttagggaaataatcagttcatgaaaatgtacttttatttactatattacggaaaaaagatcagcatgtgttgtgtagcatacgtatgtacacactaaatacagtctaggatcaaataattattagttacattaccttaaatatcttgaatgatattttagtttggttattagcttgttctaatgtatctccaggagtcaccggggcaccgtttactggtacaaaaccgtcacagtccaagttaaagcatccggttttattgtaataatcagcctgtatgtcatgcatccatatcaaaaccttgtaattaaagacatatgcatggtaattaagcaatgtatttcaagtgcacaaacaatgaatataagtggacacataccgtccaagatacaaagaagtgggttttgctgtcaccataggtggttggatcaatctatatatgtagggaaaatagcatttgagatgagatatatatatcatagctgatgttgattgtactacacatcctccaaatgttaacatagacaattaaggttagttgttcacttaccacccatccggcctgtatatcattgagaccagctttagtggcttcgtcttggtaatttgaaactctaacaatagcagcacttacttccattttcttcaaatatggaaaattataaacatccagagttgccatggcgccgctatatccattttcaggggcatctgttgaacgatgtaacgcgtgctaggaaaaaataatatacatatatatgttattctagtggcattttcactacttgaacatatagacatcttaacataaagaataaatatgaatggatcctcccaatgcatggttgtgtgcctaatgatagaggcaggagatgtaaatcatctctgtaatttaaaaagtacatatggatttttcattcccttttccagttcagctgcaaattcacgagtttgaataggaacaatatattaaaaagataaaactcaacttcccaacttttaactaaaaacgtcccctcatcaccgactcaaaattcaacctttccatcgtcatatcaactcatatcagtttaacaattattatttatcaacactcataatttaagaaaaaaaatcaattatatttcattgtcataagaaactgtacgctttggtaattaaacagaaacatcatgtttagagagaaaagataaaaaaagaagtgacccaagaatatgtatacaagaacatgcaactgatccataacattcatatgcttcactacgataagggaagaaatgaggttgaaaagcatgatatggattgagataaagtgaacttacatatgagatttctttcaatccttttgttgaagcttggcctctaattgggccaacatctgggtacgcgtaataggatgatgatagagctaaatgatttaaaaagcccacaaatatagacagcataaggcacaaatcttgcagcattttgcaagaatagttgtgtacttccatttcactgacggctggttcaagcaacatgttgatcctgggaactcatataagtagtagaagagttggctttaatgttgcttcaaagaattggtgcgtgcctaccttgaataatatcatatctcatatatatctggcagattttctttcaatgaagtgctacattaattagcaggatttacattaattatccatccatggcacaccttatagcataatttattgtcctggacttgcatagattgattaatgtagtaggaaggaagcatttattggactagaaatggttttgatgcattattgttggagcttttatcgtcttaaatatacattcatctcccaattaataaaatcaaagtaaaaggaaagcatcaatgcgacacaaatgtaatttccagagttagttgtgtatgcaagaatcaccaaataggtagtgttatattgtattaaaatggaccaaagaaagctaaaaaaaaaaggaggcaactacacgtcaggcgcccgatccaaggtgggaaaatcggacgcccatgtcatgctgacgtcagcatgcaaaaactactttaaattattttttcttttaaattatttatccaaatcatgatccgattgcaccattaaattcgttgcaattaaatctttgaaacaagactacacatggatatattccgacgaaaatttttttagcttattattgaattatttttaaatattgtacgatgttccaccaagtatatcgtaattgtttcactaagtagatcgaaaatgcttcaatcgtttaaatcaggcgatgtttcaccttatataaaaacaatatttcagcaaatagcgaaagaatgtttcagttcatttaatatttgatctatacatagtgaaacattataagtacactaggtgaaacattttttgtggaacaaaaagtgaaatgaattctcttaatagagggtttccataatatcccttaataaagggtttccataatatgtggatgatttgttgcaaaagaatgtttcaattcataacattagatatatacataacaatatattgtaagtacactaggtgaaatattttttgtggaacaaagaataaaacggattcccttaatagaaggtttccaaaatatgt

SEQ ID NO: 30356 - DNA, 6937 bp, Oryza sativa
ccccccccaacccacccaacgcccgattggaagaaattccgaaaaaaaaaagaatgtatttgaaacacggtttaaatatgatttttttaaaatgtaaaaaaagaaaagaagagaagttgtccagagtctcccgacagagtacatgaattatgttatagacaacttttagtaaatgatatcaaattgatttacatctctgagtaaaagggtataaaacagtctgagcgtgtagctgaaggaaactagaggcgtgttaagactcacaaatatgtagaacacttgcagtgggcttcctctagaacaagagcaattaaaaaagcaagctgctagttgtggcaacagttcgacaacaatcagatggtgatcgtcccccaaaaagaacaacgtccatgagcatgtatagaaaagaaaaggtctacaagttacaacaatctgtagccagtggagctctcataatgtctacacgcagattctaagctacatgtttagtgttctggtgctatctttggattaagaatgacaaaattcaatgtatgatgagaaacaggcaagacaaaactgacggtgatgcagtgacctatctatcatctctctgcctcctttccctgtgcttgcttgtctcacggtgaccaccgtcttctcttctatgcttaccagtatctgggcttcttttcctgttatcactttcatctctcttgtgacggtcactccttccatggccatcatcttctctgtagcgccgttcaccttcatacttatccctgccatatcgactgccacctcccggttgtcgtctgtaatcatcattgccatccctatatttgcccctgctctcgtgcttgctgtagccacgatcatcgtatctactagagctccgttcaccagatttattgtaacggtggtagtcctcgtgcttacgaatccctcggtccctatcaccttctttaccaccttctctaccattctcatcactgtgagttctctcccggctaatcctgtcatggtcaccccgaggtggcagccctgatttgcgatcatctgttctttgaatctttcttcggccagtacttccaggatcttgctgatcagtataattttcaccatcttcatcaaagacaagatcatagctgcaaaacaacagaagattatcagaaaatgagacgatcaggaaatatgatagatagggaaaagaaaatgaccttcgacggttatttccaccacgctgagtgttttcatctttcaggacataacttgggcctttgtttttctgctcagtgccctggtcacagtctttggctatgtgatcaggggcgccacacttgaagcatccatctgcaaagagaattgcatcatatagctttcatgtgaattaattctaactccaaaatagtaaaaaagtatggtctcacaactaactagagttcaagagtcctagttgagaatgttaaattccgcaatgaagtgggcatctgcgtacaccttcctacttcctagtacctatagattaatgggcttggatgtggtcaacctagaaatataagatgagatgtttcgtatcaaaattatttcataaatcaaccttttctacagaaaaataggaatttcatgatttaatattctatggcaaaggtctcttatgagaattcagttccatggctcaccaattgtgcaagttactctagtagagaaatgatcttaagcagatatgaatattcaggtccattgctcagctcatattgtaagaaataaaacatggtctgttagtttggtactggaagaattaatggctaagttgagtacagggctatttgaaattgatcgtatattacatatacaaagaaaccaacaatctgagtttcagaatgcctagcaaatgatgacgctaggccagtttgctatttgccacaatctgaaccatccgcggcaagtggtttagccaaaaactggtaatataaagactagtaataatatattctgttaggggctctgcagacttctaatatactaagacacagtattcagatcacacttctgccatttacagatgaactccagagaacaaatgcatgttaaagacagagatgcgatactaaagagatgctaaggagaaagcaaaacatgttggaagtcttgctcagattgatgtttactttcttctttgtcctgtggcttattgggaacattgttgccatctttacacttgacacggtttaactgtgctgaataataatcagtacacttctctagacatcttccgcatggtacaaaacactaaattccttataggaataaataaatttctataggatacaggaggatgctataattatggtctgaaaggaaattgagtgccaccaaagtctagatgaaaagaattttgatgaaggatagatttatatagttcttttccttgtaggaaagggtaacagtagaggatctcccctactgcttttccttaagaaaaaagaaagctaccatgcagttagcttaaataaaaaagaaactgaaaactgcaatcatattctaaggccatggaaataagaatacctttatttgcatttcttttgctttgtctgaactgaccccacagttttgaaacactttgactaaagtcaacatgtattcttcgatcatcaatcaaacaattgtccatctgcaagcatatcattgagtaagcaatgctcccatgaaaacactggtaaaataattacaaatatagacaatactgaattgtcaaggcacaaacaatcaagtaacattcactagtcaagcaaaaatgacttataaaaatatgctagcaaagaaatgctaagtaatgaagggaaataaagtacaattacaagaaccaagttttatctgccacatgaaacaggattttaggcaactaaccttgaagaatgcccgctcacaagcctcctttgtctcaaattctacaaaagagcaagataaaatttagcattttataatagcattcagatcttgccaatttatcaaggtggaacaataaattctttctaggccatctactgtctactgcagtctgtgccaaatatcacactgacaccgtaaccctgagagaaaaattgagctatcaagaaacttatattgtttaatacctcagaagtgtgcaatggagctactcagtttgttttcttaaatcgttaatgtttatttttgaggagatacaagtaaacaccattagtctttttgccacgtcatgcatttaacccatttgctggtttattaagtattaacaaactaaaaggtgtgctttacatgctgcaactaaagtatatccatagccactaacatttggaactcagccttacacaaaacaccagaaccttgttgcaaattaggtcactcagttgttccttactaggataacagatctaagagggtaaaacatgatgttcaacacgcctaaagaattggaggatgaatgcctgggaaagctatcaatgaagctcaagcgttcgatgaacggactagcataactctagctaacaacaatccgatgcttgatcacagtatgtcaatgtacaccagcttttgaggaatgaaactcaccaataaaagcatagcataagctatcaccagtcttgtaatcacggattatttcagctctgcaaggaataataaaaaaagttaacaaaataagaaacaggaagatatgcacattaattgaacttaggaaaatgcgcttacgatgtcacagttccaaaacgagaaaaaattgtatataaatcttcatcctacaaaacaatgaacactagccgtttagttaccaaacaatatttcaagctatattgctataaattcaatacctatatgacttccaaactgatctgtgaatctatacataaaaaggtagtggaagtagagaacaaagccaatcaattaagaaccgatacgaacttgtgttactgggttgagtttacaaacaaataaaacgttgtctggtggtttgatctcagcatctggaatatctcccacctgaataagacaaaggtatttttatcagttataacacgatgaataataatgagcgaactgttaattttttatttggcatcaggactcacgctctcaagaatcacagcatttgtatgtgcttctttggagcggatcatctcctcaagttcttcaggagccaccatttcatccatagggacccagctatcctctaagcgctcttctgcaatctgtacattgacagtgaaaagaaaatatcatgaccatgttaaaaggacaacacatagcattcaggagaatcgcggcaaaaccacacccttctaggactaatctgaaacatgcctgtctagatattttagggatcgggataatttgtacagacagaacaaggaaaaaaaatacacctacacccagtgggctgcctcaactgaaattcataccatattcttttaaaaaggtatgtgcacaaataaatagttttcaagaatgtggaggtaaaacgaattaaacaaaagacagcctgtgattttggtgagacaattttggtttatcatctttccaacatgagcaaaatagcagaactcatattacctcatcctgtggtttccctacaggagaattctcaggaataagttcactgagctgaggaggatcgtcaaaaggatcatccaagacatacgtatgtttaatcctgtccattgaacattttgcagaaggtcagcagttggaaataaagcagaaacaacagaaagtaacaccagaaagtaagtaaatattagcaagcatgttctaattattcagtttagactttttaaaaaaggtattttacctgatgtccttaaatggtctccctttatcatcaacatatgtttcactaatctttgtcagcgtgtcaaagccttcagcaaccatgccgaacacctataattgataaggacatacatatgaatcactgtagataaagtggatttttccaaagaaaatattctgtgagtcaatataataaggtactactcactgtgtgtttatcatcaaggtagtctacgtcatcccgcaaggtgatatagaactaataaagtcacagaaacataaatcaaaggttagaaatagcaggttagcagcaaggagttaaggacctcaaaatggattatcaagtactggttatcaaaacagctgagctaagttcggtaggaaggctaggaatatggtatcacacctgcgaggcattgcaattttcaccagcactcgccatagcaatagttcccttttttgaatgcctaaggtctggtcggatctcatcatcaaaaaatcgagcttgatcaccataaaggaacctacagaaaaacaaatgaatcccttttcaggcatgtattcaacaatcagtggcagtaaaacatctgagcaattgtttacttgtatacagaatcgcctccagctcctgttccagttgggtccccagtttgtgccaagaaatccttctccaccttgtggaacaggcacccattgtaatacttcatcctggtaagtcaaatcataggaggaatgaggatgattactcccattgctataaatagtcaactcagctatatttcataaccataaaattactatttcatattcataatactgctattgtgcattattttgcaatatcagtaagcatactttttttttcaattcagataacaaccctaataatcaaagagcgatcccctaattgacccaatctttccatcctacattttaatgactacactaagaaggtaaattcattcacaatgattcacgacacatcagcagcagcttaaattataattaatcttaacccagcagactccatagttcatacacccttcgcggttctagaatacaacaccaaatccacaccaagtagcaccctctgcaacgccaaaattggccgctaaactgcttcgtgagggctaacccctcaaccgcgagacagcgttacccctggtactagccagatgatcccgcgcacttacagatagaacaagccctagatgcgggtaaactgaaagcttacttgcagagcttgaggaagttcttggtggtgagggggcacatgtcggtgtggaggtccacctcgatgtcccccacgctggtcacgatgaggaccgacatctccgcgggcgttttccccccttctcgccggcggcaagagcacacggcggccgcgacggcgcgggattcaaggggaaaaatacacaaatcacggaggagccgcagcgccggatgcttctgggagctcaggcgactggttcgcgcggccgcggatactcaccggcctccgccgccgccgccgaaccccaaccgcctttctaaacgccgacgaggtgtttctattttttttcttttttgttttttatgacaaaaaattggtgatttctgagcgcttaaaccgtctaccgcactaggctgcgtgctacggagatgtaagggccgaccctgaattctcggcctgggccagaaaaccatgaccaagaaatatctgggccttgcccgcgtatatggcccaatttggtcatgctatgcttttcgtccaaccctgcactgttgcacagggtcttttgggtagcttatagtctgtttgagggagcttaaaattctgagaagcagctggttggtaaccagcttttgaaaatttagaaaggctgggttttccaggcttctaatttctagtccaatttatggattcgatgacgacagcctccaacaatgtgaaccaaaaactgggctgtatgggggagcttctgattctagaaggagctagtagctagttaggagctcccccaaacaggccctaagactcattttatagattctataactatagcttctcataattcgatgaaaagctagatagttttgggaagcttctaccagttgtatcttctcccagaatcagaagctcttccaaactgtccaggcccacaaccgcata

SEQ ID NO: 30357 - DNA, 717 bp, Oryza sativa
  unsure (1)..(717): unsure at all n locations
cataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggaggcgacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatgctaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgnnnnnnnnnnnnnnnnnnnnnnnnnnnnnnnnnnnnnnnnnnnnnnnnnnnnn

SEQ ID NO: 30358 - DNA, 1340 bp, Oryza sativa
ggttagggttcttgttagctgaatttgtgttcgaagtttggggtagctaataatgttttaaataacaaacaattgactggctactttcatgattactgtgatcagattgcattagttgcctaccacatgcttactcttaatccacctgtgttcttctggatatctagtgtcaagttgaccgcatccatgtcctctcaaacttactttgcaggatttgatcctgattgggctggctacaacagccatagaaactttatacggaacttttctttttcctgaataactaaataggatattattatcatggtttcgtggtatatagtttctacagatatgaaatgcattagctatgtcaataagggcatattttatgttctacacaacacttgcatttgacttcgatttgttatagtgcaatgtcctgacattttgactctacctgattgcagctgagcttgctgtcatcatgtaattctggtggggacccaattaagtctgaaggcatggaaaatcttggatctccacagagttgccatctcccgttcatgtaatacttcagttactctcgttttctaggtgcttgtaatctgattttatcccatcttgctgaagcaacttttcgtactccagggtaacaagtgagtgagggagaactgcttgtatgcggacgaagcttcagttgtttccacaagacgttcttgtgttctctttgtactggagttgtggacggctgatccggcagtttaccaacgctagcacgtgttgtggccgtggcatctgtatagcttccaataatgctctaaccctaggctagttttgctcatcaatcatgttcatgtagatagccagttttgtgtgctcagcaattctttttccctcggggtggggcatggctcgaaatgtttttgtatgtgtacatctttgtatacatgtatgtaaatatgtgtgatcatgtaatgcttaaagatactgttgactgatttgaggtaataatacaataaaccagtggggcactcgggtgtagtctctagggcgccccactgttgtgaaatgtgagctctgaagttgtggactatcttcaaagctatgacctagtcgagatatgtgttcatctaagttcgtttgagtttgcagctggtattgattgcgctatggttctatagctgctgttgtacaacccatccccaatgtacattttcgaccttcttggcacctgtttgtatccgaatactgaattgatatgcattttcattttatctgaaactgaagtgcatcttcatttctaccctcatcatttgctctttggtttacaggttgcagttaaaaattgaaatttttaa

SEQ ID NO: 30359 - DNA, 687 bp, Oryza sativa
  unsure (1)..(687): unsure at all n locations
tgatggggtgcagcagtaacagggtcactcgcacccatgcttgaatcactctgactatctaataagcatgtcaaagaacacatcccccaagaaattctgcagtgcaatgttctaccaaggtaacaacaatgaagtgtccagaacactgtctcaaagtctaaggatacgtgggttcccatatacattggatgcaaggtctttcaagacatccgccatctgcgcctctgaatacagcgtcgcaccggcatggtccaggtaagccatccctgctcctcaagatcaagaaagaaagaaaattaaaaatctagaaacctgctacaaatacaagcacatttgtttttttatatataatggaaatcaacccggatttgcttcatagaagctatagccaattcttattacatagtttgcagctcacactactgcagttccaaacatcaaaacaagcacaattgttgaagcttatgtagcaaaattcggtaggatgctagattcttcactctccgcaacaacaaacctaatagatttatcgatacaacagtgagttacagcaagaaacgcggtcatctgaccgaacgccacaagttcctatccatccttttgttctcacaaaacactaatagnnnnnnnnnnnnnnnnnnnnnnnnnnnnnnnnnnnnnnnnnnnnnnnnnnnnnnnnnnnnnnnn

SEQ ID NO: 30360 - DNA, 1036 bp, Oryza sativa
  unsure (1)..(1036): unsure at all n locations
aatgcgtgggtaaaatttcaccacatgaagatgccccaatagagatgttaaaacagagacttaggaaaggggaaggatgattttttgtgctcttacacgcaaatgtattccaaacaaggaagcaagcttctccacctcacggtatccaaaccaagagccatcttctcttttcaaattgaatgtgattgtagggcccattttcagaccttccacctaaaacataatacatagaaaagaatagataagtgcagagagctagcagaattcaagtgggcacttcagaatatcttattcataatggcttgttcttatatggatgacaaataatccaaaccaatggaagaaaagtaaataaagcagcagtaattcttaataagaagatagaaatataatgagatataacttagttatggaaccttggaatactgttgtccatatattgtgcaaacatttatctcattactgtgcttcaggtccagcattttgtttctcacataagtagcaagggatgtagtatgcctacaaaagaacatcagggtgtaaactatacatcatggatagggtgctaggacccaaactgtcttacgtaccgttcaattgcagaggtagtgagcatttcaatgatcttaaacccatgtcggagagaagctatgttcaagaacgagattgttccatcctctagaacctgttcgatattctttcttttttgaacaaagtcgatgtcagcaattgaagcagctacggttcctggaatttaataacaattccggaggtaagttaaaaaccaggatatagaaaatagattactcaaaaccaagtataacgagctgtgaccacaaacctccactaaaatatgtcttgttcaacagattagcagcctctgccataaaatggaaaatatagaaaaggtcattagaaaggttatcattcccttgcaaagaataatgatggcaacgatttacagattgctgttgttagttannnnnnnnnnnnnnnnnnnnnnnnnnnnnnnnnnnnnnnnnnnnnnnnnnnnnnn

SEQ ID NO: 30361 - DNA, 389 bp, Oryza sativa
tatcagcttagctagcagtggctagctagccatgagtaatagtggcaaggagcagcggcggatggaccggttcatcgtgatccccttctccacctgccgcaatggatccagcgtggacgtcgtcgatggcggcggcaagagcggcaagaagccccaaggttcgttgtttggagtcttggatgcttattcttcacttctgctctatcttgtcgattgttttttgcggggtgatttaggagtttggtattagtgatgttgtgtacgtgtctaggcggcggcggcgagggtggcggcgcggcggaccaccaccgccagcacgtggcgcacatcggctgggacggcagcacaaacaccaccaccagcctccgctcatggaaccgcgccgcgcc

SEQ ID NO: 30362 - DNA, 628 bp, Oryza sativa
  unsure (1)..(628): unsure at all n locations
nnnnnnnnnnnnnnnnnnnnnnnnnnnnnnnnnnnnnnnnnnnnnnnnnnnnnnnnnnnnnntatgatccttttgacgatcctcctcagctcagtgaacttattcctgagaattctcctgtagggaaaccacaggatgaggtaatatgagttctgctattttgctcatgttggaaagatgataaaccaaaattgtctcaccaaaatcacaggctgtcttttgtttaattcgttttacctccacattcttgaaaactatttatttgtgcacatacctttttaaaagaatatggtatgaatttcagttgaggcagccactgggtgtaggtgtattttttttccttgttctgtctgtacaaattatcccgatccctaaaatatctagacaggcatgtttcagattagtcctagaagggtgtggttttgccgtgattctcctgaatgctatgtgttgtccttttaacatggtcatgatattttcttttcactgtcaatgtacagattgcagaagagcgcttagaggatagctgggtccctatggatgaaatggtggctcctgaagaacttgaggagatgatccgctccaaagaagcacatacaaatgctgggattcttgagagcgtgagtcc

SEQ ID NO: 30363 - DNA, 1095 bp, Oryza sativa
  unsure (1)..(1095): unsure at all n locations
nnnnnnnnnnnnnnnnnnnnnnnnnnnnnnnnnnnnnnnnnnnnnnnnnnnnntgtttgtcgccgggccgatgtgaggcccattatagttaggcacaagttactgctgctgctgctgtgattctccacagcccgaactgttttctctttgttttgcacactgcggcccatatgcaagaggtggctggcaaaccgaagcagggacatgtttagtaccataccgcttgttttggacaagatgagctagttgttccgctacttatatagtcaggaagctactagttgaaaactcaagcagctgcgtggtgagcacaaaagcgaactattcttataccttttactaaagaataccgtgtacgcgccacaaatagcagcatacttttatttttggagggtgttttctcttggaaaaaattatctctttagattagactcaatttccaaagctaaatttgttagttttgtttgacactactgtacgcacagttttggagggtgttttctctcgtaggaatacaaatcaaagttcaagatctatcttttaaaattcaagctcaaagttaagtttgctagttttgtttgacagatgatgtgggttggcctgctaatcatgctagtaggggatggcaaaaatgagctactcaatgtaagtcattctaacatttctcacatttatattgatattaatgaatctagacatatatatctatttagatttattaatatcaatataaatgtggaaaatgctataatgatttacattgtgaaacgaagaaagtagttagtgtgaactaaaacaacattttcaaattacatagttacattagtatttttagtatgccacagtagagcagagtatggtcaagaaagcgttgcgtttgccttcaaaactactacataaaagcttggcttagttgaaactaacttgtgtattgtcgcttgcatttccctttcaggacaaaccattgtcaactgcagtaagttcaccataaaaaacaataggaaatgcacatgatttcagtaatcctctatcgagcacaagttacaagtacaggatcatatcaagatattgccgctattatttttctgagaaaaa

SEQ ID NO: 30364 - DNA, 385 bp, Oryza sativa
tctgaaaatgggccctacaatcacattcaatttgaaaagaaaagatggctcttggtttggataccgtgagttggagaagcttgcttccttgtttggaatacaatttccgtgtagagcacaaaaaatcattcttcccctttcctaagactctgttttaacatctctattggggcatcttcatgtggagaaattttacccacgcattacatgataaattagagctatgaaaatcaaagttctaaaatatgagaatccaattacgtttttatgaatgacaatatttctttatgagttccatccatagttaatgcaccagcagcacttgtagatttatgaacaagcagctacatgtgctgtgcaagtcctgtgacaggtgatggattat

SEQ ID NO: 30365 - DNA, 644 bp, Oryza sativa
  unsure (1)..(644): unsure at all n locations
nnnnnnnnnnnnnnnnnnnnnnnnnnnnnnnnnnnnnnnnnnnnnnnnnnnnnnnctaataaccgccgggaacactttccagcgcacggtccagggcgcacttagcaaccagcttggcaacaatgtcgaggcttacgttgacgacatcgttgtcaagaccaagacaagtgactcattgattgacgacctgcgggaaacgttcgacaacctccgacgatatcgcctcatgctcaattcagagaagtgcacattcggagtaccgtcgggcaagctactcggattccttgtttctggtagaggaatagaggcaaatcccgagaagatcaaagcaatcgagaacatgaagtcgcccacaagactcaaggaggtacaaaagctaaccggatacatggcagcattaagcagattcgtcactaggatgggagaacgaggacagcctttcttcgctttgttgaagaaacaagacaaatttgtatggacacgggaagccgaagaggcatttattgcactcaagcgctacctatcaaacccacctgtactcgttgcttcccaacctaatgaagaattattctttatattgccgtacgccatattccgttagcactgtcattgtagtcgagagagagaaagtacatcgaccagtt

SEQ ID NO: 30366 - DNA, 514 bp, Oryza sativa
  unsure (1)..(514): unsure at all n locations
nnnnnnnnnnnnnnnnnnnnnnnnnnnnnnnnnnnnnnaaaatgttcaatggacaggattaaacatacgtatgtcttggatgatccttttgacgatcctcctcagctcagtgaacttattcctgagaattctcctgtagggaaaccacaggatgaggtaatatgagttctgctattttgctcatgttggaaagatgataaaccaaaattgtctcaccaaaatcacaggctgtcttttgtttaattcgttttacctccacattcttgaaaactatttatttgtgcacatacctttttaaaagaatatggtatgaatttcagttgaggcagccactgggtgtaggtgtattttttttccttggtctgtctgtacaaattatcccgatccctaaaatatctagacaggcatgtttcagattagtcctagaagggtgtggttttgccgtgattctcctgaatgctatgtgttgtccttttaacatggtcatgatattttcttttcactgtcaatgtac

SEQ ID NO: 30367 - DNA, 1381 bp, Oryza sativa
caaacagttatgtcaaaacagttcagatggtgaaaatcttgagcaatgcacaaagtaaggaaacttgtgcaataccttctgcatgaggaaaccagcaacagaaggtctcaaatacttcgtaactccctctgttgaagcatgagctctgtgtgctgtgccaaaggcatcatttacataaaggtcagcaacagatgccagcttattggcgaattcagggtcatttttctcttcctccttgtagaaccgaacattttctagaagcagaacaccaccatctggtaaagtggcagccaatttctggacttcctcaccgatgcagtcattggccatcacaacctacgacaaggacatcatcaaaacatggaaatataagatggtctaccagtttgtagtaagcagaattgcagaataataaatatgatttatccttttatagcatacatcaacaccaagaagctcagacaagcgcggaacaagaggcttcaagctgtacttcggggttacaccttttgggcgaccctgaaaagacaaaattgattgcattacaacagaggacaagagaaaacaaaaaggggggcgaaagaacattatcccaagcatagaaacacggttagctgctgcccttttttgaacatacaatttcagtttcatttgccattttaacataacccaattatatggcatggggatttttgaggactactgcactttaaacatgtggctctttctataaccaaaatgttacagaggtggattttgcatttgacttacacaacataggagaaccaaagtttaaagaaaccgtggtgcattacagtgattttgtaaaagggaattgtgcctcttgcaagcaagtgttgggcattgatggaaaccattaataggtatttgtatcaaaattagatatacataataacaacacaattaagtaacaaatgccacattctggtagtaaaatcgcaagataaataaaagatcactcaaaacattactctgtgaaatcatcgctcactgtaatcagtctaaaaatacagtattaaatttatattgacaccttaacctcctatcgtaaccatgaatctgcacatagttaccacttaaaattcactgtgaacctatcaccctttgatgaatcataaaatcgatactgtttatatagcatgtcacatcatccaaaacggaccaccaatctcacatatcacacaacctcatgctcaaacacattatagcaacgtagtaatcctcaccagatggctggccaggatgaccttggcgcccttccccatcaagaacttgatggtgggaaccgacgcgcggatgcgggtgtcgtcggtgatcttctggctgtcatccagcggcacgttcagatcggccggaggaa

SEQ ID NO: 30368 - DNA, 529 bp, Oryza sativa
gatgccagacttgagtaatttgtggctcaggccacgattttcattgtttgtggttcaggcttgaagagcgatcaaaaccaacgaagttgcaggtttgatagtgtgacaggttttggtacatttttggtagcacgaatgcacgatcaactaaccaatataaatttaacgccaacattaatcacatcaaaactgtgatcacagctcagatatgatccgttggacaaaatttgtcgttgcatgcaaaatatatcaggcaaaatttgtcgttgcatgcaaaatatatcagggacacaagcacaggaaaccaaacatgacagcgctatcattttgtccctgcatagttgatatattaaatgaagttgcattgacaataattgctgatgatgtaggagtactataaatgtgataaattgtcgaatttactaaggtcagattggaacatcaaaaaagtagtaattccatccaagccattaaaaagcacgcacaggattgcctgtgaaaggcacaccctttgtattctaccattgta

SEQ ID NO: 30369 - DNA, 789 bp, Oryza sativa
  unsure (1)..(789): unsure at all n locations
nnnnnnnnnnnnnnnnnnnnnnnnnnnnnnnnnnnnnnnnnnnnnnnnnnnnnnncgaatctcccgctccgcagcagctcaccgagctgcaggtgaaggtcgggggacggctcggccgagttgatggtgttcttgctgagcaccgtgatggtgcagcgcacggcgaaggagtcgccggtgatgaaacccgacgcctccagctccctccgcttcacgagcagaacccacggcgagctctcgttcgcggacccgaacgcgtgcgactgtcgctcttcttctcggaagcatgggagcgcgtggtcgacgggtgcaccaggcagcagctgagctacgccttgatggcgccagcgtcgttgtcgtcgtcgtcgccgccggcgcgctgcgcctgctcgccgatgccgaggaagacgagcttgaaggcgacccagtagtgccagtgcgcatcgtggccttgggtgtagtggatctcccacgcatacccggccacggtgagacgcttggaagagacatgctcgtgtttggccatggctttcgtggccgagtagccattgacgttgaacttgtggacggcgcgcgcggcctgggtgaggtttgaggagggcgccattgatgcggatcccaggcaagctagcggaggcgaacgagcctgagcaaagggagcgttatatacagatgtctgcacggcttgggtgaacgcgaaccggtgtaccgctctcgagagtggttcgcgaatcgtgcttgcgtttttccaggcagcgctcttgtaaatccagagaattttagagatct

SEQ ID NO: 30370 - DNA, 664 bp, Oryza sativa
caaatttgactaattttgtaaaaaaaagtataatatcatttacgaatttggtagtcctattttctttccgcttcccactcgagtaagttctcgatcgactgcaggcatgcagccaattgtgcttaattccatgatttcaacctatactccatttttccatttagggcgcattctttggctaccttctcgatttttgttagcatattttttaaaccgttagccgttaaaaggtatgttttgtagagataaagtttagaaatggcacgtttatgcatgctgcatgttttttcatgaacaattaatttttattttataaaaatatttaaattaaacccaaaattatgaaatttcaatttttatatttgaaatatccagtctagctattggctctaagcatttcttttgtttatgcaacttgatacaattatttctctcattattttttgtagatggattatagttatgacggcaatagctctgagaatgtgattacttttatcttgccatttctcatggtagcagcggcggtaggagtggtcggatacctactctaccgtctatgcagcatgcaccagcgacaatcgtgactgcaggatatgcctacaggaataggaggtcggcgacactatggccagtttactctacggacaccggttttaccaca

SEQ ID NO: 30371 - DNA, 436 bp, Oryza sativa
  unsure (1)..(436): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcattgctgccttgacaatccagctgctcacactcatggttcctggcagatttaggtcgtttggtcagtactgctactgcagcaacactatcaggttcaatcctcggagtacttgatatgcgcttactcctcgttatctcaaggaggtggtaggtcatgtatgctaatctggattcttgatcacaggagcttggcaaagaccttgagatcaagcaagattgaccctccaacattctgtgagaattttcagtgatgtctctcagaagagagggtaccgagctcgaatt

SEQ ID NO: 30372 - DNA, 970 bp, Oryza sativa
gggaacccgcgcgccccggcgcgggcgaagttgccggccccggcacggcggcggacaaggggaagccggcggggcggagggtaacgaaggtaagcgaagggtgcccatctcgtcggcaggtggggagtggtgcgcggcggagtggtggactcgaggagtgcggcttggcttggcttggctttgcgctggcttgggaggcggagaggcgagaaaggaaaagaggggtttgggtgggggatggacgggcggggatctgctggtctcccgatcggacggtgaaggcgctcgagcgcgcggcgtggcaggaggtgtgtggccggcggtggggatgatgcggataaggaacggatgattgtgagtaggctgatcgagacgggaggatagacagaccgccactgcggcaacaacgtctactctgtccatcttattaaaaaaccaatctaatattagacgtgacacattttaatactataaatttagacatatatctagagacgcggtatggagatgaatctggatatatctctaaggacacggtgttgagacgggcgagtggattcttcagagatgggagcatcacgagaggctgcgtcacggaaggatgctatagctagaaaattgaagggttaattggatccatgccactgcaaatgtggcaaatcaaaaaaataccactactattcacgttatcgggtagatgccactgtaatcttctaaaattagaaccatgctactcccgtcactattttcggcctcctctctcacgtggtcatcctcctcactcacgtctgcaaggggaaaaggcgacgtggtgccggcgagcggcgaagatgaggcggtgccagcgagaggacggggagcaggcaagcagcgaggaagaggaggcgctggcgagcggtggaggtcaagaccgccgccggcaaggatgctcgcggggaggtcgtggaggggcgcggggagcgggcgcagt

SEQ ID NO: 30373 - DNA, 603 bp, Oryza sativa
ctaataaaataaatggtcaaacgtgtcttaaaaagtcaacggtgtgatatattaaaaatgatggagtagctatttgatagtaagattgttcaattgtgtcattattttcttctcacttggtttagcaattatagtacaagaggtagtgactagttaaaacaaaaaaccttgtgagactaagcgaaagtaggggtggatatcgagctggctcggctcggctcgctctagctcgttagaataacgagctggctcggctcggctcgctatcctaacgagctaaaagtctgtctcggctcgggtcaattgtaagcttgagccagctcgtttagctcgcgagctagatttggacgacgcatgcccagagctgagctggatctggaagggcgagcgaacgacggactccatggccgacgagtcaagaaggagcaccacatagcagcgccggccagacctcgtcggagcagtggactccacgacgaccaacaaatcgagcaggaggagggccacatggctatggcgcggcggtgctggctggacctcgtcggagcgacgtactcctcgggcgacgaatgaaaacacgcggatgggaggtgatgccggcaa

SEQ ID NO: 30374 - DNA, 2031 bp, Oryza sativa
  unsure (1)..(2031): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccactcctgcacgttgcaggagaaatagacccaatgttctgcaatccccaactgacgccgttccttgtaaagctccccactgcggacaagtgagtggaagttccgattgactgatgcaatggagccataatctgaacgagagcaacgggcgaggcaactgattgagttatctcgaccgatagaacttattagggtacttgaatccgaaaaaccctgatcattgctgccttgacaatccagctgctcacactcatggttcctggcagatttaggtcgtttggtcagtactgctactgcagcaacactatcaggttcaatcctcggagtacttgatatgcgcttactcctcgttatctcaaggaggtggtaggtcatgtatgctaatctggattcttgatcacaggagcttggcaaagaccttgagatcaagcaagattgaccctccaacattctgtgagaattttcagtgatgtctctcagaagagagaacctatacacaagaatccaggccttctgtattcattgtgaacctgcaagagatcataaattaatatcattctactgtgtggaaaaattgatgatcacatttgtatacataactcaatttgcaagatattgtgaagagcttcaccaaggtcagtcgaatgagatctatataattaaaatttacaatccaagaacaagacaaattaaatttcacaaaaactgattaataatgaaggcttggccaaacgattaatgaaacatcatttttgtgaataaatagaacatggcattcattaaatcaaacctaggtcttaacttaacgcatgaaactgataaaccacagaaaatgcccaaagctactccacggtaccacttcagcacagatctttcggaactaaaatgtgaaccactgcaaccaatcatttttaggagttgccattaatcattgaggatagcgattaaagatatagaaattgaagttgaacaaagtggtgctctcattgggtcctaaatggttcgtatacttcttgtacgggttactttatcatcaaaccaaatcaagttccagggcaaatcaacttatctgtgtaattagcttttttttctgtctcgcgatgtatcccttcctagatgaacaagggctggcggttctaactaagcaattataaaataaataaaattaacatgatgcctaacaggtcgcggagaacaaaaatcctatcgtgcagcaacagtatgcctgaggaaaattaatgttgctccatataattctccatggttgaaagttcgacggcaaatctgacgcctaagatgctttagtcccaaaactccacccctccaagtaagctacaattagtgccatcaaaccggtattaaccacggattgctcatccgactgatttgacctaaattctccaagtcgcccattatacaagaacaaaggatgaacaattcaaccgaaacaaaccatgtaaattaggtgagatgagaagcgaggacaaacgtagataagacaatacgccagctacctggcaatcaatctcgcctcaaaaccaaccgtgcccccgccccgcgcgcggcgacaaaatctcgcccaccggccgccgccgacacggcaggcgcccagcgacggcgacgagtgcacggcacccccccgggcggcggggatcgggagagaaacggacgcgcgcggcggagaagccgcttgcgggaggaaccgcgcggaggcggaggctgcggcggcgcggttacgggagcacgcggaggcggaggcggaggcggaggagcggaaagggagggtggggagaggtggaagag
